United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 74

SEQ ID NO: 141221 - DNA, 1485 bp, Artificial Sequence
  Description of Artificial Sequence: Synthetic coding sequence
atggggcggaaaaagaaaaagcaattgaaaccttggtgctggtattgtaaccgagatttcgatgacgagaagatactgattcagcatcagaaggcgaagcactttaagtgccacatatgccacaagaagctgtacaccggtcctggtctggccatacactgtatgcaagtgcacaaagaaaccattgacgccgtgcctaacgccatcccaggccgcacagatattgagcttgagatatacgggatggaaggtattccagaaaaagacatggacgaaaggaggaggcttttagaacagaagacccaagagtcccaaaagaagaagcagcaggacgacagtgacgagtacgacgatgatgacagcgcggcctccacctccttccaaccacaacccgtgcagccacagcagggctacatccccccaatggcccagcctggcttacctcctgtgcctggggcaccgggcatgcccccaggaataccacctcttatgcctggtgtcccaccccttatgcctgggatgccacctgttatgcctggaatgccccccggccttcaccaccaacgaaaatacactcagtccttctgcggggagaacatcatgatgccaatgggcggcatgatgccgccaggccctggaatccccccgctgatgcctgggatgccccccggtatgccccctccggtaccccgcccaggcatcccacctatgacccaagcccaggcagtgagtgcaccagggattctgaaccgcccccctgctccaactgcaaccgtcccagccccacaaccgcccgtgactaagcccctgttccctagcgccggtcagatgggtacccctgtaacatccagtagcaccgctagctctaattctgaatctctcagcgcttcatcgaaagcgctgtttccttccacggctcaggcgcaagcagccgtccaaggcccggtgggaaccgacttcaagccgctaaatagcaccccagcaacaactacagagcctcctaaacctacatttcccgcctacacacagtccaccgcctcaactacgagcaccaccaactctaccgccgccaaacctgctgctagtatcactagtaagcccgctacactgacaacaaccagtgccacttctaaattgattcatcctgatgaagatatctctctcgaagagagacgggcccagctcccaaaataccagaggaacctgcctcgcccgggacaagcaccaatcggtaatccacccgtaggaccgatcgggggcatgatgccaccacagcctgggatcccacagcagcagggaatgcgaccgccaatgccgccacacggacaatatggcggacaccatcaggggatgcccggctatctgcctggagcaatgcctccttatggccagggacccccaatggtgcccccttaccagggcggacctccacgcccccctatgggcatgcgccctcccgtaatgtctcagggcggtcgctattag

SEQ ID NO: 141222 - DNA, 1344 bp, Artificial Sequence
  Description of Artificial Sequence: Synthetic coding sequence
atgggccgcaagaaaaagaagcaattaaaaccttggtgttggtactgtaaccgcgactttgacgacgaaaaaattctgattcagcaccagaaggctaagcacttcaagtgccatatttgtcataaaaagctttatacaggacctggtcttgccattcactgcatgcaggtccataaagaaacaatcgatgcagtgcccaacgctattcctgggcggaccgatattgaactggaaatttatgggatggaaggaattcccgaaaaggatatggacgaacggcgccgtctgcttgagcagaaaactcaagagtcccagaagaagaagcagcaagacgatagtgatgaatacgatgatgacgattcagctgctagcacatctttccaaccacagcccgtgcagcctcagcaaggttacattccaccaatggcgcagcccgggctgcctcctgtgcccggcgcacccggcatgcctcctggcatccctcctctcatgcccggggtgcccccactgatgccagggatgcccccggtgatgccaggcatgcctccaggaatgatgcccatgggaggcatgatgcccccaggccctggcatcccccccctgatgccgggcatgccacccggaatgccaccaccagtgccaaggcctggcatcccccccatgacccaggcacaagctgtgagcgcaccaggaatcttgaataggcctccagccccaaccgctaccgtccctgcacctcaacccccggtcaccaagccactgtttccttccgcgggacaggcccaagcggctgtgcaaggcccggtcggcacggacttcaagcccctcaatagcactccagcaactacaacagagcctccaaagcccacctttcccgcctacactcaatcaaccgcatctactacgtccactactaacagcactgctgccaagcccgcagcaagtataaccagtaaacctgcaacattgaccactacaagtgccacctccaaattgatacaccctgacgaagatatctctctggaagaacggcgggcccagttgcccaagtaccagagaaatctgccccgtccgggacaggccccaataggaaacccacccgtcggaccaatcggtggcatgatgcctccccaacccggcatcccacaacagcaggggatgagacctcctatgccaccacatggccagtacggaggtcatcaccagggtatgcccggatacctgcctggagcaatgccaccctacggccagggcccccctatggtgccaccctatcaggggggccccccgcggccccccatggggatgcggccccccgtgatgtcacaaggagggagatattag

SEQ ID NO: 141223 - DNA, 1491 bp, Artificial Sequence
  Description of Artificial Sequence: Synthetic coding sequence
aacacagtaatgggtaggaagaaaaaaaagcagctgaagccgtggtgctggtattgtaatagggactttgacgacgaaaaaatcctgattcagcaccagaaggccaagcatttcaaatgtcacatttgtcataaaaagctgtataccggccctggactggctattcattgcatgcaggtgcataaggaaacaatcgacgccgtgccgaatgctatcccaggccgaacagatatagagctcgagatttatgggatggaaggaattcctgaaaaagatatggatgaacgtaggcgtcttctggagcaaaaaacacaggaatctcaaaagaagaaacaacaggacgactcagatgaatacgatgatgacgactcagcagcctccactagcttccagccacagccagtccagcctcagcaggggtatatccctcccatggctcaacctggactgcctcccgtgccaggcgccccaggcatgcccccagggattccaccactgatgccaggcgtccctcctctgatgccggggatgcccccagtgatgccagggatgccaccagggctgcatcatcagagaaaatacacccagagcttctgcggggaaaatatcatgatgcctatgggcggaatgatgccgccaggacccgggatcccaccgcttatgcctgggatgccacctggaatgcctcctcccgtgcccagaccaggaatccccccaatgactcaagctcaggccgtgagcgctcccgggattctgaatcgtcctcctgcccctacagcaaccgtgcccgcacctcagccgcccgtgacgaagccactttttccttcagccggccagatggggacccccgtcacttcaagtagtacagcttcaagcaattcagaatcactttctgcctcctctaaagccttattcccatcgacagcgcaggcccaggccgccgttcaggggccagtaggcactgacttcaaacctcttaattctacgcccgctacgacgaccgagccacccaagcctacttttccagcgtatacccagagtactgcctccaccacctctaccaccaacagcacagccgcgaaacctgccgctagtatcacgagtaagcccgccactctgacaaccaccagcgccacttctaagttaattcatcccgacgaggatatttccctggaagagcgtcgggcacagttgccaaagtaccagcggaacctcccccgacctgggcaggctccgattggcaacccccctgtcggcccaatcggaggcatgatgccgcctcagcccggtatcccccagcagcagggtatgcgaccgcctatgcctccccacgggcagtatggaggtcatcatcagggtatgcccggctatttacctggagctatgcccccatacggccagggcccacccatggttccaccctatcagggaggaccccccagaccaccaatgggtatgagacctccggtcatgtctcaagggctgccttag

SEQ ID NO: 141224 - DNA, 3843 bp, Artificial Sequence
  Description of Artificial Sequence: Synthetic coding sequence
atgggctctctcacgttcagggatgtggccatagaattctccctcgaagaatggcagtgcctagatactgctcagcaaaacctctataggaacgtaatgctagagaactatcgtaatctggtgtttctgggcattgccgccttcaaaccggacctgattattttccttgaggaaggaaaggaatcgtggaatatgaagcgacacgagatggttgaagaaagtccggtcatttgcagtcacttcgcccaggatctttggccggagcagggaatcgaagattctttccagaaagttattctgcggagatatgaaaagtgtggccatgaaaacctgcacctgaaaataggttacactaacgtggatgagtgcaaagttcataaggaagggtacaataaacttaatcagtccctcactacaacccaaagcaaggttttccaaagaggtaaatacgccaatgtcttccataagtgcagcaatagcaaccggcataagatcagacatactggcaagaagcacttacaatgcaaagagtacgtgaggtcattttgcatgctctcccatctttctcagcacaagcggatctacacacgggaaaacagctataagtgcgaagagggtggcaaggctttcaactggtcatccaccctgacatactacaaaagcgcacacaccggcgaaaaaccctatcgctgcaaagaatgtggaaaagcattttccaaatttagtatcctcactaaacacaaagtaatccacaccggtgaaaagtcatacaagtgcgaagagtgtgggaaagcattcaaccagagtgccatcctcacaaagcacaaaatcatacatactggtgagaaaccaaataagtgcgaggagtgtggcaaggctttttccaaggtgtctaccctcactacccacaaggccatccacgcaggagaaaagccctataaatgcaaggagtgcggcaaggccttctcgaaggtgagcaccttgatcacccacaaggcgattcacgccggggagaaaccctacaagtgcaaggagtgtggcaaggcattctctaagtttagtatcttaaccaaacataaagtgattcacacaggagaaaagccttacaaatgcgaggagtgtggaaaagcatataagtggcctagcaccctctcttatcataagaagatccacacgggggaaaaaccttacaagtgcgaggaatgcggcaaagggttttctatgtttagcatacttacaaagcatgaggtcatccatacgggcgagaaaccttataagtgtgaggagtgcggaaaggctttcaattggtctagtaacttgatggaacacaaaaagatccatacgggggaaaccccgtacaaatgtgaggaatgtggaaaggggttttcaatgtttagtattctgacaaaacataaagtgattcacaatggcgagaagccttataagtgcgaggaatgcgacaaagcaacgcatgccggggagaagccttataaatgtgaagagtgtggcaaggcctttaattggtcatcgaatctgatggagcacaaaaggatccacactggcgagaagccgtacaaatgcgaggaatgtggcaagtctttcagcactttttcaatactgactaagcacaaggtcatccatactggggaaaagccctataagtgcgaggagtgcggaaaagcctacaagtggagttcaaccctgtcttatcacaagaaaatccacacggtcgaaaaaccgtacaagtgtgaggagtgtggcaaggcgtttaaccagtccgccatcttgataaagcacaagaggatccatactggtgaaaagccttacaagtgtgaggaatgcggcaagactttttctaaggtctcgacgctgaccactcacaaggctatccacgctggtgagaaaccttataaatgtaaggagtgtggcaagacttttattaaagtttctacgttgacaacacataaggcaattcacgccggtgaaaagccctataagtgcaaggagtgtggaaaggccttctccaaatttagcatccttaccaaacacaaggtgatacataccggggagaagccatataagtgtgaagagtgtggcaaggcattcaactggtcctctaacctgatggagcacaaacgaattcacaccggagaaaagccttataagtgcgaagaatgtggcaagagctttagtacattcagtgttttgactaagcacaaagttatccataccggtgagaagccttataagtgtgaggaatgcggtaaggcttacaaatggagctcgacactctcttaccataaaaaaatccataccgtggagaaaccatataagtgtgaggagtgcgggaaggccttcaatcgttcagccattctgatcaaacacaagaggattcacactgacgagaagccttataagtgcgaagagtgcggtaagacattttctaaggtgtcaactttgacaactcacaaggccatacatgccggggagaaaccctacaagtgcaaggaatgtgggaaagcattcagtaagttctcaatcttgactaagcacaaggtcattcacaccggagaaaagccatacaaatgcgaggaatgcggcaaggcctacaagtggccctccactttgtcatatcacaagaagatccacaccggcgagaaaccctacaagtgtgaggagtgtggaaagggtttttctatgttttctatcctcaccaaacacgaggttatacacaccggagagaagccttataaatgtgaggaatgtggcaaggcttttagctggctctcagtcttttccaaacacaaaaaaacccacgccggagaaaagttttataagtgtgaggcttgcggaaaagcctacaagagctcgtccactctgtcatatcacaaaaaaatccacactgaggagaaaccatacaaatacgaggaatgtggcaaaggcttttctacttttagcatattgactaaacacaaagtgatccacactggcgaaaagccatataagtgtgaggaatgcggtaaggcctttaattggtcgtccaatcttatggaacataagaagattcacacaggggagactccttacaagtgtgaggaatgtgacaaggcattctcctggccttcatccttaactgaacacaaggccacgcacgctggggagaagccgtacaaatgcgaagaatgcggaaaggcctttagctggcctagccgcctcactgagcataaggccacgcacgcaggagaggaaccttataagtgcgaagagtgcggcaaggccttcaattggtcttcaaacctgatggagcacaagcggatacacacaggagagaagccctacaagtgtgaagagtgcgggaaaagtttcagtacattctccatccttacaaagcacaaggtcatacatacaggagagaaaccttacaagtgcgaggaatgtggaaaagcctacaaatggtcctctacattgtcctatcataaaaagattcacacagtcgaaaagccctataagtgtgaagaatgtggaaagggatttgtgatgttcagtatcttagcgaaacataaagttatccacaccggagaaaaattatacaaatgtgaggagtgtggaaaggcttataagtggccctccactctcagataccataagaagatccacacgggggagaagccctataaatgtgaagagtgcgggaaggccttcagtacttttagtatcttgacaaaacacaaggtgatccacaccggcgagaagccttataaatgtgaggagtgtggaaaggcgttttcatggttgtccgtgttttctaaacataagaagatccacacaggagagaagctttag

SEQ ID NO: 141225 - DNA, 123 bp, Artificial Sequence
  Description of Artificial Sequence: Synthetic coding sequence
ggaaaaggtttttctatgttctccattctcacgaagcataaggcgactcatgccggagagaagccctataaatgtgaggagtgcggcaaggccttcaattggtcatcgaacttaatggaatag

SEQ ID NO: 141226 - DNA, 3504 bp, Artificial Sequence
  Description of Artificial Sequence: Synthetic coding sequence
atgggcagcctgacttttcgcgacgttgccattgagtttagcttggaagaatggcagtgcctggatactgcacaacagaatctgtacagaaatgtcatgctcgagaattaccgcaatttggtgtttctgggaatcgctgcgtttaaacctgacttgatcatttttctcgaagaagggaaggaatcatggaatatgaagcgccacgaaatggttgaggagagtccagtcatctgcagtcactttgcacaggatctgtggccagaacaggggatcgaagattcctttcagaaagtcattctgagacgctacgaaaaatgtggccatgagaatttgcatttgaaaatcggctatactaatgttgatgaatgcaaggtccataaagagggctacaataagctcaaccagtcattgaccacgactcagagcaaagtcttccaacgtggaaagtatgccaacgtgttccacaagtgctcaaattcaaacaggcacaaaatacgccacactggcaagaaacacctgcagtgtaaagagtacgttcgctcgttttgtatgctttcgcatctgtcccagcacaaacgcatctacacgagggagaactcatacaagtgcgaggagggagggaaagcttttaattggtctagcacacttacttactacaaatctgctcatacaggcgagaagccctaccgctgcaaggagtgcggaaaggccttctccaagttttcaatactgactaaacataaggtcatccatacaggggaaaaaagctataagtgtgaagaatgcggcaaggcatttaaccaaagcgctattcttacaaagcataaaattattcacactggcgaaaagcctaataagtgcgaggagtgtgggaaggcattcagcaaagtgagcaccctcacaacgcataaagctattcatgctggcgagaaaccttataagtgtaaagaatgcggcaaagcctttagtaaggtgtccactcttatcacccataaggccatacatgccggggaaaagccttacaaatgtaaggagtgtggcaaggctttctcaaagttttcgattctcaccaagcataaggtcatccacaccggcgaaaaaccttacaaatgcgaagaatgcggtaaagcgtataaatggccttcgactttaagttatcacaagaaaatccataccggtgaaaagccttataagtgcgaagagtgcgggaagggattctcaatgtttagtatcctgactaagcatgaggtgatccacaccggtgaaaagccctacaaatgcgaagaatgcggtaaggccttcaattggtcctccaatttgatggagcataagaaaatccatacgggtgaaaccccctataagtgtgaggagtgcggcaagggatttaaatggtcctctacactgagctatcataagaaaattcacaccgtagagaagccctacaagtgcgaagaatgcgggaaggcctttaaccaaagcgcgattctcatcaaacataagcggattcatactggtgagaaaccctataagtgtgaggagtgtggaaagaccttctcaaaggtcagcacattgaccacacataaagctatacatgccggagaaaagccgtacaagtgtaaagagtgtgggaaaacgttcataaaggtttccaccctaacaactcacaaagccattcatgccggagagaaaccctacaagtgtaaggaatgcggaaaggccttttccaagttcagtatacttactaaacacaaggttattcacacaggggagaaaccatataagtgtgaggaatgtggaaaagcctttaattggtcatccaaccttatggaacataagaggatacacactggagagaagccttacaagtgtgaagagtgtgggaagtccttctcaacattttcggtcttgaccaagcacaaggtcatccataccggggagaagccttataagtgcgaggagtgcggtaaggcgtataagtggtcttccactctgtcttaccataagaagattcacacagtcgagaaaccttacaagtgcgaggaatgcggtaaggcctttaatcggagcgcaattctcattaaacataagcgcatccataccgacgagaaaccctacaagtgcgaggaatgtggcaagacattctcaaaagttagcactctgactacgcacaaagctatccacgcgggagagaagccatacaaatgcaaggagtgtggtaaggctttctctaagttcagcatactgaccaaacataaggttattcacactggagagaagccatataagtgtgaagagtgcgggaaggcgtacaagtggccgtccactctgagttaccataagaagatccatactggcgagaagccatataagtgcgaagagtgtggtaagggcttcagtatgttctccattcttacgaagcatgaggtgatccacaccggcgagaagccttacaagtgcgaggagtgcggcaaggctttcagttggctctccgtcttttcaaagcacaaaaaaactcacgctggggagaaattctacaagtgtgaggcctgtggaaaagcctataatacattttcaattctaaccaaacacaaggttatacacaccggcgagaaaccctacaagtgcgaggaatgtggtaaggctttcaactggtcatctaacctcatggagcacaaaaagatacatactggcgaaacaccatataaatgtgaagagtgtgataaagccttcagctggccatcaagtctaactgagcataaggccacccacgctggggaaaagccttacaaatgcgaggagtgcggaaaagcgttttcatggccttcccggctgactgagcataaggcgacccatgcaggcgaagagccctataaatgcgaggagtgtggcaaggccttcaactggagttccaatctgatggaacataaaaggatacataccggtgaaaaaccttataaatgtgaggagtgtggaaaaagcttcagcacatttagcatcctcactaagcacaaagtgatccatacaggagagaagccatacaaatgcgaagagtgtggcaaagcctacaagtggtcctccaccctctcctaccataaaaagatacacactgtcgagaagccatacaagtgtgaagagtgtggaaagggattcgtcatgttctcgatccttgccaaacacaaggttatccacaccggcgaaaagctgtacaaatgtgaagagtgcggaaaggcctataagtggccctctaccctcaggtatcataagaagatacataccggtgaaaagccctacaagtgcgaagaatgcggaaaggccttttccacctttagcatcctgactaagcacaaggtgatacatacaggagagaaaccatacaagtgcgaagaatgtggaaaggccttttcctggctgtctgtgttttcaaagcacaaaaaaatccatacaggcgtcccaaaccctcccactcataagaagattcacgccggggaaaagttgtataagtag

SEQ ID NO: 141227 - DNA, 1488 bp, Artificial Sequence
  Description of Artificial Sequence: Synthetic coding sequence
atggctgaatcggcacccgcacggcatcggagaaaaagaaggtccacacccttaactagttccaccctcccctcccaggccactgagaaatcttcatatttccagactacagagatctcactctggactgttgtggcagctatccaggcagtcgagaaaaagatggagtcacaggccgcccggctccagtctctcgaggggagaacagggaccgcagagaagaaactcgccgactgtgagaaaatggcagttgagttcggaaaccaactcgagggtaaatgggcggttctggggaccttattgcaggaatatggtctgctacagagaagactcgagaacgtcgagaacctgcttcggaacaggaatttctggatattacggctaccccctgggtccaaaggagaggcaccaaaagtttctcggtccctggagaatgacggcgtgtgcttcactgagcaggagtgggagaacttagaggactggcagaaagagctctataggaacgtaatggaaagcaattatgagaccctggtctcactgaaggtgttgggtcagactgagggcgaagctgagctggggacagagatgctgggtgatttagaggaagaaggacctgggggcgcacatcccgccggcggcgtgatgataaaacaagaactgcagtacacccaggaagggcctgctgatctgcctggcgaattcagctgcatcgccgaggagcaggcctttctatcaccagaacagactgaactttggggcggtcaagggtcatctgtgctccttgagacaggacccggtgattccacgctggaagagccagttgggtcacgtgtccccagttccagcagaaccgtggggtgccctaagcaaaaatcacacagacaggtgcaactggaccaggagtgcggacagggcctgaaactgaagaaagatacttctcgcccctacgagtgctccgagtgcgaaattactttccggtacaagcagcagctcgccactcatctgagaagccactctggatgggggtcgtgtactcctgaagagcctgaagagtctttgcgtcctagacccagactgaaacctcagactaaaaaggcaaagctccaccaatgtgatgtctgcctgaggtcctttagttgcaaggttagcctcgtgacccaccagcggtgccacctgcaggagggtccttctgcgggtcagcacgtgcaggaaaggtttagccccaattccctcgtggcactgccaggccatatcccttggagaaagtctcgcagctccctcatttgcgggtattgcggcaaatccttctcgcacccatctgatctcgttcgtcaccagcggattcacactggtgaacggccatacagctgcaccgagtgtgaaaagtctttcgtgcaaaaacaacatcttcttcagcatcagaagatccatcagagggaaaggggcggcttggccctcgagccagggcggccaaacggtttgttgtag

SEQ ID NO: 141228 - DNA, 1380 bp, Artificial Sequence
  Description of Artificial Sequence: Synthetic coding sequence
atggctgcacctctcgaagcccaggaccaagctcctggtgaaggcgagggcttactgatcgtgaaggtggaggatagttcctgggagcaggagtccgcacagcacgaggatggtcgggactcagaagcctgtcgacagagatttcggcagttctgttatggagacgtgcatggccctcatgaagcgttttcacagctgtgggagctttgttgtcggtggttgcgccccgagcttagaactaaagagcagatcctggaactgctggttcttgaacaatttctcactgttcttccaggagagatccagggctgggtccgcgagcaacacccaggatcaggggaggaggctgttgccctggtggaggatctgcagaaacagcctgtgaaggcttggcgccaggacgtcccctcagaagaggcagagcctgaggccgccggacgtggctcccaagctactggccccccccctaccgttggagcacgccggcggccctcggtgcctcaggagcagcattcccatagcgcgcagccaccggccctcctaaaagaaggtaggccaggagagacgactgatacatgttttgtgtccggggtccacggacccgtggcccttggtgacattccattctatttctctagagaagagtggggcactttggacccggcccagagggatctcttttgggacataaagagagaaaattccagaaatacgactttggggttcggtctgaagggacagagcgaaaagtcactgttacaggaaatggtgccagtcgttccaggtcagactggtagcgacgtaacagtctcttggtcaccagaagaagccgaggcttgggaatctgagaataggccacgtgccgccctcggccctgtcgtgggagctagaaggggccggccaccgacccggcgaagacagttcagagatctggctgcagagaagccacactcttgcggccaatgcgggaaacgctttaggtggggtagcgatctggctagacatcagcgaacccatacaggcgagaagccgcataaatgtccggaatgtgataaatctttccgaagctcctcggacctggtcagacatcagggtgtacacacaggcgagaagcccttcagctgcagcgagtgcgggaagagtttctccaggtcggcctaccttgctgatcatcagagaatccacacaggggaaaagccttttggttgctctgactgcggaaaatccttctctcttagatcgtatcttcttgaccaccggcgggttcacaccggagaaaggccattcggctgcggcgaatgcgataagtcctttaagcaaagagcccacctgatcgctcatcagtctttacacgccaagatggcccagccagtcggctag

SEQ ID NO: 141229 - DNA, 906 bp, Artificial Sequence
  Description of Artificial Sequence: Synthetic coding sequence
atgtgccctcgtcggcgcaggaacccaagactccaagcaggggaccctagaccacgcgggctcccaaggcggtggggccacggtggtgggcgactgttccccagatcaagcacagcaatcgcaggccctgttgccctgggtgacatcccattttacttttccagggaagaatggggtactctcgacccagctcagcgggaccttttttgggacatcaagagggaaaatagccgcaacaccacattaggatttggacttaaaggccaaagcgagaagtctctactgcaggaaatggttcccgtggtaccgggacaaaccggcagtgacgtgacagtgtcttggtcccctgaagaggctgaggcatgggagtccgaaaatcggccaagagccgcgcttggtcccgtagtcggggcaagacggggtaggccgcccactcgcaggagacagtttcgagatctagctgccgaaaaaccccattcttgtgggcaatgtgggaaacggtttcgctggggatccgaccttgcccgccaccagcggacacacacaggggagaaacctcacaaatgtcccgaatgtgacaagagcttcaggtcaagctccgacctcgtcaggcaccagggcgtgcatacgggcgaaaagcctttttcatgtagcgagtgcggcaaatcatttagccggtccgcatatctagccgaccatcagcggatccacaccggggagaagcctttcggctgttccgactgcggtaaatctttctccttaagatcctacctgcttgatcatcgtcgcgttcataccggggaaagaccatttgggtgcggggaatgtgataagtcgtttaaacagagggcgcatctgattgctcatcagagcctccatgccaagatggcccagcctgtgggctag

SEQ ID NO: 141230 - DNA, 1821 bp, Artificial Sequence
  Description of Artificial Sequence: Synthetic coding sequence
atggcagtgacttttgaggacgtaacaatcatttttacgtgggaggaatggaaattcttggattcttcccagaaacggttgtaccgagaagtgatgtgggagaattacacaaacgtaatgtccgtcgaaaattggaacgagagctataaatcccaggaagagaagtttagatacttagaatacgaaaacttcagctattggcaggggtggtggaacgccggggctcagatgtatgagaaccaaaactacggggagaccgtgcaaggaacagatagcaaagaccttactcagcaagaccgatcacaatgccaggagtggctgatcctttctacacaggtgccaggatacggcaactacgagctgacgtttgagtctaaatcgctgcgcaacttgaagtataagaactttatgccttggcaatccctggaaaccaaaactacccaggattacggcagggagatctacatgtccggctctcacgggtttcagggcggacggtaccggttgggcatctccagaaagaatctctctatggaaaaggagcagaaactgatagtacaacactcctacataccagtggaagaggcccttccccaatatgtaggcgtgatctgtcaagaggatctattgagggacagcatggaggaaaagtactgcggatgtaataaatgtaaaggcatctattactggaatagtcgttgcgtattccataaacgcaatcagcctggtgagaacttgtgccagtgttccatctgcaaggcgtgtttttcacaacgctcggacctttataggcacccacggaaccacatcgggaaaaaactgtacggctgtgatgaagtggatggtaatttccaccagtcaagtggggttcacttccaccagcgtgttcacataggcgaagtgccctactcctgcaatgcatgcggcaaatcattttcacagatttcaagtctccataaccaccagagggtacacacagaagagaagttctataagattgaatgcgataaagatctctcacggaactcccttctccacattcatcagagactccacatcggcgaaaagccattcaagtgcaaccagtgtggcaaaagcttcaaccgtagctccgttctgcatgtccatcagagggtgcacactggagagaagccatataaatgtgatgaatgcggcaaaggcttctctcaatcatccaacttgagaatccatcaactggtacacacaggcgaaaaatcatataaatgtgaagactgtgggaagggcttcacgcagaggagcaatttacagatccaccagcgagtccataccggcgaaaaaccgtacaaatgtgacgattgcggcaaggacttcagccattcatctgacctgcgcatacaccagagagtgcacaccggagaaaagccttacacgtgtccggaatgtgggaagggattcagcaagtcaagcaaacttcatacccaccagcgggtccatacaggggagaagccttataagtgcgaagagtgcgggaaaggtttctcccagcgttcgcatctcctgatacaccagcgagtgcacacaggggaaaaaccctataaatgccatgactgcggtaagggcttctcgcactcctcaaacctgcacattcatcagagggtccacacgggcgagaaaccttatcagtgtgctaagtgcggcaagggattcagccacagcagtgctctgcgcattcaccaaagagtgcacgccggcgaaaagccttacaaatgccgagagtattataaggggttcgaccacaatagtcacctacataacaaccacaggcgcggcaatctttag

SEQ ID NO: 141231 - DNA, 1821 bp, Artificial Sequence
  Description of Artificial Sequence: Synthetic coding sequence
atggccgtgacttttgaggacgtaacaatcatattcacatgggaagaatggaaatttttggatagttcccagaaacggctgtatcgggaggttatgtgggagaactatactaacgttatgtcagtcgagaattggaacgagtcatacaagtcccaggaggaaaaattcaggtacctggagtacgaaaatttttcttactggcagggatggtggaacgccggagctcagatgtatgaaaaccaaaactacggagagacggtgcaaggcacagacagcaaagaccttactcagcaggacagatcccaatgccaggagtggctcatcctgagtacacaggtgcccgggtacggcaactacgaattgacctttgagtctaaatcgctgcggaacctcaaatacaagaacttcatgccttggcaaagcctggagaccaagactacgcaagattatggtcgtgagatctatatgtccggctcacatggctttcaaggtgggaggtacaggctgggaatttctagaaaaaacctgagcatggagaaagaacagaagctgattgtgcagcattcctacattccagtagaagaggccctgccacagtatgtgggagtgatctgtcaggaggaccttctgcgtgacagtatggaggaaaagtattgcggatgcaacaagtgcaaaggaatttactattggaattctagatgtgtgtttcacaagaggaaccagcccggcgagaacctctgtcagtgcagcatttgcaaggcatgtttcagtcaacggagcgacttgtacagacaccctcggaatcacataggcaaaaaattgtatggttgtgatgaagtggacggaaacttccatcagtcaagcggagtccacttccaccagagggtgcacatcggtgaggtgccgtacagctgcaacgcttgtggaaagtccttttctcagatctcatcccttcacaaccatcagcgagtccatactgaggaaaaattctacaaaatcgagtgcgacaaagatctaagccgcaattcacttctgcacattcaccagaggctacacatcggagagaaaccttttaaatgcaatcagtgcggcaagtcgttcaataggagctctgtgttgcacgtacatcagagggttcacacgggcgagaagccatacaaatgcgatgagtgtggtaaaggattctcccaaagctcaaacctgaggatccatcaactggtccacacaggtgaaaagtcatacaagtgcgaagactgcggcaagggcttcacccagcgatctaacctgcaaatccaccagagggtgcacacaggcgaaaaaccgtataagtgtgacgactgcgggaaagacttctctcactcctcagacctgcggatccaccagcgcgtccacaccggggagaagccgtatacctgtcccgagtgtgggaagggatttagcaagtcaagtaaacttcatacacaccagcgcgtgcataccggcgagaagccctataagtgtgaggagtgtggaaagggattttcacagcgttcacacctgctgatccatcagcgagtccatacgggagagaaaccatacaagtgccatgactgcggcaaagggttctcacatagctcaaatttgcatattcaccagagagtgcacacaggtgaaaagccatatcagtgcgctaaatgtggcaagggcttctctcactctagcgccctgagaatccaccaaagggtgcacgctggagagaaaccatacaaatgccgcgagtattacaagggcttcgaccacaactctcacctccataacaaccaccgccgcggcaatttgtag

SEQ ID NO: 141232 - DNA, 1554 bp, Artificial Sequence
  Description of Artificial Sequence: Synthetic coding sequence
atgcagccactaagtaagcttatggccatttcaaagcccaggaacctcagtttgagagagcagcgcgaagtgctgcgcgcagatatgtcctggcagcaggaaacaaacccagttgttgaaacgcacgacagtgaggcctcacgacaaaagttcagacacttccagtatctgaaggtttccggacctcacgaggcgttatcccaactgtgggaactctgcctgcagtggcttcgtccagagatccacaccaagaaacagataatcgagctcctagtgctagaacagtttctggctatccttcccgaagaggtcaggacgtgggtaaatctccagcatcctaacaactctaaggacatggtgaccttgattgaagacgtcatagaaatgctggaggacgaggacatgccctgcaaggatagtgccctccaaatgggcagcataaaagagaaaatgaaagcaggatctagaaccggtaagccccaggagccagtgaccttcaaggacgttgtggtcgagttttctaaggaggagtggggccagttggattctgccgtgaagaacctgtaccggaacgtgatgctggaaaacttccgaaatctgaactcgctgagaaaggcacatttactctccaagcctttcgagagcttgaagctcgagtctaaaaaaaaacgatggattatggaaaaagaaatcccacgaaagactatattcgatatgaaatccatttctggcgaggagtctagtcatggcgtcattatgaccaggctaaccgagtctggccaccctagcagtgatgcttggaaaggcgaaaactggctatatcggaatcagaaaaaatgggacatcaatctacctcaagaagcgtttatacccgagaccatatacacggaggaggaagattttgagtgtagcgaaaacaagaaatcattcgacatcaacagtgtctccagtatatgtgcgatccaagtgggaatccctagccggaaagggtctcccaagtgtgacaaatttaaaacctatttcaagtttaacctggactcggttggtaaacaacactccgaatacgaatatggcaacgacctgtccctatctactgacatcaggcaccagaaaagccatactaccatgaactcctatgagtgttatcaatgcggcaaagcattttgcagatcatcctcactcatccgacaccagataattcacaccggagagaagccatataaatgtagcgagtgcggaagattctttaatcgtagaactaacttaaccaaacaccaaaagctgcacgcagaagctaaagcttgtacctcgaacaaatgcggaaaagcgttctctaaaagcgaggactctaacaaccccacattacacttcggaaataatttttaccagtgtgttaactgcggcaagtcttttaaccggagctccagcctgatccggcatcagatgatccataccggagagaagcccttcaaatgcaaagagtgcagcaaggcctttaaccgcagttcgaatctggttaaacaccagaaattgcacaccagggacaaatcatag

SEQ ID NO: 141233 - DNA, 1554 bp, Artificial Sequence
  Description of Artificial Sequence: Synthetic coding sequence
atgcagcctctgagtaagctgatggcgatcagcaaaccacgaaatttgagtctgagagaacaacgtgaggtgctccgggccgacatgtcatggcagcaggagacaaaccccgtggtggagacccacgatagtgaggcctctcgccagaaatttcggcacttccagtacctaaaagtcagcgggccgcacgaggccctgtcacaactgtgggagctgtgtttgcagtggctaaggccggaaatacacacgaaaaagcagataatcgagctgcttgtgctggagcaattcctggccatcctgcctgaagaggtgcgtacatgggtaaacttacaacatccaaacaatagtaaggacatggtcacattaatagaggacgtcatcgaaatgctggaagatgaggatatgccgtgcaaagatagtgccctgcagatgggcagcattaaggagaaaatgaaggccgggagcagaacggggaaacctcaggagcccgtgacttttaaagatgtggtggtcgagttttcaaaggaggagtgggggcagctggacagcgccgtaaaaaacctgtatcgcaacgtgatgcttgagaacttccgtaacctcaactccctgagaaaagcccatctgctgtcgaagccattcgaatctttgaagctcgaaagtaagaaaaagcgctggataatggagaaagaaatccctaggaagaccatatttgacatgaagtctatctctggcgaagaatccagccacggggtgattatgaccagactcacagaatctgggcatcctagctcagacgcatggaaaggggagaattggttatacagaaatcagaaaaagtgggatattaatttgccccaggaggccttcatccccgagacgatttacaccgaagaagaggatttcgagtgctcagaaaataaaaagagctttgacatcaactcggttagcagcatctgtgccatccaggtgggcatccccagccggaagggatcccccaaatgtgacaagttcaagacgtactttaaatttaacctcgattccgtgggaaagcagcactccgaatatgaatacgggaatgatctatctctttccactgacattagacaccagaagagtcacaccacgatgaattcttacgagtgttatcagtgtggcaaggctttctgccgctcttcgagcctgatacggcaccagatcattcacacaggcgagaagccttacaagtgctccgagtgcgggaggttcttcaataggagaacaaacctgaccaaacaccagaaactgcatgcagaagccaaagcatgtacgagtaataaatgcggtaaagcatttagtaagagcgaagatagtaataatcctaccctgcatttcggaaataacttttatcagtgtgtgaactgtggaaagagcttcaaccggagtagcagtctgatacgccaccaaatgattcatacaggggaaaagcccttcaagtgcaaagagtgtagtaaagccttcaacagatccagcaacctggtcaagcaccagaagctccacactagagacaagagttag

SEQ ID NO: 141234 - DNA, 915 bp, Artificial Sequence
  Description of Artificial Sequence: Synthetic coding sequence
atgcagccactctcgaaactcatggccatttctaaacccaggaatctcagtctccgggagcagcgagaggtgctgcgggccgatatgtcatggcagcaggaaactaatccagtggtggaaacacatgactccgaggcctcccggcagaaatttcgccacttccagtacctcaaggtctctggtcctcatgaggccctctctcagctctgggagttatgtttgcagtggctacgtcctgaaattcataccaaaaaacaaattatagaactgctggtgctcgagcagtttctggcaattcttcctgaagaagtacggacctgggtcaatcttcaacatcctaacaattctaaagatatggtgacgctcatagaagatgtcattgagatgctggaggatgaggacatgccttgtaaggactcagcgctgcaaatggggtcaatcaaggagaagatgaaggctggcagtcggaccggtaaacctcaagagcccgtgacctttaaggacgtcgtagtcgagttcagcaaagaagaatgggggcaactggactcagcagttaaaaacctgtatcgaaatgttatgttagaaaatttccggaatcttaacagcctgaggaaagcccacttattaagcaagcccttcgagagcctcaaactggaaagcaaaaaaaaacgctggatcatggagaaggagattccaaggaagacaattttcgacatgaagtccatctccggggaggaaagtagccacggggtgattatgaccagactcactgaatctgggcatccaagttccgacgcctggaaagacggggtttctctcctgctgcctcgcctggagtataacgatgctgtctccgcacattgcaatctgcatctgtgggtgcaggtcattctactgccgcaaccaccggaatag

SEQ ID NO: 141235 - DNA, 3147 bp, Artificial Sequence
  Description of Artificial Sequence: Synthetic coding sequence
atgcagtctaaggttacaggcaacatgcccacccagtccctccttatgtatatggacggcccagaagtgattggctcctccctggggtcgcctatggagatggaggacgccctgtccatgaagggtactgcagttgtgccatttagagctacccaggagaaaaacgtgatccaaatcgaggggtatatgcctctagattgcatgttctgttctcaaacattcacacactcagaggatctgaacaagcacgtgctaatgcagcaccggcccactctttgcgaaccagcagttctgagggtggaagcggaatatttatctccgctggataaatcccaggttcggacagaacctcctaaggaaaagaattgtaaggagaacgagttcagttgcgaggtatgcggacagacatttcgggtcgcctttgacgtggagatccacatgagaacccataaagactcctttacatacggctgcaacatgtgcggccgtaggtttaaagagccctggttcctgaaaaatcacatgcgtactcataacggtaagtcaggcgcacggtctaagctgcagcaaggcctcgaatctagccccgccaccattaacgaggtggtgcaggttcacgcggcagagagcatcagcagtccttataaaatatgcatggtgtgcggctttctgttcccaaacaaagaaagtttaatcgaacaccgaaaggtgcacaccaagaaaacagcctttggaacaagtagtgcacagactgactccccgcagggaggaatgccaagcagcagagaggatttcctgcagttatttaacttgcggccgaaatcacaccccgaaaccggcaagaagcccgttagatgcatcccccagctggaccccttcaccacattccaggcctggcagctcgccactaagggcaaagtggccatatgccaggaagtgaaagagtcaggccaggaagggtctaccgataacgacgactcctccagcgagaaggaacttggagaaaccaataaggggagctgcgcggggcttagccaagagaaagaaaaatgtaaacactctcatggggaagctccttccgtagacgcagacccaaaactgccatcgtctaaagaaaaaccaacacattgcagcgagtgtggaaaggcattcaggacttaccaccaactggtcctgcatagccgcgtccacaaaaaagaccgtcgggcaggtgctgagtcgcctactatgtcagtggacggaaggcagcccgggacatgttcacctgaccttgctgcgccacttgacgagaatggcgccgtggaccgaggcgagggcggctcagaggatgggagtgaagacggccttcctgagggcatccatttagataagaacgacgacgggggcaaaatcaaacacctcacctcttcccgcgaatgtagctactgcggcaaattcttcagatccaactactatcttaatatccatctgcgtacacacactggagaaaagccctataaatgcgagttttgcgagtatgcagctgcccaaaagacctctttgcgctaccacttggagcggcaccataaggagaaacagaccgacgtcgccgcagaagtaaagaacgatggaaagaatcaggacacggaagacgccctcttaacagcagactcagcgcagaccaaaaacctgaagaggtttttcgatggggccaaggatgtgactggctctccccctgcaaaacaactaaaggagatgccatctgtgtttcagaacgtactggggtcagcagtgctgtcccccgcccacaaggatacccaggactttcataaaaatgctgcagacgactctgcggataaggtaaataaaaacccaacacccgcctatctcgacctacttaaaaaaagaagcgctgtagaaactcaagcaaacaacctcatatgtcggacaaaagccgacgtgacgcctccccctgatggatcaaccactcacaatttggaggtgagcccaaaggaaaagcaaactgaaactgccgcagactgcaggtaccggccatccgtggactgccatgaaaagcctctgaacctttctgtgggcgctctacacaattgtcctgccatatccctttccaaatccctgattccaagcataacctgtccattttgcactttcaagactttctatccggaagtgctcatgatgcatcagcggcttgaacacaaatataacccggatgtccataagaactgccggaacaagagtctcctccggtctcgtcgcacaggttgcccacctgccttgctgggaaaagacgttccgccactttcaagcttctgcaaacctaaacccaaaagcgctttcccagcacaatcaaaatctctgccatcggccaagggcaagcaatcacctccaggcccaggtaaggcacccctgaccagcgggattgattcctccactcttgcaccctccaatcttaagagtcacagacctcagcagaatgttggtgttcagggcgccgcaaccaggcaacagcaaagtgagatgttccctaaaacctccgtttccccggcacccgacaaaaccaagcgccccgagacaaaactgaagcctttgcccgtcgccccctctcaacctaccctaggaagttcgaatattaacggctcgatagattaccctgctaagaatgacagcccatgggcccctccagggcgcgactacttctgtaacaggtccgccagtaatactgccgctgagttcggggagcccctcccaaaaagactaaagagttcagtcgtcgcactggatgtagaccaaccaggcgcaaactacaggagagggtacgatctcccgaagtaccatatggtgcgcggcattacctctcttctgccccaggattgcgtgtacccttcccaggccctgccccccaaacctcgcttcctatcctctagcgaagtggacagcccaaacgtcctcacagtgcagaaaccatacggcggaagtggcccattgtacacttgcgtgcctgccggctcgcccgccagctcgtcaacattagaaggaaagcgtccagtttcctatcagcacctctctaatagcatggcccaaaaaaggaactatgaaaattttatcggcaacgctcactaccgacccaacgacaaaaagacttag

SEQ ID NO: 141236 - DNA, 3147 bp, Artificial Sequence
  Description of Artificial Sequence: Synthetic coding sequence
atgcagagcaaagtgaccggcaacatgccaacacagtctttactcatgtatatggatgggcccgaagtaatcggatccagcctcggttcaccaatggagatggaggacgctctgagtatgaagggcactgccgttgtgcctttcagagccacgcaagaaaagaacgtgattcagatagaaggctatatgcctctggattgtatgttctgctcacaaacttttacccattcggaggatctgaataagcatgtgttgatgcaacacaggcccaccttgtgtgaacctgccgttcttagagtggaagctgaatatctctcccccctagacaaaagccaggttaggactgaacctccaaaggagaaaaactgtaaagagaatgagttttcttgcgaggtgtgtggacagacgttccgcgtcgcttttgatgtggagatccacatgcgaacccataaggacagtttcacttatggttgcaacatgtgcggtagacggtttaaagaaccctggtttctcaaaaatcatatgaggacacacaacggaaaatccggcgctaggtccaaacttcaacaggggctggaaagttctccggccaccatcaacgaagtagtgcaggtgcacgcagccgagtcaatcagcagcccatacaagatctgtatggtatgtggatttctgttcccaaataaggagtcacttattgaacaccgcaaagttcacactaaaaagaccgctttcggcacttccagtgctcagactgactcacctcagggaggaatgccctcttcaagagaggatttcctgcagttgttcaatttgaggcctaagtcccacccggagacgggaaagaaacccgtccgctgcatccctcagttagatcctttcactacattccaagcttggcagctggcaaccaaaggaaaagtggccatatgccaagaggtgaaagaatctggacaagaaggctcaacagataacgacgacagcagtagcgagaaggagctgggagagaccaacaaaggaagctgtgctgggctcagccaggagaaggaaaagtgtaaacactcccacggcgaggccccatcagtagatgctgacccaaaactgcccagctcgaaagagaagcccactcactgtagcgaatgcgggaaagctttcagaacatatcatcagcttgtgctgcattcacgagtacataagaaagatagacgggccggcgctgagagccccacgatgtccgttgacggtagacagcccggcacctgttctcctgatctggcggccccgctggatgaaaatggtgctgttgaccggggtgaagggggcagcgaggatggctcggaggatggcctgccagaggggatacaccttgataaaaacgacgatggcgggaagatcaaacatctcacttctagccgtgaatgctcatattgcggaaaattcttcagatctaattattatctcaacattcaccttaggacccatactggcgaaaaaccctataaatgtgagttttgtgaatatgcagccgctcagaagacatcgctgcgataccatttggagcgccatcataaagaaaaacagactgacgtggccgcagaggtcaaaaacgatggtaaaaaccaagataccgaggacgccctgctcactgctgactcagcgcaaaccaagaaccttaaacggttcttcgatggcgccaaggacgtgactggaagcccacccgcgaagcaacttaaagagatgccatccgtctttcagaatgttctcgggagcgctgttctttccccagcccacaaagatactcaagacttccacaaaaacgctgctgacgactctgctgacaaggttaacaaaaatcccacaccagcctacctggacctgctgaagaagaggagcgcagtggagacccaggcgaacaatctgatctgccgcactaaagctgatgtcacccctcccccagatgggtccacaacacataatctagaagtgagccctaaggaaaaacagaccgaaaccgctgctgattgtagatatagaccttctgtggattgccacgagaagcccctgaacctgtccgtaggagctctgcacaattgcccagctataagcttgtcaaagtccctgattcctagcattacctgtcctttctgtacattcaagaccttctatcccgaggtgctgatgatgcatcagaggctcgaacataaatataatcccgacgtgcataaaaattgcagaaataagtctctactgaggtcccgccggaccggatgcccccctgcgctcctgggtaaggacgtgccccccctgtctagcttttgcaagcctaaaccgaagagcgcttttccagctcagagtaagagcttaccttccgccaagggaaaacagagtcctcctggaccaggcaaagcaccactcacgtcaggtattgattcttcaaccctcgcgcccagcaacttaaaatctcacaggcctcagcagaacgtgggtgtgcagggtgcagccacacgtcagcagcagagcgagatgtttcccaagacttccgtgtcacctgcgcccgacaagacaaagcggcccgagacaaagctgaagcccctgccggtcgccccgagccagcctacccttgggtctagtaatataaacggaagcattgattatcctgcaaaaaatgattcgccatgggctcctcctgggcgcgattacttctgtaaccgttccgctagtaacaccgctgcagaattcggtgagcctctgccaaaacgcctgaagagcagcgtggttgcccttgacgttgaccagccaggggccaactacaggcgcggatacgatctgccgaaatatcatatggtaagagggatcacaagtctcctgccccaggattgcgtgtatccttcccaggcccttccacccaagcctcgctttctttcatcaagcgaggtggatagtcctaatgtgctcacagtccagaaaccatacggtggtagtgggccgctctatacttgtgtaccagcaggttcccctgccagcagctctaccctggaagggaaaagaccagtgtcgtaccagcatctttctaattccatggcccagaagcggaactacgaaaatttcatcggtaacgctcactacaggccaaatgacaaaaagacctag

SEQ ID NO: 141237 - DNA, 666 bp, Artificial Sequence
  Description of Artificial Sequence: Synthetic coding sequence
atgttcccaaagaccagtgtgtcgccagccccagacaagacgaagcggcctgagaccaaacttaagcctctgcctgtcgctccgagccagccgacgctaggatcttccaacataaacgggagcattgattaccctgctaaaaacgatagcccatgggcgccgcccgggagggactatttctgtaatcggtccgcatcgaacaccgccgccgagttcggtgagcctctgccaaagaggctaaaaagctccgtagtcgctctggacgtggatcagcccggcgctaattaccgacgcggctatgatctgccgaagtaccacatggtccgaggaataaccagtctgctccctcaggactgtgtgtatccgagccaggctctcccacccaagccaaggtttctctctagttccgaggttgacagccctaatgtcctgaccgttcaaaaaccctacggtggctctgggccattgtacacctgcgtgcctgccgggtcaccagcatctagtagcacactcgagggcctaggaggatgccagtgtttactgcccatgaaacttaactttaccagctcctttgaaaagaggatggtaaaagccactgagatttcatgcgactgtacagtgcacaagacgtatgaggagtcggctcgcaataccaccgtggtttag

SEQ ID NO: 141238 - DNA, 288 bp, Artificial Sequence
  Description of Artificial Sequence: Synthetic coding sequence
atgcaaagtaaggtgactgggaacatgccaacccagtccttgttgatgtacatggacggacccgaggtgattggcagctcactgggaagtcctatggaaatggaggatgccctttcaatgaagggcaccgctgttgtcccattcagagcgactcaggaaaaaaacgtcatacagattgaggggtatatgcctctggattgtatgttttgcagccagacctttactcacagtgaggacttaaacaaacatgtcctgatgcagcatagacctaccctgtgtgaaccttag

SEQ ID NO: 141239 - DNA, 2169 bp, Artificial Sequence
  Description of Artificial Sequence: Synthetic coding sequence
atggagggcagcaggccacgagcaccatctggccacttggcaccttcacctcctgctttcgacggagagctcgatctgcagagatacagtaacggacccgctgtgagcgccggcagccttggcatgggggctgtgtcctggagcgagagtcgggctggagagaggcgcttcccttgccctgtatgtggaaagcgcttccggtttaacagcatcctcgcgctgcacctccgagctcatccgggagcgcaggcctttcaatgcccacactgtgggcaccgcgccgcccagagagcactgctcagatctcacttgcggactcaccaacccgaacgacctagatccccggcggcccggctgctcttggaattggaagagcgagctctgctacgtgaagcgagattagggcgagcccgatcttctggtggcatgcaagctacccctgcaactgaagggctcgcaaggccacaggcaccatccagttctgctttccgctgtccatactgcaaggggaagtttcgaacttccgccgaacgggagcgacacctccatatccttcatcggccctggaagtgtgggttatgcagctttggcagttcccaggaggaagagcttctacatcatagtttgacagcccacggggctccggaacgaccattggctgcaaccagtgcggctccccctccacagccacagccccaacctccaccacaaccggagccccgctcggtcccacaacctgaaccagaacctgaacccgagcgagaagcgacccctaccccggctccagcggctccggaggagcctccagctccaccagagttccggtgtcaagtgtgcggccaatcttttacacagtcttggttcctgaaaggccacatgcgaaagcacaaagcatccttcgaccacgcctgtccagtatgtggccgatgctttaaagagccgtggttcctgaaaaatcacatgaaagtgcacgcctccaaattaggccccctcagggctccgggacccgccagtgggccagcccgcgcgccccagcccccagatctcgggcttctcgcctatgagcctctgggacctgcccttttgttggcgccggcccccactcccgcagaaagacgggagccccctagtctgttgggctacttgagccttcgtgctggcgaggggagacctaatggagaaggggctgaacccggtcctggaaggagctttggcggattcagacccctctccagtgcactgcccgcacgggcgcgtcgtcatagggctgaggagccagaggaagaggaagaagttgttgaagctgaggaagagacatgggccagaggacgtagcttggggagtctcgcaagtttacatcccagacctggcgaagggcccgggcactccgcatcggccgccggagcacaagccaggtcaaccgcaactcaggaggaaaacggcctgctggtcggaggaactaggccggagggcggtcgtggcgccaccggtaaagactgccccttttgcggaaagtccttccgcagcgcccaccatctcaaagtacacctgagagtccatacaggtgagaggccctacaaatgcccacattgcgactacgctgggactcagtcaggttccctgaagtaccatctccagcggcaccatcgtgagcaacgttccggcgcagggcccggaccccccccagagccaccccccccgtcccagcgcggtagtgcccctcaatctggagcaaagccttcaccccagcccgcaacctgggtggaaggggcatccagtccacggccccctagttccggtgcaggccccgggtcccgcaggaagcctgccagtcccggccgcaccctgaggaatggcagggggggcgaagctgagccactagacctgtcattacgggccggccccgggggagaggcagggccaggtggtgctcttcacagatgtctcttttgcccgttcgccaccggcgcgccagaactcatggctcttcacctccaggttcaccatagtcgtcgggctcgagggcggagaccaccgcaagcagatgctagcccaccgtacgccagagtgccatccggagagactccgccctctccctctcaggagggagaagaggggagcgggttgagccggcctggcgaggctgggctaggaggccaagagagatag

SEQ ID NO: 141240 - DNA, 2169 bp, Artificial Sequence
  Description of Artificial Sequence: Synthetic coding sequence
atggaaggctctaggccaagggccccctcaggccacttggctccaagccctcccgccttcgacggagaattagatttgcagcgctacagcaacggtcctgccgtgtcagctggttccctcggaatgggagcagtgagctggtccgaaagtcgggctggcgaacgcaggtttccatgtccagtgtgcgggaaaaggtttaggtttaattcgatacttgccctgcacctgagggcccatcctggggcccaagcattccaatgcccgcactgtggtcaccgggctgcccagcgagccctgttgagatcacacctgcgaacgcatcaacccgaacggccaaggagcccagcagcacggcttctactggaacttgaagagagggcactgttgagggaggcaagactaggccgggctcgatcttccggcgggatgcaggctacacccgcaacagaagggctggctcgcccacaggcaccaagcagtagcgcttttcgatgtccctattgcaaaggtaagtttcgcacctcggctgagagggagcgacacctgcatattctgcaccgaccatggaagtgcgggctatgcagctttggcagctctcaggaggaagaacttcttcaccacagtctgactgctcatggggctcccgaaagacccctggcggctacaagcgcagccccaccccctcaaccccaaccccagcctcctcctcagccagagcctcgtagcgtgccacagcccgagccagagccggaacccgaacgagaggcgactccaacacctgccccagcagccccagaggaacctcccgcaccaccagagtttcggtgccaagtctgcggccagtccttcacacagtcctggttcctgaagggtcacatgcgtaagcacaaggcgagcttcgatcatgcttgccccgtgtgcggaagatgctttaaggagccatggtttcttaagaaccatatgaaagtccatgcctcaaagttgggtccccttcgcgcccccggccccgctagtggccccgcgcgagccccgcaaccgccagacctggggttgcttgcctatgagccgcttgggccagcgctcctcctggcacccgcccctaccccagccgaaaggagggagcctccttccctgctagggtatttaagcctaagagctggagaagggcggccgaatggtgagggggccgagccgggtcctggcagatctttcggcggcttccggcctctctccagtgccctgcctgccagagctcggaggcatcgtgcagaggaaccggaggaggaggaggaggtcgtggaggctgaggaagagacatgggcccggggcagatctctagggtccctggcctccctccacccgcggcccggcgagggtcctggacattctgctagtgccgccggagcacaggctaggagtacggcgacacaggaagaaaatggtcttctggtgggtggtaccagacccgaggggggtcgcggcgcaacagggaaggactgtcccttctgtggcaaatcctttcggagcgcccatcatctgaaagtgcatctgagagtgcacaccggggagcgtccctacaaatgcccacattgcgattacgccggaacccaatccggatcattgaagtaccacctccaacgtcaccatcgcgagcaaaggtccggcgctggccccggccccccacctgagccacccccgccttcacagaggggttcagccccccagagtggtgcaaagccctcccctcagcccgcgacatgggttgagggtgccagttcgccccgccctccaagctcaggggctggcccagggtcgagacgaaagcctgcatcccccgggagaactctgcgcaatggtcgggggggggaagccgaacctttggatctgtccttacgagcggggcccggtggggaggcgggaccagggggggccctgcaccgctgcctcttctgtcccttcgctactggggcccctgaactgatggcgctacatttgcaagtacatcattcccggagggcccgggggcgacggcccccacaggcagacgctagccctccatatgcccgcgtgcctagcggcgagacccctcctagcccatctcaggaaggagaggagggcagtggcctgtcgaggccaggggaggctggcctgggggggcaggaacgctag

SEQ ID NO: 141241 - DNA, 2169 bp, Artificial Sequence
  Description of Artificial Sequence: Synthetic coding sequence
atggagggctcacggcccagagctccctccggacaccttgcgccgtccccccccgccttcgatggcgaattggacttgcagcgatattctaatgggcccgccgtgtctgctgggagtttgggaatgggagcagtgtcctggagcgaaagccgcgcaggcgagagaaggttcccttgcccagtgtgcggcaagcgattccggtttaattcaattctggccctccatctccgcgcccatcccggcgcccaggcattccaatgtccacactgcggtcacagggcagcacagagggccttgcttcgctctcatctgaggacacatcaaccagaaaggcccagatcaccagcagcgagactgttgctggagcttgaggaacgcgccttactgcgggaggcacgcttaggacgggcacggagtagcggcgggatgcaggcgactccggcgactgaagggttggccaggccacaggccccgtcaagcagtgcttttcgctgcccctattgcaaggggaagttccgcacctctgctgagcgggagaggcacctgcatattctgcatcggccctggaaatgtggcctgtgttcgttcggttcctcgcaggaagaggagctcctgcaccactctttgacagcacatggggctccagaacgtcctctggccgccacaagcgccgctcccccaccccaaccacaaccccagccgcctcctcagcctgagccgcgatccgtaccgcaacccgaacccgagcccgagccagagcgcgaagcgactccaaccccggcgcctgccgctccggaggagccaccggcacctcccgagtttcgctgccaggtgtgcgggcagagtttcacccaatcatggtttctaaaaggccatatgcggaagcacaaggcttcatttgaccatgcttgtccagtctgtggacggtgctttaaagagccttggttcctgaagaatcacatgaaggtgcacgccagtaaactgggaccccttcgcgctcctggtccagccagtggacccgcgcgtgccccccagccaccagacttgggactcctggcctatgagcctctgggtcctgcccttctcctggccccagcacccaccccagcagaacgccgagagccacccagcctgctcggctatctgagtttgagagccggtgaagggagacccaacggggagggggcggagccaggtccaggtaggagcttcggaggcttcagaccactgtcctccgcacttcctgccagagcgagacgtcaccgagccgaggagcccgaggaggaggaggaggtggtggaggctgaggaggagacttgggctagaggtcggtctttgggttctctagccagcctccatcctaggcctggcgagggccctggtcactctgcatcagcagctggggctcaggcgagaagcacagcgacccaggaagagaacgggctcctcgtcggtggcacccgccccgagggtgggcggggtgccacaggaaaagactgcccattctgtggcaaatccttcaggagtgcccaccatctcaaggtgcacctgcgcgtacacaccggcgaaaggccctataagtgtccgcactgcgattacgcaggaacacaaagcggctctctgaagtatcatctgcagaggcatcatcgcgagcagcgttccggcgcaggcccgggccctcctcctgaaccacctccgcctagccagaggggctccgcgccccagagtggggctaagcccagccctcaacccgctacatgggtcgagggggcttctagcccccgcccacccagctcaggagccggtcccggcagcagaagaaaacccgcatcccctggccgtaccttgcgcaatggaaggggcggggaagccgagcccctcgatctctccctcagagccgggccaggtggcgaagcaggacccggaggcgccctgcatcgatgcctgttctgtccctttgcgaccggggccccagagctgatggcgctgcatctgcaggtccatcattccagaagagctagggggagacgccccccacaggccgacgccagcccgccatatgccagggtgcctagcggcgagacccctcccagcccgtcccaggaaggtgaagaggggtcaggactgagtcgccctggagaagctggcctggggggccaggagcgctag

SEQ ID NO: 141242 - DNA, 324 bp, Artificial Sequence
  Description of Artificial Sequence: Synthetic coding sequence
atggagggcagcagaccacgggctcccagtggacatctggcacccagcccgccggccttcgacggagagttagacctgcagcggtattccaacggtcccgctgtgtctgccggcagcctcggaatgggagcggtttcctggtccgagtctcgagccggggaaagacgctttccatgtccagtatgcggtaaacggtttcgattcaactccatcctcgcactccacttgcgagcacatccaggggctcaagccttccagtgtccgcactgtggtcatcgggcagcccagcgtgccttgctgcgaagccacctgcggactcattag

SEQ ID NO: 141243 - DNA, 636 bp, Artificial Sequence
  Description of Artificial Sequence: Synthetic coding sequence
atggagggctctaggcctcgcgcccccagtggtcacttggctcccagtcctcctgcctttgacggggagttggatctgcagaggtattcaaacgggcccgctgtgtccgcaggctcgctcggcatgggagctgtttcttggagcgagtcccgggcaggagaacgaagatttccttgtcccgtgtgcgggaagcgatttcgattcaattcaatcttagccttgcacctgcgcgcccaccccggagctcaggccttccaatgcccacattgcgggcaccgcgccgcccagagggcgctgctccggtcccaccttcgaacacaccagcccgaaagaccccggagccccgccgctaggctgctgctggaactagaagaacgggccctactgcgcgaggctcgcctgggccgagcaagatcctccggcgggatgcaagctacccccgccacagaggggttagctagaccacaggccccatcctctagcgctttcagatgtccatactgcaaaggcaagttccgaaccagtgccgaaagggagcgccatctgcatatcctgcacaggccttggaaatgtggtttgtgtagctttgggtccagccaagaggaagagctgctgcatcactcccttaccgcctag

SEQ ID NO: 141244 - DNA, 96 bp, Artificial Sequence
  Description of Artificial Sequence: Synthetic coding sequence
atggagggaagccgcccgcgggctccttctgggcaccttgcaccatctccacccgcctttgatggcgagctggatctgcagcggtactcaaactag

SEQ ID NO: 141245 - DNA, 336 bp, Artificial Sequence
  Description of Artificial Sequence: Synthetic coding sequence
atggagggctcgaggcccagggctccatccggacatctggctccgtcccctccagcatttgacggggagctcgatctccagcgttacagtaatggtccagctgtgagcgccggatctctgggcatgggtgccgtgagttggtctgagtcacgcgcgggcgagagacggttcccgtgtcccgtttgtggcaagcgcttccggtttaattcaatcctggccctccatctgcgagcacaccctggagcacaggccttccagtgtccccactgtgggcaccgagccgcacagcgtgctttactgcggtctcatctacgaacacaccagccagagaggtag

SEQ ID NO: 141246 - DNA, 675 bp, Artificial Sequence
  Description of Artificial Sequence: Synthetic coding sequence
atgcgcctggccaaacctaaggcaggcatctcgcggagcagctcacaggggaaagcatatgaaaacaaaagaaagacagggcgccagagacagaagtggggcatgacaattaggttcgattcatctttctcaaggctgcgaaggagcttagacgacaagccctataagtgtaccgagtgcgagaagtccttctcacagagttctactctgtttcagcatcagaaaattcatacagggaagaaatctcacaagtgcgccgactgcggaaagtcttttttccagagctctaatctcatccagcatcgccgaatccataccggggagaagccctataaatgcgacgaatgtggggagagctttaagcaaagctccaatctcattcagcatcaacggatccacaccggggaaaagccttaccagtgtgacgagtgcggccgctgtttttcccagtcctcccacctcatacagcaccaaagaacacacacgggagaaaagccgtaccagtgctccgaatgcggcaagtgcttcagccagtcatcccacctcagacagcatatgaaagtgcacaaggaagagaaacctagaaaaacccgaggtaagaacatccgagtcaaaacacatctcccgagctggaaggctggaactggacggaaaagtgtggccggcttgaggtag

SEQ ID NO: 141247 - DNA, 237 bp, Artificial Sequence
  Description of Artificial Sequence: Synthetic coding sequence
atgaccacattcaaggaagcaatgacgtttaaggatgtcgcagttgtctttactgaggaggaattagggctgttagacctggctcaacgaaagctgtaccgcgacgtgatgctagaaaacttcaggaatctgctgtctgtgggtcaccaagcttttcacagagacacattccactttctgagagaggaaaagatctggatgatgaaaaccgcaatacagcgtgaaggcaacagctag

SEQ ID NO: 141248 - DNA, 2124 bp, Artificial Sequence
  Description of Artificial Sequence: Synthetic coding sequence
atgacaactttcaaagaggccatgaccttcaaagacgtggccgtggtgtttaccgaagaggaactcggcttgctggatctcgcgcagcggaagctctatcgggacgtcatgctcgaaaacttccgtaatctgctgtcagtcggtcaccaggcctttcacagggacaccttccatttcctaagggaggagaagatctggatgatgaaaaccgcaatccagagagagggtaacagcggcgacaagattcagacagaaatggagacagtttctgaggcaggcacgcaccaggagtggtcctttcagcagatctgggaaaagatcgcatccgacctaaccaggtcccaggaccttatgatcaatagcagtcagttctcaaaagaaggggacttcccttgccagactgaagccggcctgtctgtcatccacacaagacaaaagtcatctcaaggtaacggctataagccctcatttagcgacgtgtctcatttcgactttcaccaacagctgcattcaggggaaaagtctcacacctgtgatgagtgtggaaagaatttctgttatattagcgcattaagaattcatcaaagagtacacatgggcgaaaaatgttataaatgtgacgtttgtgggaaggaattttcccaatcatcccacctgcagacccaccagagagtccatacaggggaaaaaccgtttaaatgtgtggaatgtggtaaaggtttctctcggcggagcgctctgaatgttcatcataaattacacacaggagaaaagccgtataattgcgaggaatgcggcaaagccttcatacatgatagtcagctgcaagagcaccagagaatacacacaggagaaaaaccgtttaagtgcgatatttgcggaaagagcttctgtgggcggtcccgacttaaccgtcacagtatggtgcatacagccgaaaagcctttccggtgcgatacgtgcgataagagttttaggcagcgttctgcattgaatagtcatcggatgatacacaccggcgagaagccttacaaatgtgaggagtgcggcaagggtttcatctgtcggagggacctgtatacacatcatatggtgcataccggagaaaagccttacaattgtaaagagtgcggtaaatcatttcgttgggccagctgcctgttgaagcatcaacgagtacatagcggcgagaagcccttcaagtgcgaggaatgcggtaaaggattttatacaaatagccaatgctatagccatcagcgaagccacagtggagaaaagccgtataaatgcgtggaatgtggaaagggctataaacggaggcttgacctggattttcatcagagagtccacaccggagagaagttgtacaattgcaaagaatgcggcaagagtttctcccgcgccccttgcttactgaagcacgaaagactccactccggggaaaagccctttcagtgtgaggagtgtggtaagaggtttacccagaactcccacctgcattcccaccagagagtgcacacaggggagaagccctacaaatgcgaaaaatgcggtaaaggatataatagcaagttcaacctcgacatgcaccagaaggtgcacactggcgagaggccatacaattgtaaagagtgtgggaaaagcttcggatgggctagctgtttgcttaagcaccagcggttacacagtggggagaagccctttaagtgtgaggaatgtggaaagcgctttacacagaactctcagctgcattctcaccagcgggtgcacacaggcgagaaaccatataaatgtgatgagtgtggaaagggcttttcatggagtagcacgagactgacgcatcaacggaggcactcacgagagactccgctcaagtgcgagcagcatggcaaaaacattgttcagaactcttttagcaaagtgcaggagaaggtgcattctgtagaaaaaccctacaagtgcgaagactgtggcaaagggtacaatcgtcgcctcaacctggatatgcaccaacgcgtccatatgggggagaagacatggaagtgccgagagtgcgatatgtgtttcagccaggcatctagtctgaggttacaccagaacgtccacgtcggtgaaaagccgtag

SEQ ID NO: 141249 - DNA, 1932 bp, Artificial Sequence
  Description of Artificial Sequence: Synthetic coding sequence
atgctggagaactacgggaatgtggcctcacttgggtttcctctgttaaagcccgcggtgatatcccaactggagggcggtagcgagctcggaggttcctccccgctggccgccggtacgggccttcagggtttacagaccgacatccaaactgacaatgacctcaccaaagaaatgtatgagggtaaggaaaacgtgagctttgagttacagagagacttctcccaagagactgatttctcagaagctagtctgctggagaagcaacaggaagttcactccgctgggaatattaaaaaagaaaagtctaacacaatagatggcactgtgaaagatgaaacatctcctgtggaagaatgttttttttcacagtctagcaactcgtatcagtgccacaccataacgggggagcaaccgagcggctgtaccggcctaggaaaatccatatccttcgacaccaagctggtgaaacacgaaattataaacagtgaggaacggccctttaaatgcgaggaactggttgagccctttagatgtgacagtcaactcattcaacaccaggagaacaatacagaggagaagccctatcagtgttcagagtgtggcaaggccttcagcattaatgaaaagctgatttggcatcagaggctccactccggggagaaacccttcaagtgtgtggagtgcggcaagtcattttcctactcgagccactacattactcatcagactattcattctggggaaaaaccctaccagtgcaagatgtgcggaaaggcatttagcgtgaatggaagcctgtccaggcaccagcgcatccacacgggcgagaaaccttatcagtgtaaagagtgtggcaacggcttcagctgctctagcgcctacatcactcatcaacgcgtacatacaggcgaaaaaccctatgaatgcaatgattgcggcaaggcatttaacgttaatgctaaactcatccagcaccagaggattcacaccggagaaaaaccttatgagtgcaacgaatgtggcaagggtttcaggtgctcctctcagctacgtcagcaccagagtattcacactggagaaaagccataccagtgtaaggaatgtgggaagggcttcaataacaatacgaaactgatccagcaccagcggatacacactggtgagaaaccttacgagtgcactgaatgtgggaaggcattttcagtgaaggggaagctgatccaacaccaaagaatccacacgggcgagaagccgtacgagtgtaatgaatgcgggaaagcttttcgctgtaatagtcagttccgccagcatttacgcattcacacaggagagaagccttatgagtgcaacgaatgcgggaaggccttcagcgtaaatggaaagcttatgcggcatcagagaatccacacaggagagaaacccttcgagtgcaatgagtgtgggcgctgttttacctctaagagaaatctgctggaccatcaccgtattcatacgggcgagaagccttatcagtgtaaagagtgcggcaaagcattcagcatcaatgcaaagcttacccggcaccagcgtatacatacaggagagaagccgttcaaatgtatggagtgtgaaaaagcattttcctgctcttcgaactacatcgtgcaccaacgtattcataccggggagaaaccctttcagtgcaaagagtgcgggaaggcttttcatgtgaacgctcacctcattagacaccagcgctcccatacaggcgaaaagccctttcgctgcgtcgaatgcgggaagggtttttcctttagcagcgactatattattcaccaaacggtgcatacatggaagaagccctacatgtgttccgtgtgcggcaaagcatttcgattctcgttccagttgtctcagcaccagtctgtgcattcagaaggcaaaagctag

SEQ ID NO: 141250 - DNA, 1248 bp, Artificial Sequence
  Description of Artificial Sequence: Synthetic coding sequence
tgcgggaaggctttctctattaacgaaaagcttatttggcaccagcggctacattctggagaaaagccatttaagtgtgtagaatgtggtaaatctttcagctacagttcccattacatcacgcaccagacaatacactctggagagaagccctatcagtgcaaaatgtgcgggaaggccttcagcgttaacgggtcgttaagccgccaccagcggatccacaccggtgaaaaaccctatcagtgtaaagaatgtgggaatggcttttcatgttcttccgcctacattacacatcagcgcgtccacacaggcgaaaagccttatgaatgcaatgattgcggcaaagcctttaacgtaaacgctaaattaattcagcaccagaggatccacactggggaaaagccatatgagtgtaacgagtgtggcaaggggtttcgttgctccagtcagctgaggcagcaccagagcatccatacaggggagaagccatatcagtgcaaagagtgtggaaaagggttcaataacaacacaaaactgatccagcatcagcggattcatactggcgaaaagccttatgaatgtaacgagtgcggcaaagcttttcgctgtaacagccagttcagacagcacttaaggattcatacgggagagaaaccttacgagtgcaatgagtgtgggaaagccttctcggtcaacggtaaacttatgcggcaccagcgcatccacacaggggagaagccctttgaatgtaacgaatgcggtcgctgctttacatcaaaaagaaacctgctggaccaccaccgaatccataccggagagaagccctaccagtgtaaggagtgtgggaaagccttttctatcaacgcaaaactcacacgccaccagcgtatccatactggagagaaaccctttaaatgcatggaatgcgaaaaagcttttagctgttccagcaactatatagtgcaccaacgtattcacaccggcgagaaaccattccagtgtaaggaatgcggaaaagcatttcacgtaaacgcccacctgattcgacatcagaggagtcatactggcgaaaaaccgttccggtgtgtagagtgtggcaaaggcttcagttttagctcagattatataatccaccaaaccgtgcacacttggaaaaagccgtacatgtgctcagtgtgtgggaaagcatttcggttttcttttcagctgagccagcaccaatcggtgcacagtgaggggaagtcttag

SEQ ID NO: 141251 - DNA, 1932 bp, Artificial Sequence
  Description of Artificial Sequence: Synthetic coding sequence
atgctagaaaactacggcaatgtcgcctcattgggtttccccctcctcaaacctgcagtcatctcccaactcgaaggagggtctgagctgggtggaagctctcctctagctgcaggaacaggcctgcaaggtctgcagactgacatccagaccgataatgatctaaccaaagagatgtacgaaggtaaagagaacgtatcctttgaattgcagagggacttttctcaagagactgactttagcgaagcttcattgctcgaaaagcagcaagaagttcactctgctggaaacatcaaaaaggagaagtctaacaccatcgacggaaccgtcaaggatgagacaagtcctgtggaggagtgcttcttctctcagtcaagcaattcttatcagtgccataccataaccggggaacagcccagtggatgtactggcctgggcaagtcaatctcttttgatacaaaacttgtgaagcacgaaatcattaactcggaagagaggcccttcaaatgtgaagagctcgttgagcctttccgatgtgattcccaactgatccagcaccaagaaaataatactgaagaaaagccatatcagtgtagtgagtgtggcaaagcattttcgatcaacgaaaaattgatctggcaccagagactccactctggtgagaagcctttcaaatgtgtagagtgtggcaagagcttctcgtacagcagtcactacattacccatcagacaatccacagtggagagaaaccataccagtgtaagatgtgcggcaaagcctttagcgtcaacggctcactgagccggcatcagcgaattcacaccggagagaagccttaccagtgtaaagagtgcgggaatggtttctcctgctcaagtgcttacatcacgcatcagcgcgtgcatacaggcgagaagccctacgagtgcaatgattgcggcaaagctttcaacgtgaacgccaaactgatccagcatcaacgcatccatactggtgaaaaaccatacgagtgtaatgagtgtggaaaggggttcaggtgttcctcccaactgcggcagcatcagtctatccacactggagagaagccctaccagtgtaaagaatgtggcaagggtttcaacaataacacaaagctaatacagcatcagcgaattcataccggagagaaaccctatgagtgtactgaatgtgggaaagccttctccgtgaagggaaagcttattcagcatcagagaattcacacaggggagaaaccctacgaatgcaatgagtgcgggaaggcttttcgttgcaactctcagtttaggcagcaccttcggatccatacaggtgagaagccctatgagtgtaatgaatgcgggaaggcttttagtgtaaacggtaagctgatgaggcaccagagaattcacaccggcgagaagccgtttgagtgcaacgaatgtggtagatgttttacaagcaaacgcaacctcctggatcaccaccggatccatactggggaaaaaccttatcagtgcaaagagtgcggaaaggctttttcaatcaacgctaagctgactcgacaccagcggattcatacaggggaaaagcctttcaaatgtatggagtgtgaaaaggccttctcttgttcatctaactacatagttcatcagaggattcatactggggaaaagccatttcagtgcaaagagtgcggaaaggcgtttcatgtgaacgcccatctgattcgtcaccaaagatcccatacgggagaaaaaccctttcggtgcgtggagtgcgggaagggattctcgttcagctcagactacatcatccatcagaccgtacacacatggaagaaaccttacatgtgtagtgtttgtggtaaggcattccgcttctcttttcagctgagccagcaccagagtgtccacagcgaagggaagtcctag

SEQ ID NO: 141252 - DNA, 1932 bp, Artificial Sequence
  Description of Artificial Sequence: Synthetic coding sequence
atgctggagaattacgggaatgtggcatcccttggtttcccattgctgaagccggctgttatttctcaactggaaggcggatccgaattaggcggtagttctcctttggcggcaggcactggcctgcaggggctccagactgacatacagacagataacgatctgacgaaggaaatgtatgagggaaaagagaacgtttcattcgagctgcagcgggatttcagccaggaaacagactttagcgaagcctctttgctagagaagcagcaggaggttcactccgctggaaatatcaagaaggagaagtccaacactattgatggcacagttaaggatgagacctctcctgttgaggaatgtttctttagtcaatcttccaattcttaccagtgccacactatcacgggagaacagccaagcgggtgtacaggtttgggcaaatctatcagcttcgacaccaaactcgtgaagcacgagattatcaattctgaggaaagaccatttaagtgcgaagagttggtggagccatttagatgcgactcacagttgattcaacaccaggagaacaacacagaggagaaaccatatcagtgctccgaatgcggcaaagccttctcaatcaatgagaaattgatctggcatcaaagactccactctggagaaaaaccctttaagtgcgtcgagtgcggaaagtcattctcgtattcctctcactatattacacaccaaacaatccactccggcgagaaaccgtaccagtgcaagatgtgcgggaaggcctttagcgtgaacgggtccctttctcgtcaccaacgtatccacactggcgaaaaaccctaccaatgcaaagagtgcgggaatggatttagttgtagcagcgcttatattacgcatcagagagtccacacaggcgaaaaaccttacgagtgcaatgattgtggcaaagcatttaatgtaaatgctaaactgatccagcaccagagaatacacacaggcgaaaaaccttatgaatgcaacgaatgtgggaaagggtttcgatgcagctcgcagctgcgacagcaccaatccattcacacaggagagaagccatatcagtgtaaggaatgcggaaagggctttaataacaataccaagctaatacaacaccagcggatccacacaggggaaaagccttacgagtgcaccgaatgcggtaaagccttctctgtgaaagggaaactgatccaacaccagcggatccacaccggtgaaaagccttatgaatgcaacgaatgtggcaaagcttttaggtgcaactctcagttccgtcagcatttaaggattcataccggtgaaaaaccatatgaatgcaatgaatgcggtaaggcatttagtgtgaacggtaagctgatgcgacaccagcgaatccatacgggcgaaaaaccgttcgagtgtaacgaatgtggtcgctgcttcacctcaaaacgcaacctgctcgaccaccacaggatccatacaggcgagaaaccctaccaatgtaaggagtgtggaaaagcgtttagcattaatgccaagctgacccgccaccaaaggattcacactggcgaaaaaccattcaagtgtatggagtgcgaaaaggctttctcctgttctagtaattacatcgttcaccaacgtatccacacgggcgagaaaccctttcagtgcaaagagtgtggcaaggcatttcacgtgaacgcacatctgattcgacatcaaagaagccatactggcgagaaaccttttcgctgtgtcgagtgtggtaagggcttctcattctcgtcagactatattattcaccagacggtgcatacatggaagaagccgtacatgtgctcggtgtgtggaaaagcattcaggttcagtttccagctgtcacagcaccagtccgttcactccgaggggaagtcctag

SEQ ID NO: 141253 - DNA, 1758 bp, Artificial Sequence
  Description of Artificial Sequence: Synthetic coding sequence
atgtacgagggcaaagaaaacgtgagcttcgaacttcaacgcgattttagtcaagaaacagattttagtgaggcctccctactagagaagcagcaagaagttcacagtgcaggcaacatcaaaaaggaaaagtctaataccatcgacggaacagtgaaggacgagacaagccctgtggaggagtgctttttcagccaatcttctaacagttaccagtgtcacactatcaccggagaacaacccagcggctgcactgggcttggcaaatcaatcagttttgacaccaagctcgtgaaacatgagattatcaacagtgaggagcggccattcaaatgcgaggagctggtggagcctttccgttgcgactcccagctcatccaacatcaggagaacaacaccgaggaaaaaccctaccagtgctccgagtgcggcaaggcgttcagcattaatgaaaagctgatttggcatcagaggttacacagtggggaaaaaccatttaagtgcgtggaatgtggcaagtcgttttcctattccagccactacatcactcatcagaccatccactccggtgagaaaccctaccaatgcaagatgtgcggcaaagcttttagtgtgaacggctctctgagccggcaccagcgaatccacaccggtgagaagccgtaccaatgtaaggaatgtgggaacggattctcttgctcctccgcatacattactcaccaaagagtgcacaccggtgagaagccctacgaatgcaatgattgcggcaaggcctttaacgtgaacgctaaactcattcagcatcaaaggatccacacaggggagaaaccatatgaatgtaatgagtgtggaaaggggttccggtgctcttcgcagctgagacagcatcaaagcattcatacaggtgaaaagccctaccagtgcaaggagtgcggcaagggttttaacaacaacacgaagctaatacaacaccagcgtattcacaccggtgagaagccatacgagtgcacggagtgtggcaaggcgttcagtgtaaagggcaaacttattcaacatcagagaatccataccggcgaaaagccatatgaatgtaatgagtgtgggaaggcattcagatgtaattcacaatttaggcaacatctgagaatccacaccggcgagaagccctacgaatgcaatgaatgcggcaaggctttttcagtaaacggaaagttgatgcgccatcaacgtattcacaccggggagaaaccgttcgagtgcaacgagtgcggccggtgttttaccagcaagcgtaacctgctcgaccaccacaggatccataccggggaaaagccctaccagtgcaaggagtgcgggaaggccttcagtataaatgcaaagctcacccgacatcagcgaatccatacaggagagaagccgtttaaatgtatggagtgtgagaaagcgttctcatgttcatctaactatattgtgcatcagcgtatacacacaggggagaagccctttcagtgcaaggagtgtgggaaggcattccatgtgaatgcccaccttatcagacaccaacgctcacataccggagaaaagccttttcgatgtgtggagtgcggcaaagggttttcattttctagtgattacatcatacatcagaccgttcatacctggaagaagccatatatgtgcagcgtgtgcggaaaggcattcagattttctttccagctctcacaacaccagagcgttcacagcgaagggaagtcctag

SEQ ID NO: 141254 - DNA, 1758 bp, Artificial Sequence
  Description of Artificial Sequence: Synthetic coding sequence
atgtatgaaggcaaagagaacgtctcatttgagcttcagagggacttctcgcaagaaactgatttctcggaggcctctctgctggagaaacagcaggaggtgcatagtgccggtaatatcaaaaaagagaagtctaatacgattgatggaacagtgaaggacgagacaagtcccgtagaagagtgttttttttcacaatcctctaattcatatcagtgtcatactattactggagagcagccctcaggatgtacagggctgggaaagtcaatctcctttgatacgaagttggtgaagcatgagatcattaactccgaggagcgacccttcaaatgcgaagaactggttgaaccgttccggtgtgattcacagctcatccagcatcaagagaacaacacagaggagaagccctaccagtgttccgaatgcgggaaagcatttagtattaacgaaaagctgatttggcaccagcggttgcattcaggcgagaagcctttcaaatgcgttgaatgcggaaagagttttagctactcatctcactacatcactcatcagacgattcactctggagaaaaaccttaccagtgcaagatgtgcgggaaggcattttccgtcaacggatctttgtcccggcaccagcgcatccatacaggggagaaaccatatcaatgcaaggagtgcggtaatggtttttcttgttcatccgcctatatcacacatcagcgcgtccacactggcgagaagccatacgagtgtaacgactgtgggaaagcgtttaacgtcaatgctaagctcatccaacatcagcgaattcacaccggcgagaaaccttacgagtgcaatgagtgcggaaaggggtttaggtgttcttcccagctgaggcaacaccagagcatacacactggggagaagccatatcagtgtaaagaatgtggaaaaggatttaacaacaacacaaaactcatacagcaccaaagaatacatacaggcgagaaaccgtacgagtgcactgagtgtgggaaggccttctccgtgaagggaaaactgattcagcaccagcggatccatacaggcgagaagccctatgaatgtaacgagtgtggcaaagcgttccggtgcaactctcaattcagacagcatttgcgcatccacactggtgagaaaccatacgagtgtaatgagtgcggcaaggctttcagcgtgaacgggaaactcatgagacaccagcgtattcacacaggcgaaaaaccatttgagtgcaacgaatgcggaagatgctttacgagcaagagaaacctgctagatcatcaccggattcatacaggggaaaaaccttatcaatgcaaagagtgtggcaaggcgttctcgatcaacgctaagctgacccgtcatcagcgtatccacacaggtgaaaaacccttcaagtgtatggagtgtgagaaagccttctcctgctcttccaactacatcgtgcaccagaggatacacaccggcgagaagccctttcagtgcaaggaatgcggaaaggcctttcacgtgaatgctcacctgattaggcaccagaggtcccacactggcgaaaagccattccggtgtgtggagtgcggaaagggcttcagcttttctagcgactacatcattcaccagacagttcacacatggaagaaaccttacatgtgttctgtgtgcggtaaggctttccgcttcagctttcagctctctcagcaccagtcagttcatagcgagggaaagtcttag

SEQ ID NO: 141255 - DNA, 5538 bp, Artificial Sequence
  Description of Artificial Sequence: Synthetic coding sequence
atggggctctgtggattgctggagcgctgctggctgcaccacgatcctgacggagtgctgacactgaacgccgagaatacgaattatgcatatcaggtaccaaattttcacaagtgcgaaatctgtctactgtccttccctaaggaatcacagttccagcggcatatgagagatcacgagcggaacgacaagccacataggtgcgaccagtgtcctcagacatttaatgtggagttcaatctgacacttcataaatgcactcatagtggagaggaccccacatgccctgtctgtaataagaaatttagcagggtggctagcctgaaagctcacatcatgctgcatgagaaagaggagaatcttatttgttctgagtgcggggacgagttcactctacagagccaattggccgtacatatggaggaacaccgccaggaacttgcaggaacaagacagcatgcatgtaaggcctgcaaaaaagagtttgagacttcctcagagctcaaggagcacatgaagactcattacaaaatcagagtgtcttcaacccggagctacaatcgcaacattgatcgatcagggtttacatactcctgcccacattgcggaaagacattccaaaagccctcacagctgaccaggcacataaggattcataccggggagagaccctttaagtgctccgagtgcggcaaagcgtttaatcagaaaggggctctccagacccacatgataaaacacactggggagaagccccatgcctgcgcgttctgccctgccgcattctcccagaaaggtaacctgcagtcacatgtacagagggtgcattctgaagtaaaaaatggacctacatacaactgcactgagtgttcatgcgtgttcaagtctctcggcagccttaatactcatatctctaagatgcacatggggggtcctcagaattcaaccagttcaacggaaacagctcacgtgctgacggctacattattccagacgctgccattacagcaaacagaggcccaggccaccagcgccagcagtcagccatccagccaagccgtgagcgacgtaattcagcagctgttagaattgtccgaaccggcacctgtcgagtctggccagtctccgcagccaggccaacagctttcaattacagtggggattaatcaggatatcctgcagcaggccctcgagaatagtgggctcagttccattcctgccgccgcacaccctaacgatagctgtcatgccaaaactagtgcgccacacgcccagaacccagacgtgtcatctgtgtcaaatgagcaaactgaccctacggatgccgaacaggaaaaggaacaggaaagccccgagaaactggacaaaaaagaaaaaaaaatgattaagaagaagagccccttcctgcctgggtctattcgcgaagagaacggtgtgcggtggcatgtctgcccctactgtgctaaggaattcagaaagccctccgacttagttcgccatatccgaattcatactcatgaaaaaccatttaagtgtccacaatgcttcagggctttcgcagtgaagtccactttgactgctcatatcaagacacacacaggaattaaggccttcaagtgccaatactgcatgaaatcctttagtacctctggctccctaaaagtacatattaggctccacactggtgtcaggccattcgcatgtccgcattgtgataagaagtttagaaccagcgggcatagaaaaacacacatcgccagccactttaaacatactgagctcagaaaaatgcgacaccagcgaaagccagcaaaggttcgcgtcgggaagactaacatacctgtccccgacatcccgttgcaagagcccatacttataacagatcttggcctgattcagcccatccccaagaatcaattcttccagtcatattttaacaacaacttcgtgaatgaagcagatagaccctataagtgcttctactgtcatcgtgcctacaaaaagagctgccaccttaaacagcacatccgctcccatacaggcgaaaagcctttcaaatgcagccagtgtggtcggggatttgtgtcagctggggtgctgaaggcgcatataaggacccacaccgggctaaagtccttcaaatgtcttatttgtaacggagcattcactaccgggggaagcctgcggcgccacatgggcatccataatgatctgcggccatatatgtgcccctattgtcaaaagactttcaaaacatcactgaattgcaaaaagcacatgaagacccaccggtacgagctagcccaacaattgcagcagcaccagcaggccgcatccattgatgactccaccgtggatcagcaaagcatgcaggcttcaacccaaatgcaggtggaaatcgaatccgacgaactgccgcagaccgccgaagtggtggcagcaaaccccgaggccatgctcgatctggaaccacagcatgtagtgggaacggaggaggccggcttgggccagcaactagccgatcaacccttggaggctgatgaggatggtttcgtggccccacaggatcccctgcgaggacatgtggaccagttcgaggagcaaagtcctgcccagcagagtttcgagcccgcaggtctgcctcagggcttcacagtgactgatacatatcaccagcaaccacagttcccccccgtccaacagctgcaggatagtagtacattggagtcacaagcactatccacctcttttcaccagcagtctctactccaggcaccctccagcgatggcatgaatgtcacaacacgcttgatacaggagtcgtcacaggaagagttagatctgcaagcacagggaagccagttcctggaggacaacgaagaccagagtcgtcgctcgtatcgttgtgattactgcaacaaaggctttaagaagtcttcacatttgaagcagcatgtgagatctcatactggcgagaaaccttataagtgcaagctgtgtgggcggggattcgtgtctagtggcgtattgaagtcccacgagaaaactcacactggtgtaaaggcttttagctgcagcgtttgcaatgcttcattcacaactaatggcagtctgacacgacacatggccacccatatgtcgatgaaaccatataaatgtccattctgtgaggaggggttccggactactgtgcattgtaagaagcacatgaagagacatcagaccgttcctagtgcagtgtccgcgacaggcgagaccgagggcggcgatatttgcatggaagaggaagaggagcattccgacaggaacgcctcccggaagtctcgccccgaagtgatcacgttcacagaggaggagacagctcagctggccaaaattcgcccccaggaatctgcaaccgtcagcgaaaaggtgttggtgcagagtgcggccgagaaagaccgtatcagcgaattgagagataaacaggcagagcttcaggatgagcccaagcatgcaaattgctgtacctattgccccaagtcattcaaaaagccctcagacctggtgagacacgtaagaatccacaccggcgagaaaccatacaaatgcgatgaatgtggcaaatctttcactgtgaagtccaccttggactgccacgttaaaacacacacaggccagaagttgttttcctgccacgtctgttccaacgccttctccactaaggggtccctcaaggtccatatgcgtttgcacactggcgccaaaccttttaaatgtccccactgtgagctgaggttcaggacatcgggcaggcgtaaaactcatatgcagtttcattacaagccagaccccaaaaaggcccgcaaaccaatgacaagatcctcttcagaaggcctgcagccggtgaacctgcttaacagctcttcaactgaccctaatgtgtttatcatgaacaactccgtcctgacgggccagttcgatcaaaacctcctccagccaggcctggtgggccaggccatactgcccgcctcagtgagcgccgggggtgatctaacagttagtttaactgatggatcccttgcgaccctggaaggcattcaactgcaattggccgcaaatctcgtgggacctaatgtgcagatcagcggaatagacgccgctagcatcaacaacatcactttgcaaatcgatccctcaattttacagcagactttacagcaaggaaacctgctcgcccaacagctgacaggagagcctggactggcaccccagaatagttcactgcagaccagcgatagtacagtaccggctagcgtcgtcattcaacccattagtggtctatcgctgcagcctactgttacaagcgcgaacctgaccattggtcccctgtcagagcaggatagcgtcctgacgaccaactcgagcggcacccaggatctgactcaagtaatgactagtcaagggctagtctcccccagtggaggaccccacgaaatcacccttacgataaacaatagctccctgtctcaagtgcttgcccaggccgcaggacccacagccacgtcctcctccgggtcaccccaggagatcacactcactattagcgaattgaacactacaagcgggtccctgccttctacaacgccgatgtcgccgtcggccattagtactcaaaatctggttatgtcttcatcaggcgtaggcggcgacgccagcgtgactctgaccttggctgacacacaggggatgttgtcgggagggctggacacggtgacgcttaacatcacttcccaggggcaacagtttccagcccttctaactgatcccagcctcagtggacagggtggagccgggagcccccaggtgattctagtgagccatacaccacagtccgcgtcagccgcttgcgaggagattgcctaccaggttgctggcgtctccgggaaccttgcacctggtaatcagccggaaaaagaaggcagagctcaccagtgcttggagtgcgaccgggcgttctcctccgccgccgtgcttatgcaccattccaaggaggtgcacgggcgtgagcgcatacacggctgtcctgtgtgcagaaaagctttcaaacgggccacccacttgaaagagcacatgcagacgcatcaggccgggcccagcctgagcagtcagaagccacgggtgtttaagtgtgacacgtgcgaaaaggcctttgctaagccatcccagctcgaaaggcacagtagaattcatactggcgaacgccctttccattgtaccctttgcgagaaggcatttaaccagaagagtgccctgcaggtgcatatgaagaaacacacgggcgaaaggccttacaagtgtgcctattgcgttatgggttttacccagaagtctaacatgaaacttcatatgaagagggctcacagctacgctggcgcactgcaagagagcgccgggcacccagagcaggatggggaggagctgagtaggactttgcacctggaggaggtcgttcaggaggcagccggagagtggcaggcactaacccatgttttttag

SEQ ID NO: 141256 - DNA, 4677 bp, Artificial Sequence
  Description of Artificial Sequence: Synthetic coding sequence
atggggctctgtggcttgcttgagaggtgctggctgcatcatgatcctgatggcgttctaacgctaaacgcagaaaacactaattacgcttaccaggtgcctaacttccacaaatgcgaaatctgcctgctctccttccctaaagagagccaatttcagaggcatatgcgggaccacgaaagaaacgacaaaccacatcgctgtgatcaatgccctcagactttcaatgtggagttcaacctcactcttcacaagtgcacgcactcaggcgaagatccaacatgcccagtttgcaataagaagttctctcgggtggcatcgcttaaagcgcacataatgcttcatgagaaagaggagaacctgatctgttcagagtgcggcgatgagttcacgctacagagccagctagccgtccatatggaagagcaccgacaggagctggcaggcacgagacagcatgcgtgcaaagcatgtaagaaggagttcgaaacttcttccgagttaaaagagcacatgaaaacccactacaagattcgagtgagctctactcgctcctacaaccgtaatatcgatagatcaggattcacctactcttgtcctcactgcggtaagacgtttcagaagccttcacagttgactaggcatattcgcatccacactggggagcgtcctttcaagtgctcagagtgcgggaaagccttcaaccagaagggcgctctccagacccatatgataaaacataccggagagaagccccatgcctgcgccttttgcccggccgccttcagtcagaaaggcaacctgcagagccatgtccagcgtgtgcactccgaggtgaagaacggacctacatataattgcacagagtgctcctgtgtctttaaatctctgggctctttaaatactcatatctctaagatgcacatggggggccctcagaatagtacatcatcaacggaaaccgcgcatgtgcttaccgcaacattattccagactctgcctctgcagcagactgaagcacaagccaccagcgccagctctcaaccctcctcccaggccgtcagcgacgttatacagcaactcttagaactgagtgagccagccccagtagagagtggccagagccctcagcctggccagcaactgagcatcaccgtgggaatcaatcaggacatcctgcagcaggcgctggaaaacagcgggttatcatctatcccggccgccgcacacccgaacgattcttgccacgcgaaaacctctgcaccacatgctcagaacccagacgtcagctcagtttccaacgaacagactgatcctactgatgcagagcaggaaaaagagcaagagtcccctgagaagctcgacaagaaggagaaaaagatgattaagaagaaaagcccattcctgcccgggtccatccgtgaggagaatggcgtgaggtggcatgtctgcccttactgcgctaaagagtttcgcaagccaagcgacctggtacgacatatccggattcatacacacgaaaaaccatttaaatgccctcagtgttttagagcattcgcagtgaagtccacactaacagctcacatcaagacacatactgggatcaaagcattcaaatgtcaatactgcatgaagagcttcagcacttcgggctccttaaaggtccacatacgactgcacacaggcgttaggcccttcgcctgcccccattgtgacaaaaagtttcgtacaagcgggcatcgtaagacccatatcgcgagccacttcaaacacacggagctgcggaaaatgcgacaccaacgcaagccagccaaggttagggtgggcaagactaatatcccagtccccgatatacccctgcaggagccaatactgatcactgatttgggtctgatacagcccatacctaaaaatcagttcttccaaagctactttaataacaatttcgtgaacgaggctgatagaccatataagtgcttctactgtcaccgggcgtacaaaaagtcttgccacctaaagcagcacatacgtagccacacgggggaaaagccctttaaatgttctcagtgcggccgcggatttgtatccgctggcgttctcaaggctcatatacggacacacaccggcctgaaatcctttaagtgcttaatttgcaatggcgccttcacaacagggggatcgctgcgcagacacatgggaatccacaacgacctaagaccgtatatgtgcccttactgccagaagaccttcaaaacttcccttaactgcaaaaagcatatgaagacccaccgttatgaactggcacaacaattgcagcagcaccagcaagcagcctctattgacgatagtaccgtcgaccagcaatccatgcaggcctctacacagatgcaagttgagattgagagtgatgaacttccacagactgccgaggtggtagctgcgaatccagaggcaatgctggacctggaaccgcaacatgtggtcggtaccgaggaggccggactaggccagcagttggctgatcagccactggaagcggatgaagacgggttcgtggctccccaggaccctctgaggggacatgttgatcagtttgaagagcagagtcctgcccagcaatctttcgaacctgcgggtctgccacagggttttacagtcaccgacacctaccatcagcaaccacagttccctcccgtgcagcagctgcaagactctagtacacttgagtctcaagccctttcaacctctttccatcagcagtctttgctgcaggcacctagtagcgacgggatgaatgtgacaactagactgatacaggaatcttcccaggaggaactggatctccaggcacaggggagtcagttcctggaggacaatgaagaccaatctcgccggagctatcggtgcgactattgcaacaaaggctttaagaaatcgtcacacctgaagcagcacgttagaagtcatacaggcgagaagccatacaaatgcaaactttgtgggcgcggatttgtctcaagcggcgtcctgaagtcgcatgaaaaaacccacaccggggtcaaggccttctcatgtagcgtgtgtaacgcctcatttactacaaatgggtcactcacacggcacatggcaacgcacatgtctatgaagccttataagtgtcccttctgcgaagaagggttccgcacaactgtgcattgtaaaaagcatatgaaaagacatcagaccgtgccatccgctgtttcagcaaccggtgaaaccgagggaggggacatctgcatggaggaggaggaggagcactcggatcgcaatgcaagcaggaaaagtaggcctgaggtgataaccttcacagaggaggagactgcccagctcgccaagatcagaccacaggagtccgccaccgtctccgaaaaggtcctggttcagtcggccgcagaaaaggataggatctctgagctgcgagacaaacaagccgaactccaagacgagccgaagcacgcaaactgttgtacctactgcccaaaatctttcaagaagccctctgatctggtccgtcatgtgagaatccacacgggagagaagccttataagtgtgatgagtgtgggaagagtttcaccgttaagtccaccttggattgccacgtcaaaacgcacaccggtcagaaactcttctcttgccacgtgtgctctaacgctttctccaccaagggatctctgaaggtacacatgcggctgcacaccggcgccaagcccttcaagtgtccacactgtgagctgagatttcgcacgagtggcagacggaagacccacatgcagtttcattacaagcccgatccgaaaaaggccagaaaacccatgacacgctcctcctctgagggactacagcctgtgaatctgcttaatagctcttccaccgaccctaatgttttcattatgaataatagtgtcctcactggccagtttgatcagaacctgctccagccgggtctcgtgggtcaggccatcttacctgcatctgtgagcgccgggggggatctgactgttagcctaaccgacggttcactggcgactctcgaaggaattcagctgcaactggctgcaaacttggtggggcccaatgttcagatcagcggcatcgatgccgccagcattaacaatatcaccctacagatcgacccctccatactccagcagactttacagcaaggaaatctgctggcacagcagctgacaggagaacccgggcttgccccccaaaactcttctctccagacatccgactccacggtacctgcaagcgttgtgatccagcctatatctggactgtccttgcagcctacagttacttccgcgaacctcacaattggccctctgtccgagcaggacagcgtgctcacaacaaactcctccggaacccaagatctgacccaagttatgacatcacaggggctggtctccccctcaggcggccctcacgagataaccctgaccatcaacaattcttccctgagccaagtactggcgcaagcagctggcccaactgccacctcttcatccgggtcccctcaggaaatcactctcaccattagcggatcacgatctgtacagcactctgtgggacctcaggagtgtggtagtgtggaagcactatatctggagaattccagcgataagacttag

SEQ ID NO: 141257 - DNA, 4677 bp, Artificial Sequence
  Description of Artificial Sequence: Synthetic coding sequence
atgggcctctgcggactgctggagagatgctggctccaccatgacccagatggggtgctgaccctgaacgcggaaaacactaactacgcctaccaggtgccaaacttccacaagtgtgaaatctgcctgttatcatttcctaaagagtcacagttccaacgccacatgcgggaccacgagcggaacgataagccacatcgttgtgaccagtgcccccagacgttcaatgtggagtttaacctaacgcttcataagtgtactcattcgggagaggacccaacctgccccgtgtgtaacaagaagtttagccgcgtggcttcgttaaaggcacacataatgttgcacgagaaggaggagaatttgatttgttcagaatgcggcgacgagttcactctccaatcgcagctcgcggtccatatggaggaacataggcaagagctggcaggcacccgccagcacgcatgtaaagcatgcaagaaggaatttgagacaagttccgagttaaaagagcacatgaaaacccattacaagattagagtatcttccacccgatcttacaatcggaacatcgatcgtagtggcttcacctactcgtgtccccattgcggcaagacattccagaaacccagccaactgacaagacacataagaatccacaccggcgagagaccctttaaatgcagtgagtgcggcaaagcattcaatcagaaaggagccttacagacgcatatgattaagcacaccggggaaaagcctcacgcctgcgccttctgcccggcagccttttcacagaaggggaacctccagtcacatgtccaacgagtccacagcgaggtcaagaacggcccaacatacaattgtacagaatgttcctgtgtattcaagtcgctggggagtttaaatacgcatatcagcaagatgcatatgggggggccacagaactctacctcctccaccgagacagctcacgtcttgaccgcaacattatttcagactttaccactgcagcagacagaggcccaggcaaccagcgccagcagccaaccgtcttcacaggccgtgtccgacgtgattcagcaactattagaattatctgaaccagcccctgtggagtctgggcagtccccgcagcccggccagcagcttagcatcacggtcggcattaatcaggatatcctgcagcaggcccttgagaattctggtctcagcagcatccctgccgccgcccacccaaatgattcctgccacgccaagacgtccgctccccatgcacaaaatccagatgtgtctagcgtatctaacgaacagacggaccccaccgatgcagagcaggaaaaggaacaggagtcccccgagaaactggataaaaaggagaagaagatgatcaagaagaaaagccccttcctacctggcagcatacgtgaggagaatggcgtgcggtggcatgtgtgcccgtactgtgccaaagagttcagaaaaccctcagacctggtacgacacattcgcatccatacccatgaaaagcccttcaaatgtcctcagtgttttcgcgcctttgcagtgaaaagtacactaaccgcgcatattaaaacccacacagggatcaaagcgtttaaatgtcaatactgcatgaagtcctttagcacttcaggctccttgaaagttcatatcaggctacacaccggggtccgcccatttgcatgcccacactgtgacaaaaaattcagaactagcggacatcgcaaaactcacatagctagtcattttaagcatacagagctcagaaagatgaggcatcagcgaaagcctgcgaaggtgagagtcgggaaaactaacatccccgtgccagatattccgctgcaggagcctatcttaatcacagacttgggacttatacaacccattcctaaaaatcagttttttcaatcttacttcaacaataactttgtcaatgaagcagatcgtccatacaaatgtttctattgccaccgggcttataaaaaaagctgtcacctgaaacagcatatccggtcccatactggagagaagccattcaagtgctctcagtgcggacgggggtttgtcagcgcaggcgtcctgaaggcacatatcaggacgcacacaggccttaagtcattcaaatgtctgatctgcaacggggcattcacgaccgggggctcgttgcgtcgtcacatgggtattcacaacgacctgcggccatacatgtgtccgtactgtcaaaagacatttaagacctccctgaactgcaaaaaacacatgaaaacgcacaggtacgaactggctcagcagctccaacagcatcagcaagctgccagtatagatgactctaccgtggatcagcagtccatgcaagcctccacacagatgcaggtggagatcgagtccgacgaactgcctcagacagccgaagtggtcgctgccaacccagaggccatgctggacttggaaccacagcatgtcgttggtacagaagaagccggcctgggacagcaactggccgaccagccccttgaggcagacgaagatgggtttgtggccccccaggatcccttgagaggccacgttgatcaatttgaagaacaatcccctgcacagcagtccttcgagcctgccgggctgccccagggcttcacggtgactgacacataccatcagcagcctcaattccctccagtgcaacaactccaagactcatctactctcgagagccaagcccttagcacttcttttcatcagcagagcctcttacaggcaccctcaagcgacgggatgaacgtcacgactcgccttatccaggaatcttctcaggaggagctcgatctgcaggctcaaggaagtcagttcctggaggataatgaagaccaaagcagacgcagctacaggtgtgattactgcaataagggcttcaaaaagagttcccatcttaaacagcacgtgcgatcgcacactggcgagaagccgtataagtgcaaattatgtgggcggggatttgtcagtagtggggtgctgaagagccatgaaaagacccatactggcgtgaaggctttctcctgtagtgtttgcaatgctagcttcacaacgaatggtagcctgacacggcatatggctactcatatgtccatgaaaccctataagtgccccttctgtgaagaagggtttcgcactacagtccactgtaagaaacatatgaaacgccatcagactgttccatcagctgtctcagccacaggggagaccgaagggggcgacatttgcatggaggaggaagaagaacactccgaccgaaatgcaagtcggaagagccggccagaggtcattacattcactgaagaggagacagcacagctggctaaaatcaggccacaggagtctgcaaccgtgtcggaaaaagtcctggtccagagtgctgccgagaaggataggattagcgagctgagagataaacaggctgagctacaggatgaacctaaacacgcgaactgctgcacttattgccctaagtcctttaaaaaaccctccgatctggttcgccacgtaaggatccatactggagagaagccctacaagtgtgatgagtgcggtaagtcgtttaccgtcaagtctaccctggactgtcatgtgaagactcacaccggtcaaaaactgtttagctgccacgtgtgctcgaatgccttctctaccaagggttcgcttaaggtgcacatgcgcctgcataccggagcaaaacccttcaagtgcccccactgtgaactaaggttccgtacatcaggaagacgtaagactcacatgcagtttcattacaaacccgatcccaagaaagcaaggaagcccatgacccggagctccagcgagggactgcagcctgttaatctgctgaattcttcgtcaactgatcccaatgtgttcatcatgaataacagcgttctgactggacagtttgaccagaacttgctgcagcctgggctcgtcggtcaggcgatactgcctgcctctgtgagcgccggcggtgacctgacagtgagtctgaccgatggatccctggctacattagaagggattcaacttcaactggcggctaacctagtgggacctaacgtgcagatctccggcatcgatgccgcctctatcaataacatcactctgcagatcgatccctcgattttgcaacagaccctgcagcaaggaaacctcctcgcccagcagttgaccggcgagccaggtctcgcaccacagaactcctccctgcaaacatcagacagcaccgtgcctgcgagtgttgtgattcagcccatctcaggcctttccttacagcctaccgtaacatccgcaaatttaaccattggaccactgagcgagcaggacagcgtacttactaccaactcctcgggaactcaggacttaacccaggtgatgacatcacaggggctggtgtcaccttccggcggccctcatgaaatcacgctcacaataaataactcctcactgtcacaagtattagcccaggccgccggtccaaccgccaccagttcaagcgggagtcctcaagagatcacattgaccattagcggttctcggagtgtgcaacacagcgtgggacctcaggaatgtgggtccgtagaagccctgtatctggagaattcgagcgataaaacttag

SEQ ID NO: 141258 - DNA, 1596 bp, Artificial Sequence
  Description of Artificial Sequence: Synthetic coding sequence
atgtgtcccaaggggtacgaggatagtatggaattcccagatcacagcagacacctattgcagtgcctctctgaacagagacaccagggattcctgtgcgactgtacagtgctggtcggagatgcccagtttcgggcacaccgtgccgtgctcgctagctgctccatgtatttccacctgttctacaaagaccagcttgataaaagggacattgtccatctcaacagtgatattgtgaccgccccggcctttgcacttctgcttgaattcatgtacgagggtaagctgcagttcaaggatctgccaatcgaagacgtattggctgcggcatcatacctgcacatgtacgatatcgtaaaggtgtgtaaaaagaaactcaaggaaaaggctacgactgaagccgatagcacgaagaaggaagaggatgccagcagctgctccgacaaagttgaatctctgtctgatgggtcaagccatattgccggcgaccttcctagtgacgaagatgagggcgaggatgagaagttaaacatcctccctagcaagcgcgacttagcagccgaaccggggaatatgtggatgcgacttccatctgattcagctggaattcctcaagcgggaggagaagccgaacctcacgccacggccgccggtaagacagtggcctcaccctgtagttcaaccgagtcccttagtcagagatctgtgacttcggttcgggacagcgccgatgtggactgcgtacttgacctgtccgtcaagtctagccttagcggcgtcgaaaaccttaactcttcgtactttagttcacaggatgtgctcaggagcaatctagtgcaggtcaaggtagagaaagaggcctcatgtgacgaaagcgacgtggggacaaacgactacgacatggagcattcaactgtgaaagaaagcgtttccactaacaacagggttcagtatgagcctgcacacttggcccccctgagagaagatagcgtgctccgggaactggacagagaagataaagcctctgacgacgaaatgatgacccccgaatccgagcgcgtccaggtggagggagggatggaatcttctttgttaccgtatgtgagcaacattctgagtccagcagggcagatcttcatgtgtccgctttgcaataaagtgttccctagccctcatatcctccaaatacacttaagcacacatttcagagagcaggatggtataagatctaagcctgccgctgacgtgaatgtccctacctgcagcctgtgcgggaagacgttcagctgtatgtatactttaaagagacacgagcgaactcactcaggcgaaaagccctacacctgtactcagtgcgggaaatcgttccaatactcccataacctttcgagacatgcggtggtgcacacacgggagaagcctcacgcgtgcaaatggtgtgagagaagattcacacagtcaggggatctatatcggcatattcgcaagtttcattgcgagctggtgaactccctaagtgtcaagtcagaggccctttctctgccaaccgtgcgggattggacgcttgaagattcatcacaggaactctggaagtag

SEQ ID NO: 141259 - DNA, 1464 bp, Artificial Sequence
  Description of Artificial Sequence: Synthetic coding sequence
atgtgcccaaaaggttacgaggattctatggaattccctgaccactcacgtcacctgctgcagtgtcttagcgaacaacggcaccaggggttcctgtgtgactgcactgtgctcgttggcgacgcacaatttagggctcacagagccgtcttagccagctgctcaatgtatttccatttgttttataaagatcaattagataaaagggacatcgtgcacctgaattctgacatagtaactgctcctgctttcgcattactcctggaattcatgtacgagggtaagctccagtttaaagatctgcctatcgaggatgtcctggctgccgcttcctacctgcacatgtacgacatcgtgaaggtgtgtaaaaaaaaattaaaggaaaaggctaccaccgaagccgattctacaaaaaaggaggaagacgcttcttcttgctcagacaaggtcgaatccctttcagatgggtcttcccacatcgccggagatctccccagcgatgaggacgagggcgaggacgagaagctcaacatactgccctctaagagggatctggcagcggaacctgggaacatgtggatgcggctccccagcgatagcgccggtatcccacaggccggtggagaggcggagccgcacgcaaccgccgccgggaaaacagtggcctcaccctgctctagtacagaatcgctatctcagcgctctgttacatctgtcagggattctgctgatgtagattgtgtgttggatttatctgtgaagtcatctctcagcggggtggagaatttgaacagcagttacttctcttcgcaagacgttctgaggagtaatcttgtgcaggttaaggttgagaaagaagcctcttgtgacgaatctgatgtcggaactaacgactatgacatggagcactcaacagtgaaagaatcggttagcaccaacaaccgcgtccagtacgaacccgcccacttagcccctctgagagaagactccgtactgagggagctcgaccgggaggataaagcctctgatgacgagatgatgacacccgaaagcgagcgcgtgcaggtggaaggcggcatggagagctccctgttgccgtacgtgagtaacatcctgtcaccagcgggccagatctttatgtgccccctgtgtaacaaggttttcccatccccacacatactgcaaattcatctgtcgacccacttcagggagcaagatggaattagaagtaagcccgccgccgacgtgaacgtgccaacctgttccctttgtggaaaaactttctcttgcatgtatacgctcaaacgacacgagcgcacccattccggggagaaaccttacacttgtactcaatgtgggaaatcctttcagtacagccataacctatcccgtctccaggtggtcagggctcaagtgcacgctgttcgtgggccagtccaaacgcactcccaggtgcccctttag

SEQ ID NO: 141260 - DNA, 1377 bp, Artificial Sequence
  Description of Artificial Sequence: Synthetic coding sequence
atggctagcacgatcacgggaagccaggactgtatcgtcaatcataggggggaggttgatggagagccagagcttgacatctcaccatgtcagcagtggggcgaggcctcctctccaatttcccgaaaccgagacagtgttatgacactgcagagcggatgtttcgagaatatcgaaagcgagacctacctccctcttaaggtatcatcacagatcgatacacaggattcctccgtgaaattctgtaaaaacgaacctcaggaccaccaggagtctcgccgtctgtttgtgatggaggagtctacagagcgtaaagttatcaagggggagtcgtgtagcgagaacctgcaggtgaaactcgtcagtgatggtcaggagctggcatcgccactgctcaacggcgaagccacatgtcagaatggacagctgaaggaatccctggaccccatagactgtaattgcaaggacatacacggatggaagagtcaggtagtgtcttgctctcaacagcgcgctcatactgaagagaaaccttgcgatcacaacaactgtggcaagatccttaacactagcccggatggacacccgtatgaaaaaattcataccgccgaaaaacagtacgagtgcagccagtgtgggaagaattttagtcagtcctctgagctcctgctgcaccagcgggatcataccgaggaaaaaccctacaagtgcgaacagtgtggaaagggcttcacaagatcgtcaagtctcttaatacatcaggccgtgcacaccgatgagaaaccatacaaatgtgataaatgtgggaagggatttacacggtcctccagcctacttattcaccacgctgttcatactggggagaagccatacaagtgcgataaatgtggcaaaggcttctcccagtcctccaagttgcatatccatcaacgggtgcatactggagagaagccttatgaatgcgaggaatgtgggatgtctttcagccagcgatctaaccttcacattcaccagagagtgcacaccggggagaggccatacaagtgtggggagtgcggcaaagggttctcccaaagttctaacttgcatatacataggtgtattcacaccggcgagaaaccatatcaatgctatgaatgtggcaaaggatttagtcagtcttctgacttgcgcatccacctgagagtacacaccggtgagaagccttaccattgtggtaagtgcgggaaggggttttcccagtcctcgaaactactgattcaccagcgcgtgcatacaggagagaaaccatacgaatgttccaagtgcggcaagggtttttcccaatccagcaatctgcacatccaccagagagtgcataagaaagacccccgctag

SEQ ID NO: 141261 - DNA, 1377 bp, Artificial Sequence
  Description of Artificial Sequence: Synthetic coding sequence
atggcctccacaatcaccgggtctcaagactgcattgtcaatcaccggggcgaagtggacggcgagcccgaattggacatttcgccgtgccaacagtggggtgaggcaagttctcccatctccaggaaccgcgacagcgtgatgactctacaatctggatgctttgagaacatcgaatcagaaacctacctgcccttaaaggtttcgtcccagattgacacccaagactcatcggtcaagttctgcaagaatgaaccccaggaccatcaggaaagtagacggctgttcgtgatggaagagtctacagagcggaaggtgattaaaggcgaatcatgttctgaaaatctgcaggtgaaattagtgtctgatggacaggagctggcttctcctctcctgaacggggaagcaacatgccagaatggacagctcaaggagagtctggacccgatcgactgtaactgtaaggacatccacgggtggaagtcccaagtggtgtcttgctcccagcaacgggcacacactgaggaaaaaccatgtgatcacaataattgcggtaagatcttaaacacttcccccgatggtcatccatatgagaaaatccatactgccgagaagcaatatgagtgttctcagtgtggaaaaaatttcagtcagagctctgaactgcttcttcaccaacgagatcacacagaggagaagccatataaatgcgagcagtgtggtaaaggatttacacggtcttcctcactcctgatccatcaggccgtgcatacggatgaaaagccctacaaatgtgataaatgcggcaagggcttcacccgctcatcatctctgctcatccatcatgccgtacacaccggggaaaaaccatacaagtgtgataagtgcgggaagggattcagtcagtcctctaagctgcatattcaccaacgagtgcataccggggagaagccctatgagtgcgaagaatgtggcatgtctttttcacagagatcaaacctacatatccaccagcgcgtccatacaggcgagagaccatataagtgcggggaatgcggaaagggcttttctcagtcctcgaacctgcacatccaccgctgcatccatacaggagagaagccataccaatgttacgagtgtggaaaagggtttagccaaagtagcgatttgagaattcatttacgcgtgcacactggggagaagccatatcattgcgggaaatgcgggaagggattctctcaaagctccaagcttctcatccatcagcgtgtgcacacaggggaaaagccgtacgagtgctcaaagtgcggcaaaggttttagtcagtcctccaacctccacatccatcagcgagtccacaagaaagatccccggtag

SEQ ID NO: 141262 - DNA, 1377 bp, Artificial Sequence
  Description of Artificial Sequence: Synthetic coding sequence
atggcctcaacgattacaggttcacaagactgcattgtaaatcaccgcggcgaggttgacggagagcccgagctggatataagtccatgtcagcagtggggcgaggcctcgagccccatctctcgaaacagggacagtgtcatgacactccaatcgggctgttttgaaaacatcgagtccgagacttacttgcccctgaaggtgagtagccagatcgacacccaggacagcagcgtgaagttctgtaaaaacgaaccacaggatcatcaggagtccagacggctgttcgttatggaggaaagtacagagagaaaggttataaagggagagtcctgctcagagaatttgcaggtcaagcttgtgtcggacggacaggagctggcctctcctcttttgaacggcgaagcgacatgccagaacggtcagcttaaggagtccctcgatcctatcgactgcaactgcaaagatatccacggatggaagagccaagtggtgtcctgttctcagcaacgggcgcatacagaggagaagccctgtgatcataataactgcgggaagattctgaatacatctcctgatgggcacccatacgagaaaattcacacagccgaaaaacaatatgagtgttcacaatgtgggaaaaacttttctcaatcctcggaactgctgttacaccagcgggaccatacagaggagaaaccttataagtgtgaacagtgcggcaaaggctttacaagatcctctagtctgctgattcatcaagccgtccataccgacgagaaaccctacaagtgtgataagtgcgggaagggcttcactcgatcatcttctctgctgatccaccacgcagtgcataccggggaaaagccctataagtgtgataaatgcgggaaaggtttttctcaatcgtccaagctgcacatacatcagcgcgtgcacacaggagagaaaccatatgagtgcgaggagtgtggcatgtctttttctcagagatctaacttgcatatacatcagagagtacataccggggaaaggccgtataagtgcggcgaatgcggcaagggcttctcacagtcctcaaacctgcacattcatcgctgcattcacacaggcgagaaaccgtatcagtgctatgagtgcgggaagggcttcagccagagctcagacttgcggatccatttgcgagtgcatacaggtgagaaaccttaccattgcgggaagtgtggaaagggatttagccagtcctccaaactactcatccaccagagagtccacacgggcgagaaaccgtacgaatgctctaaatgcggaaagggattcagccaatcatctaacctgcatattcatcagcgtgtccataagaaagatcccagatag

SEQ ID NO: 141263 - DNA, 1377 bp, Artificial Sequence
  Description of Artificial Sequence: Synthetic coding sequence
atggcaagcacaatcactggtagtcaggactgcattgtgaaccaccgcggagaagtggacggagagcctgaactcgacatatctccctgccagcagtggggagaggcctcttctcccataagtcggaaccgggactctgtgatgacccttcaaagcggatgctttgagaacatagaatccgagacatatctgcctttgaaggtcagttctcagatcgatacacaggatagttccgtgaaattctgtaaaaatgaacctcaggaccatcaagagtcaaggcgcttatttgtgatggaggagtcaacagaaagaaaggtgatcaaaggtgagagctgctccgagaacctgcaagtgaagctggtgagtgacggacaggaactcgctagtcctcttctgaacggcgaagcaacctgccaaaatggccagctcaaagaaagtctagaccctatcgactgtaactgcaaggacatccacggatggaaaagccaggtggtgagttgctctcagcagagggcccatacagaggagaagccttgcgatcataataattgcggaaaaatattaaatactagccctgacggacacccatatgagaaaattcatacagccgaaaagcaatatgaatgtagccaatgtggcaaaaacttcagccagagctctgagttgctgctccaccagcgcgaccacaccgaggaaaaaccctacaagtgcgaacagtgtggtaaaggttttacacgatcgagctccctcctcatccatcaggcggtccatacagacgagaagccctacaaatgcgataaatgtggaaagggttttacccgcagttccagccttttaattcaccacgctgtccacaccggagaaaaaccctataagtgcgataagtgtggcaagggtttttcacagagttctaagctccacatacaccagagagtgcacaccggagagaaaccatatgaatgcgaggagtgcgggatgagtttttcacaacggtctaacctgcacatccaccagagggtacacactggagagagaccctacaagtgcggggagtgtgggaaaggattttcacaatcaagtaatctccatatacacagatgcatccacaccggagagaaaccgtaccagtgctacgagtgcggcaaggggttctcacagtcaagcgacttacgtattcacctgcgggtgcataccggagagaagccttaccactgtggcaagtgtggtaagggattttcccagtcaagcaaactgttaatccatcagcgagtacacaccggagaaaaaccttacgagtgcagcaaatgcggaaaaggcttcagccagtcatccaatctacatatccatcagcgcgtgcacaagaaggacccaagatag

SEQ ID NO: 141264 - DNA, 1377 bp, Artificial Sequence
  Description of Artificial Sequence: Synthetic coding sequence
atggcttcgactatcaccgggtctcaggactgcatcgtgaatcataggggcgaagtcgatggagagccagaattggatataagcccttgccaacagtggggggaggccagcagtcccatctcccgaaatagggacagtgttatgaccttgcagtcggggtgtttcgagaacattgaaagcgaaacctatctccccctcaaggtcagcagccagattgatacccaggactcaagtgtgaaattctgcaaaaacgagcctcaagaccaccaggaatcccgacgactgttcgttatggaagaatcgaccgagagaaaggtgatcaagggagaatcctgcagcgaaaacctccaggtcaagctggtatcggacggacaagagctcgcctcccctcttctgaacggggaggctacatgtcaaaacggccagctgaaggagtcactggacccaatcgactgtaactgcaaggacattcacggctggaaatcccaagtcgtgagctgctctcagcaaagagcccacactgaggaaaagccgtgcgatcacaataactgcggtaagattctcaacacatcacccgacggccatccttacgaaaagatccacaccgctgagaagcagtacgaatgttcacagtgtggtaaaaatttcagccagtccagcgagttattactccatcagcgcgatcatactgaagagaaaccttataagtgtgaacagtgtggcaaggggttcacaagatcttcttcacttctcatccatcaggccgtgcatacagacgagaagccctacaagtgtgacaagtgcggcaaaggcttcacgcggagctccagcttgctgatccaccacgctgtgcataccggcgaaaagccatacaaatgtgacaagtgcggaaagggctttagccagtccagcaagctgcatatccaccaaagagtgcacaccggcgagaagccttatgagtgtgaggaatgcggcatgagcttctctcaacgcagtaatctgcacattcaccaaagggtgcacactggggagcgtccctataagtgcggcgagtgcggcaagggtttcagccaaagctccaaccttcatatccatcggtgtattcacactggcgaaaagccctaccaatgctatgagtgcgggaaaggattctctcagtcaagtgatctccgcatccatctcagagtccacactggggagaaaccttatcactgcgggaaatgcggcaaaggcttctcccagtctagcaaattgcttatacaccaaagggtccacaccggagagaagccgtacgagtgtagtaaatgcggtaagggatttagccaatccagcaacctgcacatccatcaaagagtccataagaaggatcccagatag

SEQ ID NO: 141265 - DNA, 1107 bp, Artificial Sequence
  Description of Artificial Sequence: Synthetic coding sequence
atgtctgcccaaagcgttgaggaagacagcatcttaatcatccctacccctgatgaagaagagaaaattctaagggttaagttagaagaggatccggacggcgaggaaggatcctccatcccctggaaccacctgcctgaccccgaaattttcagacaacgattcaggcagtttgggtaccaagactcccctggccccagagaagctgtatcacagctgcgcgagctgtgtagactttggcttagaccagagactcacactaaggagcagattctcgagctggtagtgctagaacagtttgtggccatcctgccaaaggagctgcagacctgggtgcgggatcatcatcccgagaatggagaagaggccgtaaccgtgctggaagatctggaatccgagctggacgacccgggccagcctgttagcctcagacgaagaaagagggaggtgctcgtggaagatatggtgagccaagaggaggctcagggtcttccatcttctgagctagacgctgttgaaaaccagttgaaatgggcctcctgggaactgcatagcctgagacactgcgacgatgacgggcgcaccgagaatggcgccctcgctcctaagcaggaactaccaagcgccctggaaagccatgaggtaccggggactctgaacatgggtgttccccaaatatttaagtacggagaaacatgctttcctaaaggtcgctttgagcggaaacgcaacccctcaagaaagaaacagcacatatgcgacgagtgtggtaaacacttctcccagggctccgctctcattctgcatcagaggattcacagcggtgaaaaaccttatggctgcgtggaatgtggtaaggcattctccagatcgagtatcttggttcagcaccagcgagtacacacaggcgaaaagccttacaagtgcctagagtgtggaaaggcattctcccagaactctgggctgattaatcaccagcggatccatacaggggaaaaaccgtacgagtgcgtgcagtgtgggaaatcctattctcaatcttccaatctgttccgccatcaaagacggcacaatgccgagaaactgctcaacgtggtaaaggtttag

SEQ ID NO: 141266 - DNA, 1107 bp, Artificial Sequence
  Description of Artificial Sequence: Synthetic coding sequence
atgtccgcgcagagcgtggaggaggatagcattctgatcataccaactcctgacgaagaggagaaaatcctgcgcgttaaactggaggaggaccccgacggtgaggagggatcctccatcccgtggaaccacctacccgaccccgagatctttcgccaacgtttcaggcagtttggttaccaggacagccccgggcctagagaggctgtgtctcagctgagggaactgtgtagactgtggctgcggccagagacccatactaaagaacagatcctggagctcgtggtactggaacagtttgttgccatcctcccgaaagagctgcagacatgggttagggaccaccaccctgaaaacggagaggaggcagtgacagtgttagaggacctggagagtgagcttgacgatcccggacagcccgtaagccttcggcggcgaaagcgcgaagtcttggttgaggacatggtgtcacaggaggaggcccaaggactgccaagctcagagctcgatgccgttgagaaccagctgaaatgggcttcttgggagctgcattcattacggcactgtgacgatgacggacgaaccgaaaatggtgctcttgcccctaaacaggagctcccgagcgcactggaaagccatgaggtgccaggcactctcaatatgggggtgccacagatattcaagtacggggagacctgctttcctaaaggcagattcgagcgcaaaagaaacccttctagaaagaagcaacacatctgcgacgagtgcggcaaacattttagccagggtagcgccttgatcctacatcagagaatacactccggggagaaaccatacggttgcgttgaatgtgggaaagccttctctcgcagcagcattttggtacagcatcagagggttcacactggagagaaaccttacaagtgtctggagtgtggcaaagccttttcacagaattcaggcctgatcaaccaccagagaatccacaccggggagaaaccctacgaatgtgtccagtgtggcaaaagttacagtcagtccagtaacctttttagacatcaacgtcgccacaatgccgaaaaactgctgaatgttgtgaaggtgtag

SEQ ID NO: 141267 - DNA, 1371 bp, Artificial Sequence
  Description of Artificial Sequence: Synthetic coding sequence
atgaataagtttcaaggtcccgttacacttaaggacgtcattgtggaatttacaaaagaagagtggaagctgttgacccccgcccagcggacactctacaaggatgtgatgctggaaaactattctcatcttgtttccgttggatatcatgtgaataagcctaacgcggtgttcaagctgaaacagggcaaggaaccgtggatcttagaggtggaattcccacatcgaggttttcctgaggatctttggagcattcacgacctagaggctagatatcaggaatctcaggccggaaattcacgcaacggggaactaaccaagcaccagaaaacacacacaaccgaaaaggcctgtgaatgcaaggaatgcggaaagtttttctgccagaagagtgcattaatagtgcaccagcatacccatagtaagggcaaatcctatgattgcgataaatgcgggaagtccttttcaaaaaacgaggatctgatccgtcaccagaagatccacaccagagacaaaacatatgaatgcaaagagtgtaaaaagattttctaccatctgagtagtttgtcacgacatttacggactcatgccggcgagaagccgtacgagtgcaaccagtgtgagaaaagcttctatcagaagccccatctgacggaacaccaaaagacgcataccggagaaaaaccttttgagtgcaccgaatgtggaaaattcttttacgtcaaggcctatctgatggtgcaccagaaaacccacaccggggagaaaccttacgagtgtaaggagtgcggcaaagctttttctcagaaatcacacctgaccgtccaccagcgcatgcatactggcgagaagccttataaatgcaaagaatgtggcaaattcttcagtaggaactcccatctgaagacccatcagcgatcgcatacaggcgaaaaaccctatgagtgcaaagaatgccgaaagtgcttctaccagaaatctgctcttacggtccaccaaagaacccatacaggcgagaagcctttcgaatgtaataaatgcggaaaaaccttttactacaagagcgacctgaccaaacaccaaaggaaacacacaggggagaagccctacgagtgtaccgagtgcggcaaaagctttgcggttaacagcgtgctacgcctccaccagagaactcacaccggcgaaaaaccatatgcctgcaaagagtgcgggaaatcgttcagccagaagtcgcacttcataatccaccagcgaaagcataccggggagaagccatacgagtgccaggaatgcggcgagacatttatccagaaatcccagcttacagctcaccagaaaacccacaccaaaaaaaggaacgccgagaagtag

SEQ ID NO: 141268 - DNA, 1263 bp, Artificial Sequence
  Description of Artificial Sequence: Synthetic coding sequence
atgctggagaattatagccatttagtttccgtgggctatcatgttaataagccaaacgcagtgttcaagctcaaacagggaaaggagccatggatcctggaagtcgagttccctcaccgaggatttcccgaagatctgtggtccatccatgacttggaggcacgctaccaggaatcacaggctgggaatagccgcaacggtgaactgacaaaacaccagaaaacacacaccaccgaaaaggcctgcgaatgtaaggagtgcggcaaattcttttgtcaaaaatcagctttaatagtgcaccagcacacgcattctaagggcaaaagttatgactgtgacaagtgcggaaaaagctttagtaagaatgaagatctaattaggcaccagaagatccacacccgggacaagacttacgagtgcaaagagtgtaagaaaatattttaccatctgagcagcctttcgcgtcatttgcggactcatgcgggggagaaaccgtatgagtgtaaccagtgtgagaagagtttttatcagaagccacacctcacagaacaccagaaaacgcatacgggggaaaaacccttcgaatgtacagagtgtggcaagtttttttatgtcaaggcctatctaatggtgcatcagaagactcacacaggcgaaaaaccatatgaatgcaaggagtgcggtaaggctttctcacagaagtcccatctgacagttcaccagagaatgcacaccggcgagaagccctacaagtgcaaggagtgcggtaagttcttctctcgcaatagtcacctaaagacacaccagagatctcacaccggggagaaaccatatgagtgcaaggagtgtaggaaatgtttctaccagaagtctgccttgactgtgcaccaaagaacccatacgggagagaaacccttcgaatgtaacaaatgtggaaaaacattctattataaaagcgatctgactaagcaccagcgcaaacacacaggtgagaagccttatgaatgtactgaatgcggcaagtcattcgccgttaattcagtgcttcggctgcaccaacggacacacacaggcgaaaaaccctatgcatgcaaggaatgcgggaaatcattcagccaaaagagtcactttatcatccaccagagaaagcacaccggcgaaaaaccatacgaatgtcaggagtgcggagaaacctttattcaaaagtctcaactgacagcccaccaaaagacccataccaaaaagcgtaacgcagagaaatag

SEQ ID NO: 141269 - DNA, 1500 bp, Artificial Sequence
  Description of Artificial Sequence: Synthetic coding sequence
atggggcctcttcaattcagagacgtcgctattgaattctcactggaagagtggcattgtctggacactgcacagcgcaacctgtaccgcgacgtgatgctggagaactatagaaacctggtcttccttggaatcgttgtaagcaaacccgatctggtgacatgtttggagcaggggaagaaacccctcaccatggagcgtcacgagatgatcgccaagccaccggtcatgtccagccacttcgcccaagatttgtggccggaaaacatacagaacagctttcagattggcatgctgcggcggtatgaggagtgccgccatgataaccttcagctgaagaagggctgtaagtctgtaggagagcacaaagtgcacaagggaggttacaatggtcttaaccaatgcttgactaccacccagaaagagatcttccaatgcgacaagtacggcaaggtgtttcacaagtttagcaattcaaacacctataagacaaggcatacaggtattaacttgtttaaatgcatcatatgtggaaaggcgttcaagagaagttccaccttgactacccataaaaagatccacaccggcgagaagccctacaggtgcgaggaatgtggaaaagccttcaaccagtccgctaatctgactactcacaagcgaattcacactggagaaaagccgtatagatgtgaggagtgtgggaaggccttcaaacaaagttctaacctgactacgcacaagaagatccacactggagagaaaccctacaaatgtgaggaatgtggaaaagctttcaatagatcaaccgacctcacaacacataaaatagtgcacaccggcgaaaaaccttataagtgtgaggagtgcggcaaggctttcaagcatccaagtcacgtgaccacccacaaaaaaatccacacaagggggaagccttacaattgtgaagaatgcggtaaatccttcaaacactgctcaaaccttaccatccataaacgaatccacacgggagaaaaaccttacaagtgcgaggaatgcgggaaagccttccatctgtcctcacatctgaccactcataaaatcctccacacaggggaaaaaccctatcgctgcagggaatgtgggaaggccttcaatcatagcaccactctgttctcccacgaaaaaatccacacaggcgagaagccgtataagtgcgacgagtgtggcaagacttttacatggccaagtattctgagcaagcataaaagaactcatacaggcgaaaaaccctacaagtgtgaagagtgcggaaagtcttttaccgccagtagcacactaacgacacacaagcgcatacacactggagagaagccttataaatgtgaagagtgcggaaaagcattcaattggtcctcagacctaaataaacataaaaagattcacatcgagcggaagccttacattgtaaaaaacgttacagacctactgaatgtcccaccactgcttatctcaatccgctag

SEQ ID NO: 141270 - DNA, 1500 bp, Artificial Sequence
  Description of Artificial Sequence: Synthetic coding sequence
atgggtccgttgcagttccgggacgtagccatagagttttctctggaagaatggcattgtctggacacggctcagaggaacctgtacagagacgtgatgctggaaaattaccgaaatctcgtcttcctcggaatcgtggtcagcaagcctgatttagttacttgcctagaacaaggcaagaagcctctaaccatggagaggcacgagatgattgccaaaccacctgttatgtcaagccacttcgcacaggatctctggcctgaaaacattcagaacagcttccagatcgggatgttgagacggtacgaggagtgtcgtcacgacaacctgcagctcaagaagggatgtaagtccgtcggtgagcacaaggtgcacaagggcgggtacaatggcctcaatcagtgtctgaccaccacccagaaggaaattttccagtgtgacaagtacggcaaggtgtttcacaaattctcaaatagtaatacctataagacaagacacacagggataaacctgttcaagtgcattatatgtggtaaggcctttaaaagatcaagtaccctgacaacgcacaaaaagattcatacaggagagaaaccctaccggtgtgaggaatgtggcaaagccttcaaccagtccgccaacctcacaacccacaaaaggattcatactggagagaagccatataggtgtgaggagtgcggcaaggccttcaaacagagctccaacctgactacccacaagaagattcatactggtgagaaaccgtacaaatgcgaggaatgcggtaaggccttcaacaggtccactgacctgacaacccacaagatcgtgcacacgggggagaagccatacaaatgcgaagaatgtggcaaggccttcaagcatccttcccatgttactacccacaaaaaaatccatactagggggaagccctataactgcgaggagtgcgggaagagctttaaacattgtagcaacctcactatccataaacggatccataccggcgagaagccatacaagtgcgaggagtgcgggaaggcctttcatctctcgtctcatctgaccactcataagatattgcataccggggagaagccttatagatgtcgggaatgcggtaaggccttcaaccattcgaccaccctgttttctcacgagaagatacacacgggagaaaagccatataagtgcgatgagtgcggtaagacctttacgtggccaagtatcctgtccaaacacaagaggacacacacaggcgagaaaccgtataagtgtgaggagtgtggaaaatccttcactgctagctctaccctcaccacacacaagcgaatccacactggagagaagccttataagtgtgaagaatgtgggaaggcctttaattggtcctccgacttaaataagcataaaaaaatccacattgaacgcaaaccatacattgtgaagaacgtcacagatctactgaatgtgcctcctctactgatctcaattcgctag

SEQ ID NO: 141271 - DNA, 276 bp, Artificial Sequence
  Description of Artificial Sequence: Synthetic coding sequence
atgccaggaccccctcgctccctcgagatggggctgctcacctttcgagatgttgcgatcgaatttagtttggaagagtggcagcacctcgacattgcccaacagaatctttatagaaacgtcatgctggaaaactatagaaatttagctttccttggcatcgccgtgtccaagccggatctgattacctgtttggaacagggtaaggagccttggaatatgaaaagacacgaaatggtggatgaacccccagggctggacttttcattgctgtag

SEQ ID NO: 141272 - DNA, 1725 bp, Artificial Sequence
  Description of Artificial Sequence: Synthetic coding sequence
atgtgccctcatttcgcccaggacctgtggcccgagcagggcatggaagacagctttcagaaagccatcttacgtaggtacggtaaatacggtcacgagaacctacagctgcgcaagggatgtaaatcagtggacgaatataaggtcaataaggaaggctataacggactcaaccaatgcttcaccacagctcagtcaaaggtgttccagtgtgacaagtaccttaaagttttttacaagttcctgaacagcaaccggccaaaaatccggcacactgagaagaagagcttcaagtgcaaaaaaagggtgaagctgttttgtatgctaagtcataagacacagcacaagtctatctaccacagagaaaaatcttacaaatgtaaggaatgtggcaagacattcaactggtcatccaccttgacaaatcaccgtaaaatttacaccgaggagaagccatataagtgcgaggaatacaataaatctccaaaacaattgagcaccctgaccacccatgaaatcattcacgctggcgagaagctatacaaatgcgaggaatgcggggaagcgttcaacaggtccagtaacctgacgactcacaagatcatccacactggtgagaaaccctataagtgtgaggagtgcggtaaggcattcatctggtcctctaccttaactgaacacaagaagattcacacacgcaagaaaccatacaagtgtgaagagtgtggaaaggcatttatttggtcatccaccctaacgaggcacaaaaggatgcatactggtgagaagccttacaagtgtgaggagtgtggtaaggccttttctcagagctcgactttgacgacccacaagattattcatacgggcgagaaaaggtataagtgtctcgagtgtgggaaagcttttaaacagctcagtacacttactactcataaaatcattcacgtgggggagaagctgtataagtgcgaggaatgcgggaaagggttcaaccgcagtagcaatctcacaacccataaaatcattcatactggagagaaaccttacaagtgcgaggaatgcggcaaggcattcatctggtcctccacacttaccaaacacaagaggattcacacaagggagaagccttacaaatgtgaagaatgcgggaaggcttttatctggagctctacgctgactcgtcacaagcgcatgcacactggtgagaagccctacaaatgtgaagaatgtggcaagtcatttagccaaagcagcacattgaccacccataagataatccacacaggcgagaaaccttacaaatgcgaagagtgcggcaaagctttcaattggagcagcaccctgactaagcacaagattattcacactgaagagaagccctataagtgcgaaaagtgcgggaaggccttcaagcagagctccatcctgacgaaccacaagcgcatccataccggggagaaaccgtataaatgcgaggagtgtggcaaaagttttaatcggtcctctacctttactaagcacaaagtcatccacactggcgtgaaaccatataagtgcgaggaatgtggcaaagccttcttttggagtagtacccttaccaaacacaaacgtatccataccggtgagcaaccatataaatgggaaaagtttgggaaggcgtttaatagatctagccatcttacaacggataaaatcacccactggcgtgaaattttgcaggtgtag

SEQ ID NO: 141273 - DNA, 1980 bp, Artificial Sequence
  Description of Artificial Sequence: Synthetic coding sequence
atgccaggtcctcctagatccctggagatgggcctgttaacatttcgggacgtggcgatcgaattctctctggaggagtggcagcatctcgatatcgcacagcagaatttatacagaaatgtcatgctcgaaaattatagaaatctggcttttttgggtatagctgtctccaaacccgacttgatcacatgccttgaacaaggcaaggagccctggaacatgaagcggcatgagatggtagacgaacctcccggaatgtgtccacacttcgcacaggacctgtggcctgagcaggggatggaggattccttccagaaagcaatcttgcgccggtacggcaagtacggacacgagaaccttcagttacgtaagggatgtaagagcgtggacgaatacaaggtgaataaggagggctacaacggcttaaatcagtgctttacaactgcccaatctaaagtgtttcaatgtgataagtatcttaaagtgttctacaagtttcttaattccaaccgtccaaagatccggcataccgagaaaaagagtttcaagtgcaaaaaacgggtgaagcttttctgcatgctgagccacaagacacaacacaaatctatctatcacagagaaaaaagttataaatgcaaggaatgcgggaaaacctttaactggagctctaccctgaccaatcacagaaagatctacactgaggaaaaaccttataaatgtgaggaatacaataagtctcccaaacagctctcgacgcttacaacacatgaaatcattcacgccggtgaaaagctctataaatgcgaagagtgtggcgaggccttcaatagatcgtcgaacctgacaacccacaagataattcatactggcgaaaagccctacaagtgcgaggagtgcgggaaagccttcatctggtcctccaccctgactgaacataagaagatccataccagaaaaaagccctacaaatgtgaggagtgcggcaaggctttcatctggtcatcgactctgacccggcataaacgcatgcataccggggagaagccttataaatgcgaggaatgtggtaaggccttcagccagtcttccaccttgacaacacacaagatcattcacacaggtgagaagcgttacaaatgtctggagtgcggcaaagctttcaaacaactgagcactctgacaactcacaagatcatacacgtcggcgaaaagctgtataagtgcgaagagtgtggaaaagggttcaacagatcctctaatctaacaactcataagatcattcacactggagagaagccgtataagtgtgaagaatgtggaaaagctttcatctggtctagtaccctgacaaaacataaacgaattcatacacgagagaagccatataagtgcgaagaatgcggcaaggcctttatttggtcatctaccctaactcggcataaacgcatgcacacgggcgaaaaaccctacaagtgtgaggagtgtggaaagagtttcagccagagcagcaccctcactactcacaagattatccacacaggcgaaaagccctataagtgtgaagagtgtggcaaggcttttaactggagctctacactgacaaaacataagattatccataccgaggagaagccttataaatgcgagaaatgtggtaaggccttcaagcaatcttcaattctgactaaccacaaacgaattcacacaggggaaaagccgtataagtgcgaggaatgtggtaagtcattcaaccggtcatccaccttcactaagcacaaggtgatccatacaggcgtgaagccctataaatgtgaagagtgcggaaaagccttcttctggtcgtccaccctcactaaacataagagaatccacacgggtgagcagccatataaatgggaaaagttcggaaaggctttcaatcggtccagccacctaacgacagataaaatcacacactggcgtgagattctgcaggtgtag

SEQ ID NO: 141274 - DNA, 1056 bp, Artificial Sequence
  Description of Artificial Sequence: Synthetic coding sequence
atgcccgggccaccgcggtctctcgaaatggggctgttaacgtttagagatgtcgccatagaattcagcctcgaagagtggcagcacctggatattgctcaacaaaatctctatcgtaacgtcatgctggagaactataggaacttggccttcctcggcattgccgtgagtaagcccgacttaattacctgccttgagcagggaaaggaaccctggaatatgaagcggcatgaaatggtggacgagccacccgggatgtgtccacatttcgcacaagacctctggcctgaacaggggatggaggattcatttcagaaggccattttaagaagatatggcaagtatgggcatgagaatctgcagttaaggaaaggttgcaaaagcgtggacgagtacaaagtgaacaaggaggggtataacggactcaatcagtgttttactaccgcgcagagtaaggtatttcaatgtgacaagtatctaaaggtgttctataaattcctgaatagcaatagaccaaagatacggcacaccgagaagaagtcttttaagtgcaagaagcgcgtcaagttgttttgcatgctgtcacacaaaacccaacataagagcatctaccatcgtgaaaagtcttataaatgcaaggagtgcggtaaaacatttaattggtcctctactctgaccaaccacagaaaaatctacaccgaggagaaaccatataaatgtgaagagtacaataaaagtcccaaacagctgtccacactcacaacccacgaaataatccacgccggtgagaaactctacaaatgtgaggagtgcggtgaagccttcaataggtcctctaccttcactaagcacaaggtgatccacactggcgtcaagccatacaaatgcgaagaatgcggcaaggcttttttttggagttcaactctcaccaaacataagaggatccacactggagaacagccctataagtgggagaagtttggcaaggccttcaatagatcatcacacctgacaacggataagattacacattggcgagaaatcttgcaggtttag

SEQ ID NO: 141275 - DNA, 1884 bp, Artificial Sequence
  Description of Artificial Sequence: Synthetic coding sequence
atggccgccgccgagctaaccgcacccgcccagggtatcgtgactttcgaggatgtcgctgtttatttctcctggaaagagtggggcttgctggatgaggcccagaagtgcctgtaccacgatgtgatgctggaaaacctgacgctgactacttccctcggtggctctggtgccggcgatgaggaggccccctaccaacagtctacaagccctcaaagagtgtcacaggtacggatccctaaagccttgccaagcccgcagaaaacgaatccttgtgaaatctgtggccccgtgttgagacagatccttcaccttgtggagcaccaaggcacgcatcacgggcaaaaattatacaccgatggcgcttgtaggaagcagctgcagtttaccgcatacctccaccagcaccaaaaacagcatgttggacagaaacactttagatctaacggggggagggatatgttcctcagctcttgtacattcgaggttagcggtaagccattcacatgtaaggaggtaggtaaggatttccttgtgaggtcacgctttctgcagcagcaagcagcacacaccaggaaaaagtcaaataggacgaagtcggctgtggccttccactccgttaagaaccactataactggggtgaatgtgtgaaagcgttttcatataagcatgtgcgggtgcagcatcagggggacctcatcagggagaggtcttacatgtgctccgagtgcggaaaatctttttcaacctcgtgctctctgagcgaccatctgagggtgcacacatctgaaaagccctacacatgtggggagtgtggaaagtcttatagacagagcagctcgctgattacacatcgcaggattcacaccggggtaagacctcatcagtgtgacgagtgtggaaagctgtttaacaggaaatatgacctgctaatccatcagcgcgtccatacaggggagcgtccctataaatgtagcgaatgcgggaaaagctttagccactcttctagccttattactcaccagagaatacataccggcatgagaccttatgaatgctcggagtgcggtaaaagctttattcactcgtcttccttgattacacaccagcgggtccatactggcacccgtccatatatgtgttctgagtgtggtaagtcattctcgcagtcttgccatctgattaagcaccgcagactccacataggtgagggaccttatgagtgtagcgaatgtggcaagctatttacgtatagatcacgattctttcaacatcaacgggtccatacaggcgtcaggagtcacgagtgtcatgaatgcggaaaactgttctctagaaagttcgatttaatcgtccatgaaagagtccacaccggggagcggccgtacgaatgttctgaatgtggcaaatcgtttacctgcaagtcatatctcatctcccactggaaagtacacaccggggcccgtccctacgagtgtggcgagtgtggcaagtccttcactcactcttccacgctcttacaacaccagcgggtccacactggcgaacggccatacgagtgtaacgagtgtggaaagtttttttcccaatccagtagcctgatccggcatcgacgcagccataccggagagaggccgtatgaatgtagtgagtgttggaagtccttcagcaatcactctagcctggtgaaacacaggagagtccacaccggtgaacggccatacgaatgtagcgagtgcggcaaatcctttagccagtcaagtaatctgactaatcaccagcggatccacagcggtgagcgcccttacgaatgtagcgattgcggtaagtttttcacattcaatagcaacctcctgaagcaccagaatgtgcacaagggctag

SEQ ID NO: 141276 - DNA, 1608 bp, Artificial Sequence
  Description of Artificial Sequence: Synthetic coding sequence
atgggccccctcaccattcgcgatgtcactgtggagttttctttagaagagtggcattgtctggatactgcgcaacagaatttatacagagatgtgatgttagagaactaccgaaatttggtgtttctcgggatcgccgtatccaaacctgatttaattacctgcttggagcaggggaaagaaccctgtaatatgaaacgtcacgagatggtggccaagcctccagtgatgtgttcacacatcgcagaagatttgtgtcctgagcgggacattaaatacttttttcagaaagtcatcctgcggcgctatgataaatgcgagcatgaaaacttgcagctgagaaagggctgtaagtccgtggacgaatgcaaagtctgcaagggaggatataatgggctgaatcagtgccttattacaacacagtccaaaatgtaccagtgcgataaatacgttaaagtcttctacaaattcagcaacagtgacaggcataaaataagacataccgaaaaaaagacctgcaagtgcaaggagtgcggaaaggctttcaaccagtctagcgcgctgactcgccacaagatgacgcatacgggcgagaaaccttataaatgcgaagaatgtgggaaagcattcaataggtcatcccacctaactcagcacaaggtgatccacacacgagaaaagccctataagtgtgaggagtgcgggaaagccttcaaccgcagttcacatataactcagcacaagagaatacacaatcgggagaaacccttcaagtatgatgagtgctgcaaagcattcaaatggtccagtgctcttactacactgactcaacataagcggattcacacgggagaaaagccatataaatgtgaggaatgcggcaaggctttcaaccaaagcagcgcccttaccaggcataagatgattcacacaggagagaaaccattccagtgtgaagagtgtgggaaggcctttaatagatcatctcatttaacccagcacaagatcatacacactaaggagaagccgtacaaatgcgaagagtgtggaaaagcctttaacaggtcctcccacctaactaagcacaaacggatccacacacgtgagaaggcatacaagtgtgacgagtattgcaaagcatttaattggagtagcgccctgaccaccctgacccaacacaagataatccatacgggggaaaaaccctacaaatgtgaagaatgtggtaaagccttcaaccgtagctcctaccttattaggcacaaaattatccatacaggggagaagccgtataaatgcgaagaatgcgggaaggcctttaaccagtcctctcatttgacgcagcacaaaataattcacacaggcgagaagccttacaaatgcgaggagtgcgggaaggcgtttaacaggagcagccatctcagccagcacaagattatccacaccggcgaaaaaccttataagtgtgaagagtgtggaaagccattcaaccggttctcttatctcactgtacacaagcgcattcacgcaggcgaaaaccccaataaatatgaggagtgtggaaaggcatgtaatcactcatctaacctgacgaaacacaattcatag

SEQ ID NO: 141277 - DNA, 1692 bp, Artificial Sequence
  Description of Artificial Sequence: Synthetic coding sequence
atgggtccactcactatcagggatgttacagttgaattctctctcgaggaatggcactgcctagataccgctcagcagaacctgtatcgggatgtcatgctggagaattaccgcaacctcgtctttctcgggattgccgttagcaaacctgacctgatcacatgtttagaacagggcaaggagccttgcaatatgaaaaggcatgagatggtggctaaaccccctgttatgtgttcccatattgcagaggacttgtgccccgaacgcgacattaagtactttttccaaaaggtgattttgaggagatacgacaaatgtgagcacgagaacctgcagttaagaaaggggtgtaagtcggtggacgaatgcaaagtgtgtaaggggggctacaatggtctgaaccagtgccttatcactacgcagtctaagatgtaccagtgcgataaatatgtgaaggtgttctacaaattcagcaatagtgatcgccacaaaatacggcacaccgaaaagaagacttgcaaatgcaaggagtgcggcaaatcattctgtatgttgagtcagcttacacgccataagaggatccatatcagggagaacagtcacaagtgtgaggagtgtggcaaggcctttaaccaaagttctgccctcacgcggcacaaaatgacccacaccggagaaaaaccatacaagtgtgaagaatgtggaaaggccttcaaccggtcttcgcacctgacccagcacaaggtcatccatacaagggaaaaaccttacaaatgtgaagagtgtggaaaggcctttaaccgttcaagccatataacgcaacacaaacggatccacaacagagagaaaccctttaaatacgatgaatgctgcaaagcctttaagtggtcctcagccctcaccaccctgacccagcataagagaattcatacaggagagaagccttacaaatgtgaagagtgcggaaaggcgtttaatcaatcctctgccttgaccaggcataaaatgatccataccggtgagaaaccattccagtgtgaggagtgtgggaaagccttcaacaggagcagtcatctcacgcagcataagattatccatactaaggaaaagccttacaagtgtgaagagtgtggcaaggcctttaataggtcttctcacctgactaaacataagaggatccacacaagggaaaaagcttataaatgtgacgagtactgcaaggcttttaattggtctagcgccctaacaacgttaactcaacacaagataatccacacaggggagaagccctataagtgcgaggaatgcggcaaggctttcaataggagttcctacttaatccgtcacaaaattattcacacaggtgagaagccttataagtgtgaggagtgtggtaaagcttttaatcaaagctcccatttaacccagcacaaaattatccacacaggggagaagccttacaaatgtgaggagtgtggcaaagcattcaatcggtcctcccacctgagccagcacaagattatccatactggagagaagccttacaaatgtgaggagtgtggaaagccttttaaccgattttcttacctgaccgttcacaagcgcatacacgcgggagaaaaccctaataaatatgaagagtgcggcaaagcatgcaatcacagcagtaacctcactaaacacaacagctag

SEQ ID NO: 141278 - DNA, 1692 bp, Artificial Sequence
  Description of Artificial Sequence: Synthetic coding sequence
atggggcctttgactattcgagatgtcactgtggagtttagtttggaggagtggcattgcttggataccgcccagcaaaacctgtacagagacgtcatgcttgaaaactatagaaacctggtgttcctgggcattgccgtgagcaagcccgacctgatcacttgcctggaacagggcaaggagccctgcaatatgaagaggcatgaaatggtggcaaaacctcccgtgatgtgcagccacatcgcagaagacctctgccccgagagggatatcaaatacttcttccagaaagtaatactgcgacggtacgacaagtgtgagcatgagaatctacagctcagaaaaggatgtaaatccgtggatgaatgtaaagtgtgcaagggcggttacaatggcttgaatcagtgtcttataacgactcaaagcaagatgtatcagtgcgacaaatacgttaaagtgttctacaagttctccaattcggacaggcacaagatccgtcacaccgagaagaagacctgcaaatgcaaggaatgcggaaaatccttctgtatgctgtcccagttaacccgccataagcgtattcacatcagagagaattctcacaagtgcgaggagtgcgggaaggcctttaatcagagctccgcgctgacccggcacaaaatgacccatactggtgagaagccttacaagtgtgaggagtgcgggaaggcattcaatcgctctagccatttgacgcagcacaaggtaattcatacacgtgagaaaccctacaaatgcgaagaatgcgggaaagctttcaaccgcagctcgcatattactcagcacaagaggatccacaaccgggagaagccgtttaaatatgacgaatgctgtaaagcttttaaatggagctctgccctcactaccttaacgcagcacaaacggatccatactggcgaaaagccttataagtgcgaggaatgcggtaaggcctttaatcaaagttctgcactgacccgccataaaatgatccataccggcgaaaagcccttccagtgcgaggagtgtggtaaggctttcaatcgctccagtcatttgacccagcacaagattattcacacaaaggagaagccttataagtgtgaagagtgcgggaaggctttcaataggtcatcccatctcacaaaacacaagcgaatccataccagagagaaagcctataagtgcgacgagtattgtaaagccttcaactggagctccgctttgaccacactgactcagcacaaaattattcacaccggagaaaaaccttataagtgcgaagaatgtggcaaggcttttaatagaagctcatatctcattaggcacaagatcatccataccggagagaagccttacaagtgtgaggagtgcggcaaagctttcaaccaatccagtcatctcacacagcataagattatacataccggggaaaaaccatacaagtgtgaggagtgcgggaaagcatttaatcgcagcagccatcttagccagcacaagatcattcataccggcgaaaagccttacaaatgtgaggaatgtggtaaaccattcaataggttctcttacctgactgttcacaagcgcatacatgcaggcgaaaaccctaacaaatacgaggaatgtgggaaagcatgcaatcacagctcaaatctcacaaagcacaacagttag

SEQ ID NO: 141279 - DNA, 1602 bp, Artificial Sequence
  Description of Artificial Sequence: Synthetic coding sequence
atggcgacatcctttcgcacagcaagctgctggggccttctgagttttaaagacatttcaatggaatttacatgggacgagtggcagctcctggactctacccagaaatatctgtacagagatgtgatactggaaaattatcataacctaataagcgtgggctaccacgggacgaagcctgacctgatctttaaactggagcagggagaagatccttggataatcaacgcaaagatcagtaggcagagctgtcctgatggatgggaggagtggtaccagaacaaccaggacgaactagaatcaattgagcggtcttatgcctgctccgtacttgggcgactaaaccttagcaaaactcatgatagcagccggcaacggctctataatacacgcgggaagtcactgacacagaattcggccccaagccgatcgtatctcaggaagaatcccgataaatttcacggttacgaagagccttacttcctgaaacatcaaagggcccacagtatcgagaaaaattgcgtgtgctcagaatgtggcaaagcttttaggtgcaaaagccagctcatcgttcacctaaggattcacacgggtgaacgcccatatgagtgctctaaatgcgagcgtgctttttcggcaaaaagcaacttgaacgcccaccagcgggtacacactggcgagaagccttattcatgttccgaatgcgagaaggtcttttcttttagatcgcagctcatcgttcaccaggagatacacacaggtggtaaaccatatggttgttcagagtgcggcaaggcttatagttggaagtctcagttattattacaccaacgcagtcatactggagtcaaaccctacgagtgcagcgagtgtggcaaagctttctcacttaagagcccattcgtcgtgcatcagcggacccataccggagttaagccccacaaatgcagtgagtgtggaaaggccttccggtcgaagtcttatttgcttgttcacataaggatgcacactggggagaaaccctaccagtgttcggactgtggtaaggcattcaatatgaaaacacagctgatcgtgcaccagggtgttcacaccggaaataacccttatcagtgcggagagtgtggcaaggcgttcggccgcaaagagcagctgactgcacacctacgggcccacgcgggcgaaaagccatacggttgtagtgagtgcgggaaagcttttagtagcaagtcttacctcgtcatccaccggcggacccacacgggagaaaggccatatgaatgttctttatgtgagcgagccttctgcggcaagagtcagcttatcatccatcagcggacacattcgactgagaaaccttatgagtgtaatgagtgcgaaaaagcataccctcggaaagcatctctccagattcaccagaaaacccactcaggagaaaagccattcaagtgttccgagtgcggcaaggcattcacacagaagagctctttatcggaacaccagcgtgtccacacaggcgagaagccctggaagtgttccgagtgcggaaaatcgttctgctggaactccgggttgaggattcatcgcaaaacacacaagtag

SEQ ID NO: 141280 - DNA, 1542 bp, Artificial Sequence
  Description of Artificial Sequence: Synthetic coding sequence
atggagtttacctgggatgaatggcaactgcttgatagtacccagaaatatttgtacagggacgtgattctggaaaactaccataatctcatatctgttgggtaccacggaaccaagccagatctcatattcaaattagaacagggcgaagatccctggattattaatgccaagatatcacgtcagtcatgtccagatgggtgggaagaatggtaccaaaataaccaggacgagctggagtccatcgaacgctcatatgcatgtagcgtattaggaagactgaacctgagcaagactcacgatagctcgagacaaaggctgtacaatacccgggggaagagtcttactcagaattccgcaccgagtcggagctacctacgaaaaaatcccgataaattccatggttacgaggaaccgtacttcctgaaacaccaacgtgcccactccattgagaaaaattgtgtgtgctctgaatgtggcaaagcctttcggtgtaagtctcaattgatagtccatctgagaatacacaccggcgagcgaccctacgaatgctccaagtgtgaaagagcattttctgctaaaagcaatctcaatgcccatcagcgtgtgcacacaggtgaaaagccctactcctgttccgagtgtgagaaagtgttctcattccgatcgcagttgattgttcatcaagaaatccatacaggaggtaaaccctacgggtgctctgagtgtggcaaggcttacagctggaagtcccaattgttactccaccagcgctcccacactggagtgaaaccatacgaatgcagcgagtgtggcaaggcgttttctctaaaaagtcctttcgttgtccaccaaagaacacatactggcgtaaagccgcataaatgtagcgaatgcggcaaggccttccgcagcaagtcttatttgctcgtacatattcggatgcatacaggcgagaagccctatcagtgctccgattgcggaaaggcgttcaatatgaagactcagctgatagttcatcagggagtgcacactggcaacaacccttaccagtgtggcgagtgtggcaaggcgttcggtcgcaaagaacagttgacagctcatctgcgagctcatgctggtgagaaaccctacggatgcagcgaatgtggaaaggcttttagttccaagagctatctagtcattcatagacgcacacacactggagagagaccctacgagtgttctctttgtgaaagagccttttgcgggaaatcccagctgattatccaccagaggacccatagcaccgagaaaccctacgaatgcaatgaatgcgaaaaagcctatcctagaaaagcttctcttcaaatccatcagaagacacacagtggagaaaagcccttcaaatgcagtgagtgtggaaaggctttcacacaaaaaagctcattaagtgaacaccagagggtgcacacaggagaaaagccctggaagtgcagcgaatgcggcaagagcttctgctggaactccgggttaaggatacatcgaaagacgcacaaatag

SEQ ID NO: 141281 - DNA, 1239 bp, Artificial Sequence
  Description of Artificial Sequence: Synthetic coding sequence
atgatcgggatgctggagtccctgcagcatgaatcagatctcctccagcatgatcagatccacactggcgagaagccttacgaatgtaatgagtgccgcaaaactttttccctgaaacaaaatctagtcgaacacaaaaaaatgcacacaggtgaaaagagccatgaatgtactgaatgcggcaaggtgtgtagtcgtgttagctccttgaccttacatctgcgttcccatactgggaaaaaggcttataaatgtaataaatgcggtaaagcattctcgcagaaggagaattttcttagccaccagaagcaccacactggtgagaaaccatacgagtgtgagaaggtatcgatccagatgcccacaatcatcagacaccaaaaaaatcacactggcacaaagccctatgcctgtaaggaatgtggaaaagcctttaatgggaaggcttacttaaccgagcatgagaaaattcataccggcgagaaaccgtttgagtgcaaccagtgcgggcgggctttttcccagaagcaatatctgattaagcaccagaacatccacaccggaaaaaaaccttttaagtgctcagagtgtggtaaagcctttagccagaaagaaaacctcatcatacaccaacggatccacacgggcgaaaagccctacgaatgtaagggctgtggtaaggctttcatccagaaatcctctttgattcggcaccagagaagccacacaggtgaaaaaccttacacctgcaaagagtgcggcaaagcattttccgggaagagtaatctcacagagcacgagaagatccacattggggagaaaccttacaaatgcaacgagtgtgggacaatcttccggcagaaacagtacttaattaagcatcacaacattcacacaggggagaagccttatgaatgtaataagtgcggcaaagctttttctcgaattaccagcctcattgtgcacgtccgcattcacacaggggataaaccctacgaatgtaaagtgtgcgggaaggctttttgtcagtctagctccttgaccgtccatatgcgatcccacacaggagaaaagccctacgggtgcaatgagtgcgggaaagcatttagccagttcagtactcttgcgctccatatgcgcatccacacaggtgagaagccctaccagtgttctgaatgcggtaaagcgttttcacagaagagccaccacatccggcaccagcggatccatacacactag

SEQ ID NO: 141282 - DNA, 1239 bp, Artificial Sequence
  Description of Artificial Sequence: Synthetic coding sequence
atgataggcatgctggagagcctgcagcatgagtccgatctgcttcaacacgaccagattcacaccggtgaaaagccctatgagtgcaacgaatgtcggaagacatttagtttgaagcagaacttagtggagcataagaagatgcatactggagaaaagagtcatgaatgcaccgagtgtggaaaggtttgttcgagagtgagcagcctgaccctgcacttacgatcacacactggcaaaaaagcgtataagtgtaacaagtgtggcaaggcgtttagtcaaaaagagaacttcctgtcccaccagaaacatcacacaggggaaaagccatacgagtgtgagaaggtctctatccagatgccaaccattatccgccatcagaaaaatcacaccgggaccaagccctacgcttgcaaagagtgtggcaaggcttttaatgggaaggcctacttgacagaacatgaaaagatccataccggcgaaaagccctttgagtgcaaccagtgcggcagagctttctcccagaaacaatacctcattaaacaccagaacattcacacgggcaaaaaaccctttaagtgctctgagtgcggcaaggccttcagccagaaggagaacttaattatacatcagcgtatccatacgggggagaagccctatgagtgtaaggggtgcggaaaggccttcatacagaaaagcagcttgattagacatcagagaagccatacaggcgagaagccctacacttgcaaggaatgcggaaaggccttcagtgggaaatcaaacctgacagagcatgagaagatccatataggtgagaagccttataagtgcaacgagtgcggtaccatattcaggcagaagcagtaccttattaagcaccataacatccacactggcgaaaaaccttacgagtgtaacaagtgcgggaaagccttctctcgcattacatcgttaattgtgcatgtgcggattcataccggggacaagccttatgaatgcaaagtatgtggcaaagccttctgccaatcctcttccctgacggtgcacatgcggtctcataccggtgaaaaaccttatgggtgtaatgagtgcggtaaggctttctctcagttttcaacgctggcactgcatatgagaatccacactggagaaaaaccttaccaatgcagcgaatgtggtaaggcctttagccaaaagtcgcaccacattcggcaccagcgcatccatacacactag

SEQ ID NO: 141283 - DNA, 1884 bp, Artificial Sequence
  Description of Artificial Sequence: Synthetic coding sequence
atggctgccgcagtgttgacagatcgcgctcaagtctcagtgacatttgatgatgtggccgtcacattcaccaaagaagagtggggccaattggatctcgcccagcggaccttgtaccaggaggtgatgctggaaaattgcggtttgctggtgagtctcggctgcccagtgccaaaggcagagttgatctgtcacctagaacacgggcaggaaccatggacaagaaaggaggacctgtctcaggatacatgcccaggagacaaaggtaaaccaaaaacgactgagccaaccacatgcgagccagccctgagtgagggaattagtctgcagggccaggtgacacagggcaactccgtggacagtcagttgggtcaggccgaagaccaggatgggctgtcagagatgcaggaaggacacttcagacctggcattgaccctcaggaaaagtctccgggaaagatgagtccggagtgtgatggcttagggaccgcggacggcgtttgttcccgcatcggacaggagcaggtgtctcccggcgaccgggttcggtcccataattcatgcgaatccggaaaggaccccatgattcaggaagaggagaacaactttaagtgctccgaatgcggtaaagtgtttaataagaagcacctgcttgctggccacgagaaaatccactctggtgttaaaccttatgagtgtacagaatgcggcaagaccttcattaaatctacccacctgttacagcaccacatgattcacactggtgaaaggccgtacgagtgcatggaatgcggtaaagcattcaatcgtaaaagctatctgacacagcaccagaggatccatagcggcgagaagccatacaagtgcaacgagtgtggcaaggccttcactcatcgatccaatttcgtacttcacaatcgtcggcacacaggcgagaaatcctttgtgtgcacggagtgtggccaggttttcaggcaccggccaggctttttgagacattatgtggtacactccggcgagaacccgtacgagtgcctggagtgcggaaaggtttttaaacacagatcttacctgatgtggcaccaacagactcacactggtgaaaagccctatgagtgtagcgagtgcgggaaggttttcctagagtctgcggctctgattcaccactatgttatccatacaggggagaaaccctttgaatgcttagaatgcggcaaggcctttaatcatcggtcttatctgaaacgccaccagcgcatccataccggagagaagcctttcgtctgctctgagtgtggtaaggcctttactcactgcagcacattcattctgcataagagagcccacactggcgagaaaccattcgagtgtaaagagtgcggcaaggctttcagcaacagaaaggacctgatccggcatttttccatccacactggggagaagccatatgagtgcgtggagtgtggtaaagcctttacccgaatgtccggtctaacacgccataaacgcatacacagcggtgagaaaccctatgaatgtgtggagtgtgggaagagcttctgttggagtacaaacttgatacggcatgctataatccatacgggcgaaaagccttataagtgttctgagtgcgggaaagcattctcccggtcttccagcctcacacaacaccagcggatgcacacaggcaaaaatccaatcagcgttaccgacgtcggccgcccctttaccagcgggcagaccagcgtgaccctcagggagctgctgctcggcaaagattttctcaatgtgactaccgaggccaatatactgcccgaggaaacttccagcagtgcgtcagatcagccatatcagcgggaaacaccccaggtctccagtctgtag

SEQ ID NO: 141284 - DNA, 1884 bp, Artificial Sequence
  Description of Artificial Sequence: Synthetic coding sequence
atggctgctgccgtgctgactgatagagcccaggtctccgtgacattcgacgatgtggctgttacctttacaaaggaagaatggggacagctggacttggcccagcggacgttgtatcaggaagtgatgctcgagaactgtggccttctagttagcctcggctgccctgttccaaaagcagagctcatatgccatctggagcatgggcaggagccttggacccgcaaggaagacctgagccaagacacatgcccaggcgataaagggaagccaaagacaacagagcccactacttgtgagccggctttatcagaaggtatctcactccagggacaagtaactcaagggaattccgtcgacagccaactcggccaggctgaggatcaagatggactgtcagagatgcaggaaggacactttcgccctggcattgatccccaagaaaagagtcccggaaagatgtccccagagtgcgacggccttggaacagcagacggtgtctgctcacggattgggcaagaacaggtcagtccgggagatcgggtgcgatcgcataacagctgcgagagcggtaaggatcccatgattcaagaagaggagaataactttaagtgttcggagtgcgggaaggtcttcaacaagaaacacctcctcgccggacacgagaagatccattcaggggtgaagccgtacgagtgtaccgaatgcggcaagacttttattaaatcaacccatttgcttcagcatcatatgatccacaccggcgaacgcccttacgagtgtatggaatgcgggaaggcctttaatcgcaagtcatatctgacccagcaccaacgcatacacagcggagaaaagccctataagtgtaacgaatgtgggaaagcatttacccataggagtaatttcgtgctccataaccgccgccacacaggagaaaagtctttcgtttgcacggaatgcggccaggtgttccggcacaggccgggctttctacgacactatgtggtacattccggcgaaaacccttatgagtgtctggagtgtggaaaagtcttcaagcataggagttacctgatgtggcaccagcagacccacactggcgaaaagccatacgagtgcagcgagtgcggtaaggtatttctcgagagcgctgcactaatccaccactatgtgattcacaccggggagaagcccttcgaatgtctggagtgtggaaaggcatttaatcaccgtagctacctgaagcggcatcagcggatccatacaggcgaaaagcccttcgtctgtagcgaatgtggcaaggcgtttacccattgcagcacattcatcctgcacaagcgggcccatacaggcgagaagccctttgaatgtaaagaatgtgggaaggccttttccaaccgaaaggatttgattagacatttttccattcacaccggagagaaaccctacgaatgtgtagagtgcgggaaggctttcacacggatgtccgggttaacccgccacaagagaatccattctggagaaaaaccatacgaatgtgtggagtgcggaaaatctttctgctggtctacaaacctgatcaggcatgctattattcatacaggagaaaaaccatacaaatgcagcgaatgcggtaaagcctttagccgcagcagttcactgacgcagcatcagcgcatgcacactggtaagaaccctataagcgtgacagacgttggccgcccttttacttccgggcagacatctgtgaccctacgtgagctgctcctgggtaaggacttcctgaatgtgacgactgaagccaacattctgcctgaagagacttcttccagcgcatcagaccagccatatcaacgcgaaacgccacaggtcagctcactgtag

SEQ ID NO: 141285 - DNA, 1650 bp, Artificial Sequence
  Description of Artificial Sequence: Synthetic coding sequence
atgctggagaattacaaaaatctggccacagtaggctatcaactctttaagccatccctaatctcttggctggagcaggaggaatccaggactgttcaaaggggtgactttcaagcctcggaatggaaagttcaacttaagaccaaagagctcgctcttcaacaagatgttctgggcgagccaacgtctagtgggatccaaatgatcggttcccacaatggtggcgaagtgagcgatgtcaaacaatgcggcgacgtttctagtgagcactcctgtctgaaaacccatgtgcgaacacaaaacagcgaaaatacattcgaatgctacctatacggcgtagattttctgaccctacataaaaagacttccacaggtgaacagcgctctgtattcagccaatgtggcaaagcattttctcttaatccggacgtggtgtgccagagaacttgcaccggagaaaaggccttcgactgctctgattccggaaagtcttttatcaatcacagccatttgcagggacatttgagaacccataacggcgagagcctgcacgaatggaaggagtgcgggcggggcttcatacactctacagatctggccgtgaggatacaaactcataggagcgagaagccatataaatgcaaagagtgtggcaagggatttaggtattcagcttacctgaacatacatatgggaacccacactggggacaatccttatgagtgtaaggagtgcggcaaagcttttaccagaagttgtcagctcacacagcatcggaagacacataccggtgagaagccatataaatgtaaggactgcggccgagcatttaccgtctcatcttgcctttcgcagcacatgaaaattcatgtgggagaaaagccctatgagtgcaaggaatgtgggatagcgttcacacggagcagtcagctgacagagcatcttaaaacccacactgccaaagaccctttcgagtgcaaaatatgtggtaagtcattcaggaacagttcctgtttgtcagaccattttcgtattcacaccggcataaaaccgtataagtgcaaggactgtgggaaagcattcacacagaactctgatttgaccaagcatgctagaactcattcaggcgagcggccttatgagtgtaaagagtgcggaaaagcgtttgcgagaagctcgcgcctttcggagcacacccgcacacatacaggggagaaaccctttgagtgcgtcaagtgtggcaaggcatttgccatcagctcgaatttatcaggccatcttagaatacataccggggagaagccctttgagtgtctggagtgcgggaaggccttcactcacagctccagtttgaacaatcatatgaggactcattctgcgaaaaagccgtttacatgtatggagtgcggaaaagccttcaagtttcctacatgtgtgaacctgcacatgcggattcatactggggagaagccctataaatgtaagcagtgcgggaagagcttctcatacagcaattccttccaacttcacgaacgcacacacacgggggagaagccttacgagtgtaaggagtgtggcaaggcctttagctcgagtagttctttcagaaatcatgagagaaggcacgcagatgagagattaagcgcttag

SEQ ID NO: 141286 - DNA, 1650 bp, Artificial Sequence
  Description of Artificial Sequence: Synthetic coding sequence
atgctagagaattacaaaaatttggccaccgtgggatatcagctcttcaaaccttctctgatttcatggttagagcaggaggaatcacgcaccgttcaaaggggcgacttccaagcaagcgaatggaaggtgcaactgaaaactaaggagctagcccttcaacaggacgttctgggagagcctaccagttcaggcatacagatgataggatctcacaatggaggagaagtgagcgatgtgaaacagtgcggtgatgtgagcagcgagcatagctgcctgaagacccacgtgcggactcagaattcagagaatacttttgagtgctatctttacggcgtggattttctgaccttgcacaaaaagacctcaacaggggagcaaaggagtgtcttttcacagtgcggcaaagcattcagtttgaacccagacgtggtgtgccaacgaacttgcacaggggagaaggcatttgactgctcggactcgggtaagagctttattaatcactcacatctgcaaggacatttgagaacgcataatggcgagtcactccacgagtggaaagaatgcggaagaggctttattcactcaacagatctcgcggtgaggattcagacgcacaggtcagaaaaaccgtataagtgcaaggaatgcggtaaaggatttcgctattcagcttaccttaatattcacatgggtactcataccggggataacccttacgaatgtaaagagtgcggaaaggcttttacgcggagttgccagctgacgcagcatcgaaagacccatactggcgagaagccatacaagtgtaaggattgcggacgcgctttcaccgtgtctagctgtttaagccagcatatgaaaatacatgtaggcgaaaaaccttatgagtgtaaggagtgtggtatcgcgtttaccagaagctcacagttgaccgagcacctgaaaacccacacagccaaagacccgtttgaatgtaagatttgcggaaagtcctttcgtaatagttcttgcctgagcgatcactttcgaattcataccggcatcaaaccatacaagtgcaaagactgcggtaaagctttcacccaaaattccgacctgacaaagcacgctaggacacactcaggtgaacggccttacgaatgcaaggagtgtggtaaggcgttcgcccgcagtagcagactctctgagcatactcggacacacactggagagaagccattcgaatgtgtgaaatgcggaaaggcttttgccatttcttctaatctctcggggcatttgcgcattcacaccggagaaaaacctttcgaatgtttggaatgcggtaaggcttttactcactccagctcactgaataatcacatgcgcactcacagcgccaaaaagccatttacgtgcatggaatgcgggaaagcttttaagtttcccacttgcgttaatttacacatgagaatccatacgggtgaaaaaccttacaagtgtaaacagtgtggcaagagcttttcctattctaatagtttccagctgcatgagagaacacacaccggcgaaaaaccctacgagtgcaaagagtgcggtaaggccttcagttcttcatcatcttttagaaatcatgagcgcagacatgctgatgaacgcttaagtgcttag

SEQ ID NO: 141287 - DNA, 1650 bp, Artificial Sequence
  Description of Artificial Sequence: Synthetic coding sequence
atgttggaaaactataaaaatcttgctaccgtgggataccagctttttaagccttctcttatctcttggctggaacaggaggagtctaggacagtccagcgcggcgattttcaggcctctgagtggaaagtgcaattaaagactaaggaactagcgctacagcaggacgtactgggcgagcccacgagctccggaattcaaatgattgggagccataacgggggagaggtgagcgatgtgaagcagtgtggggatgtctcatccgagcacagttgcttaaaaacacatgtgcgaacccaaaacagtgaaaacacctttgaatgttacctctacggtgtcgattttctcacgttgcataagaaaacgagcactggagaacagcggtccgttttttcgcagtgcggcaaagctttttcccttaatcctgacgtagtctgtcagaggacgtgcacgggagaaaaagccttcgactgcagcgactcggggaaatccttcatcaaccatagtcatctccaggggcacctgaggactcacaacggcgaatcccttcacgaatggaaagagtgtggccggggctttatacacagcacagacttggccgtcagaattcaaacacaccggagcgaaaaaccgtataagtgcaaagagtgcggaaagggttttcggtattccgcttaccttaacatccatatgggcactcatacaggggacaacccctatgaatgcaaggagtgcggcaaagcctttacaaggtcctgccaactgactcaacatagaaaaacccatacaggagagaaaccttataaatgcaaagactgtgggcgagcgtttactgtttccagctgtctaagtcagcacatgaagatccatgtaggggaaaaaccctatgagtgtaaagagtgcggcattgccttcaccagatcttcccagttaaccgagcacttgaagacccacaccgccaaagatcccttcgaatgcaagatttgcggtaagtcatttaggaatagcagttgcctctctgaccatttcagaatacatacaggcattaaaccgtataaatgtaaggactgtggcaaagcttttacccagaactccgatctgacaaaacacgcaagaacgcactctggcgagcgaccatacgagtgcaaggagtgtggcaaagccttcgctaggagctctagactgagtgaacatacccgtacgcataccggcgagaagccattcgaatgcgtgaaatgcgggaaggcctttgccatcagcagtaatctgagtggccacctcagaatccacaccggagagaaacccttcgagtgccttgaatgtggaaaggcctttactcacagttcctctcttaacaaccatatgcggacacacagcgccaagaagccattcacatgcatggagtgtgggaaggcatttaagtttccaacttgtgttaatcttcacatgaggatacacaccggcgagaaaccctataaatgtaagcagtgtggaaagtcattttcctacagcaactcttttcaactccatgaacgcacacataccggcgaaaagccctacgaatgtaaggaatgcggaaaagctttctcaagctccagttccttccgcaaccatgagcgcagacacgcagacgagaggctgagtgcatag

SEQ ID NO: 141288 - DNA, 2232 bp, Artificial Sequence
  Description of Artificial Sequence: Synthetic coding sequence
atgggccttctgacctttagagatgtcgctgtggagttctcactggaggaatgggaacatttggaacctgcccagaagaatttgtatcaggatgtgatgctcgagaactacagaaacttggtgagcctaggtttggtggtgagtaaacccgacctcatcacttttctcgaacagagaaaggaaccatggaatgtaaagtccgaggagactgtggctatccagccggacgtcttttcgcattacaacaaggaccttctgacggagcactgtacggaagcatcttttcagaaagtgatttcaaggagacacggttcctgcgaccttgaaaacctgcaccttaggaagcgatggaaaagagaagagtgtgagggacacaatgggtgctacgatgagaagacattcaaatacgaccagttcgatgagagcagcgtggagtccctctttcaccaacaaattctgtcctcttgtgccaaatcatacaatttcgatcaatatcgcaaggtattcacccactcatcattgttaaatcagcaagaggagatagacatctggggaaaacaccacatatatgataagacttccgtgctgtttaggcaggtgtcaacactgaatagctataggaatgtctttatcggcgaaaagaactatcattgcaacaactccgagaagacattgaatcagtcctctagccccaagaaccaccaggagaactattttttggaaaaacagtacaaatgtaaagagttcgaggaggtgttcctgcagagtatgcacggacaagagaagcaggagcagagttacaaatgtaacaagtgcgtggaggtgtgtacgcaaagcctaaagcacatccagcatcagactatacatattcgtgagaattcttactcttataataagtatgacaaggacctgtcccagtcttctaatctgcggaagcaaataatccataatgaagagaagccttacaagtgcgaaaaatgtggcgacagccttaatcattccctgcatttgacgcaacatcagattattccaactgaggaaaaaccctgtaagtggaaggagtgtggcaaggtgtttaatttgaactgcagcctctatctaaccaagcagcagcagatcgatacaggagaaaacctgtataaatgcaaggcctgctccaagtcatttacacgatcctctaatctcattgttcatcaacggatccacaccggagagaaaccctataaatgtaaggaatgcggaaaggcctttaggtgctcttcttacttaaccaaacacaaaaggattcacactggagagaagccctacaaatgcaaggagtgtggtaaagcattcaatcgctcatcttgtctcacccagcaccaaacaacacacaccggggagaagctatataagtgtaaagtgtgctcgaagtcttacgctagaagcagcaacctgatcatgcatcagcgggttcacaccggcgagaaaccttacaagtgcaaggagtgcggaaaagtgtttagcaggagctcctgtctgactcaacaccggaagattcacactggggaaaatttgtataagtgtaaggtgtgtgccaaaccattcacctgctttagcaacctgattgtccatgaaagaatccacaccggcgagaagccctataaatgcaaagaatgcggcaaagctttcccatactctagccatctgatccgtcaccacaggattcataccggcgagaaaccttataagtgcaaagcctgctcaaagagtttcagcgattcctcagggctcacagtccatcgcaggacacataccggcgagaaaccatacacgtgtaaagaatgtgggaaagcattttcctatagttcagacgtgattcagcaccggcgcatccacaccgggcaaagaccatataagtgtgaagagtgtggcaaggccttcaactataggagctacctgaccacacatcaacgctcacacaccggggagaggccctataaatgcgaagaatgcggtaaggctttcaattctcgaagttacctgaccactcatcggcggcgacataccggggaaaggccgtacaaatgcgacgagtgcggtaaagccttctcttaccggtcttacctgaccacccatcggcgctcgcactcaggtgagcgaccgtataagtgcgaggaatgtggcaaggccttcaactccaggagttatttaattgctcaccagaggtcccatactagggaaaaattgtag

SEQ ID NO: 141289 - DNA, 840 bp, Artificial Sequence
  Description of Artificial Sequence: Synthetic coding sequence
atgggcctgctcacgttccgtgacgtggcagtcgaattcagcctggaggaatgggagcacctcgagccagcgcagaagaacctgtaccaagacgtcatgttggagaattatcggaacctggtgagcctgggtctcgtggtaagtaagcctgatctcctaaccgaacactgcaccgaagctagcttccagaaggtgattagtcgaaggcacggctcctgtgacttagaaaacttacacctgaggaagcggtggaaacgcgaggaatgtgaaggacacaacggttgttatgacgagaagaccttcaagtatgaccaatttgacgaatcctcagttgaaagtctgttccaccagcagatcttatctagctgtgccaaatcttataatttcgaccagtatcgaaaagtattcacacatagttccttactcaaccaacaagaggagattgatatttggggcaagcatcatatatatgataaaaccagcgtactgttcagacaggtgtccacgttaaattcataccgtaatgtctttattggagagaagaattaccactgtaacaatagcgagaagacgctcaatcagtccagctctcccaagaatcatcaggagaactattttctggagaagcaatacaagtgcaaggaatttgaggaggtcttcttacaatctatgcacggacaggagaagcaggagcagtcttacaaatgtaacaaatgtgtcgaagtctgtacacaaagcttgaaacacatacaacaccagacaatccacataagggaaaacagctactcctataataagtatgacaaagacttaagccagagcagcaacttgagaaaatag

SEQ ID NO: 141290 - DNA, 2892 bp, Artificial Sequence
  Description of Artificial Sequence: Synthetic coding sequence
atggcaaccgctgccgagactagtgcttctgagcccgaagctgagtctaaagccggacccaaagccgacggcgaggaggacgaggtgaaggcggcaagaacaaggcggaaagtgctttctcgggcggtcgccgcagccacttataagaccatggggccagcctgggaccagcaggaggaaggcgtgtctgaatccgatggtgatgagtacgctatggcctcctcagccgaatccagtcccggggaatatgaatgggaatatgacgaggaagaggagaaaaaccagctggaaatcgagcgcctcgaagaacagttatccatcaatgtatacgattataactgccatgttgacctcatccggctcttgcgtctggaaggggagttaactaaggtgcggatggctcggcaaaagatgtctgaaatcttccctctgaccgaggaattgtggctggagtggctgcacgacgagatcagtatggcgcaggacgggctcgatcgagagcacgtgtatgatctgttcgagaaggctgtgaaagactatatttgccccaacatctggcttgagtacggacagtactccgttggtggcattggccagaaggggggcctcgagaaggtccgctccgtcttcgagcgtgcactgtcttcagtgggattgcatatgaccaaggggctggcgctttgggaagcctaccgagaatttgaaagtgctatcgtagaggctgcacgccttgagaaggtccatagtctgtttagacgccaactggccatacccctgtatgacatggaagctacttttgccgaatatgaggagtggagtgaggaccccattcctgagtcagttatccagaattacaacaaagctctgcagcagctggagaaatataaaccttacgaggaagccctgctgcaggccgaagctcctagactggcagagtatcaggcttacatcgattttgagatgaaaatcggggaccctgccagaatccagctgatttttgagcgtgctctggtggagaactgcctggtgcccgacttatggatcaggtactcccagtatctcgatcgccagctgaaagttaaggacctagtactcagcgtgcacaatcgcgcaattagaaattgtccatggacagtggcgttgtggtcccggtatctcctggcgatggaaagacacggagttgatcaccaggtcatatctgtcacattcgagaaagcactgaatgccgggttcatccaggccacggattacgttgaaatttggcaggcttacctcgactacctgaggcgtcgggttgactttaagcaggatagttctaaggagctggaggagctgcgcgccgctttcaccagggccctggaatacctcaaacaggaggttgaggaacgattcaacgagtcaggggacccctcttgcgtcatcatgcagaattgggctaggatcgaggcacggctgtgcaacaatatgcagaaggcacgagaactctgggactccatcatgacccggggcaatgcaaaatacgcaaacatgtggctagaatattacaatctagagcgggcccatggcgatacccagcactgccggaaggctctgcatcgtgccgtacagtgtacttctgactatccagaacacgtgtgtgaggttctgctgacgatggagcgaaccgagggatcactcgaggattgggacatcgccgtgcagaaaactgagacgcgcttagccagggttaacgaacaacggatgaaagcggcagaaaaggaggccgcactggttcagcaagaggaagaaaaggccgagcagcgcaagcgggcaagggcagagaagaaggccctcaaaaaaaaaaagaagataagaggtcctgaaaagcgtggtgccgacgaagacgacgaaaaggaatggggtgacgatgaagaggagcaacctagcaagaggagaagagtggaaaattccataccggccgctggggagacacagaatgtggaagtagccgctggaccagccggcaaatgtgccgctgtggacgttgagccaccctccaagcagaaggagaaggctgctagcctgaaacgtgatatgccaaaagtcctccacgattcaagcaaggattccataacagtttttgtgagcaacctcccatatagcatgcaagaacccgatacaaaactgagaccactgttcgaggcgtgtggtgaggttgtgcagatccgcccaatcttctccaatcgcggtgatttccggggttattgctatgtggagtttaaagaggagaagtcagcactgcaggccctggagatggataggaagtccgtcgagggtcgccccatgtttgtttccccttgcgttgacaagtcaaaaaacccagactttaaggtttttcggtattcaaccagcctggagaaacataagctgttcatctctgggctgcctttttcatgtactaaggaagagcttgaagagatttgtaaagctcatggcactgtgaaagacctgagactcgttacaaacagggccgggaagccaaagggcctggcatacgttgaatatgagaatgaaagccaggctagccaagccgttatgaaaatggacggaatgactattaaggagaatatcataaaagtggctatctccaatcctccacagagaaaggttcctgaaaagcccgagacacgcaaggcaccaggaggtcccatgctgctgcctcagacatatggtgcccgtggtaaaggccggactcagcttagtcttctgcctcgggcccttcagcggcctagcgcagcggctcctcaggcagagaacggacccgccgcagctccagccgtagccgcccccgcagccaccgaggctcccaaaatgagtaatgccgatttcgctaaactgtttctgaggaagtag

SEQ ID NO: 141291 - DNA, 1077 bp, Artificial Sequence
  Description of Artificial Sequence: Synthetic coding sequence
atggacgcaaagagcttgactgcttggtctaggaccctggttacgttcaaggacgtattcgtggacttcacccgcgaagagtggaagttgctcgatactgctcagcaaattgtgtatagaaacgtgatgctggaaaactacaagaacctggtatctctcgggtaccagctgaccaagcctgacgtgattcttagactggagaaaggggaggaaccctggctggtagagcgagagattcatcaggagacacatccagacagtgagaccgcattcgaaattaaaagttcagttagctcccgatcgatcttcaaagacaagcagagttgtgatatcaagatggaggggatggcgcgcaacgatttgtggtatctttctcttgaagaggtctggaagtgtcgggaccaactcgataagtatcaagagaatcctgaacgccacctgagcattccgcgggtactttcccttccagccagacatacgaaactaaccgtgggcatggccacaagagtgaggaccgcaagtatttgggtgcctccactccaagagaggaacagcagttgggaccgtattcggaaattgcagggtcaggaatcaatcctcgggcaggggacacctggcctccagcccttacccgggacgccacgtcaaaaacagaaaagtaggaggatagaaaaggtgctggaatggctctttataagccaagagcagccaaaaattactaagtcctggggaccgctctcgttcatggatgtattcgtggacttcacctgggaggagtggcagctgctggacccagcacaaaaatgcctgtatcggtcagtaatgctagagaattattccaatctcgtctccttaggttaccagcacaccaagcccgatattattttcaagttggagcagggggaggagctgtgcatggtacaggcacaggtgccaaatcagacgtgcccaatactcaaagccggtaagtctaaggccaaggttttagctggcttagtcagtggggaaggcctgctttgcgcttcaaagatgactccgtgctgttgtattctctggcgccattccttggagaattag

SEQ ID NO: 141292 - DNA, 504 bp, Artificial Sequence
  Description of Artificial Sequence: Synthetic coding sequence
atggctacccgagtccggactgcgagtatatgggtgccaccattacaggaacgcaattcctcctgggaccgcatccggaagctgcagggacaggagtccatcttaggacaaggcacccccggcttgcagcctctgcccgggacgcctcggcaaaagcagaagtctagaagaattgagaaagtcctggagtggttgttcatctctcaggagcagccaaagatcacaaagtcctgggggacaaatactccgaacctgatatcgtcctcaagctggaacaaagaaaagtcatgcgtatggtgcaggccaaagtttcaaatcagaccagtccaaacccaaagcggcaaactaatgatactctggatcggcatccgcaagataaagaccagttgggaggttcgccaaaaagcgctgaacgccctccatttagaaaattacgtttttctggtgcagagcatcttccaagacaaaaacttgatcaatgtggccaggatggaacgggtgtag

SEQ ID NO: 141293 - DNA, 2361 bp, Artificial Sequence
  Description of Artificial Sequence: Synthetic coding sequence
atggactggcaccaggaaaataaggacaaactgggatccacagctaagagcttcgagtgtacaactttcggtaaactgtgtctgctaagcacaaagtatttgagtcggcaaaagccccataaatgtgggactcacggcaaatcccttaaatatatcgactttactagcgattatgctagaaacaatccaaatggatttcaggttcatggaaaaagtttctttcattccaaacatgagcagaccgtaataggtatcaaatactgcgagtccatcgaatccggtaagaccgtcaataagaaatcacagctgatgtgccagcaaatgtatatgggggaaaaacccttcggttgctcctgctgtgagaaagcattctctagtaaatcttacctgctggtccatcagcagacacacgccgaggagaagccgtacgggtgtaatgaatgcggaaaagacttctcatccaaaagctacctaatcgtccatcagcgaattcatacgggggagaagctacatgagtgtagtgaatgcagaaaaaccttctctttccattcccagctcgtcattcaccaaaggatccataccggtgagaatccctacgaatgttgcgaatgtgggaaagtgttttcgaggaaggaccagctcgttagccatcagaaaacgcattcaggccagaaaccctatgtctgcaacgaatgcgggaaggccttcggcttgaaaagtcagctgataatacacgaacgaatccacacaggagagaagccttacgaatgtaacgagtgccaaaaggcattcaacactaagtcaaacctgatggtgcaccaaagaacccatacaggagaaaaaccttacgtctgttctgactgtggtaaagcttttaccttcaaatcgcaactgatcgtacaccagggaattcacactggcgtgaagccctatggctgcatacaatgcggaaagggattctctcttaagagccagctcatagtccatcagcgctcccatacaggcatgaaaccgtacgtctgtaacgagtgtgggaaagcattcaggtctaaatcatatttaataattcacaccagaacccacacaggtgaaaagctgcacgaatgcaataactgcgggaaggcctttagctttaagagccaactgattattcatcagcgcatacacactggcgagaacccttatgagtgtcacgagtgtggtaaggctttcagccgaaaataccagctgattagtcatcagaggacccatgccggggagaaaccctatgagtgtactgattgcgggaaggcgttcgggctgaagagccagcttattatacaccagagaactcataccggtgaaaagcctttcgaatgctcagaatgccagaaggcttttaatacgaaaagcaatttgatcgtgcaccaacggactcacacaggcgaaaagccttactcttgcaatgaatgcgggaaggccttcacctttaagtcgcagttgatcgtacacaagggtgtccatacaggggtgaagccttacggctgcagccagtgcgctaaaacattcagcctgaaatcacagctcatcgttcaccagcggtcccacaccggcgtgaagccctacgggtgctctgaatgcggaaaggccttcaggagcaaatcttatctcatcatccatatgaggactcacacaggagagaaaccacatgaatgccgggagtgtggaaaatcattttcctttaatagccagctgatagtgcaccagagaattcataccggggaaaatccctacgagtgcagcgagtgcgggaaggctttcaacagaaaggaccagctcatctcgcatcaacgtactcacgctggggagaaaccatacggatgttcggagtgcggtaaagctttctccagcaagagttatttaatcatccacatgcgcacccactctggcgagaagccctacgagtgcaatgagtgtggaaaagcatttatttggaaaagcttactcatcgtgcatgaaagaacccatgctggagtgaatccctataaatgtagccagtgtgagaaaagttttagcgggaaactgcggctgctagtgcatcaacggatgcacaccagggagaagccttacgaatgtagcgagtgtgggaaggctttcatacgcaacagccagttaattgtacatcagcggacccacagtggagagaaaccatacggttgcaacgaatgtgggaagaccttctcgcagaagtccatacttagcgcacaccaaaggacacataccggagaaaaaccatgtaagtgtacagagtgcggcaaggccttctgttggaagtcacagctgatcatgcatcagcggactcacgtggacgacaagcactag

SEQ ID NO: 141294 - DNA, 2844 bp, Artificial Sequence
  Description of Artificial Sequence: Synthetic coding sequence
atggctacaagagtgcgtactgcatcaatctgggtgcctcctttacaggagcgaaactccagttgggatcgcatcaggaaattgcaggggcaggagagtattctgggacagggtactccaggactgcagcccctgcctgggaccccccggcagaaacagaagtcccgtaggatcgaaaaagtgcttgaatggctgtttattagccaggagcaaccgaagatcaccaaatcgtggggaccactgtcgtttatggacgtcttcgtggattttacatgggaagagtggcagctcctggatcctgcccaaaagtgtctgtaccgaagcgtcatgctagaaaactactccaacctggtctctctcggataccagcatacgaagcccgatattatttttaagctcgagcagggcgaggaactctgtatggtccaagcccaagtccctaatcagacctgtccaaacaccgtatggaagatcgacgacttgatggactggcaccaggagaataaagataaactgggcagcaccgccaaaagctttgagtgtaccacttttggtaagctgtgcctgttatcgactaagtatctgtctcggcagaagccacacaagtgcggtactcacggaaagagtttgaaatatattgacttcacctctgattatgcccggaacaatccaaatgggttccaagtccatggtaaatcgttttttcacagtaaacatgagcaaaccgtgatcgggatcaaatactgtgagagcatcgaatccggcaaaaccgtgaataaaaagagccagctcatgtgtcagcagatgtacatgggtgaaaaaccttttgggtgctcttgttgtgagaaagcgtttagtagtaagtcttaccttctcgtgcatcagcagacacacgctgaagaaaagccatacggatgtaacgagtgcggtaaggactttagcagcaaaagctacctcattgtgcaccagcgtattcatactggcgaaaaactgcacgagtgctccgagtgtaggaagacattttccttccactctcagctggtgattcatcaaagaatacataccggtgaaaatccttacgaatgttgcgaatgtggaaaggtgtttagtcgaaaggatcagctggtttcccatcagaaaactcattccgggcaaaagccatacgtgtgcaatgaatgtggcaaggcctttgggctgaagtctcagctaatcatacacgaacgcatacatacaggagaaaagccatatgaatgtaatgagtgccagaaggcttttaacaccaaaagcaatctgatggtgcatcagaggacacacaccggtgagaagccttatgtgtgcagcgactgcggcaaggctttcacgttcaagtcccagctgattgtccatcagggaatacacactggagtgaaaccctatggatgcatccagtgtggtaaaggcttcagcctgaaatcccagctgatcgtacatcagaggagccacaccggaatgaagccgtacgtctgcaatgaatgcggcaaagccttcagatctaagagctaccttatcatacatacacggacccacacaggtgagaagctccatgaatgcaacaactgtggcaaggctttcagcttcaagtctcaacttattatccaccagcggattcacacaggcgagaatccgtatgaatgccacgaatgtggcaaagcattctcccgcaaatatcagttgatctcacatcaacgaacccatgctggagagaaaccctacgagtgtacagattgcggtaaggcctttgggcttaaatctcagctcatcatacaccagaggacccatacgggtgaaaagcccttcgagtgttcagaatgccagaaggcttttaacactaagtccaatttgattgtccatcaaaggacacatactggtgagaaaccctactcttgcaacgagtgcggaaaagcctttacattcaagtcgcagttaattgtccataagggcgtgcatacaggcgtaaaaccgtacggatgcagtcagtgcgccaagacgttcagcttaaagtcccaactgatcgttcatcagcgcagccacacaggcgtgaagccctacggctgcagcgagtgtggtaaggcattcaggagcaaaagctacctcattatccatatgcgcacccacaccggggagaaaccccatgaatgccgcgaatgcggaaaaagtttctcattcaatagccagttaatcgtccaccagcgcattcacaccggcgaaaatccttacgagtgtagtgagtgcggcaaggcttttaatagaaaggatcaactgatctcccatcagaggacccacgctggcgaaaaaccctatggatgttcggaatgtgggaaggctttctcttcaaaatcttacttgataatacatatgcggacccacagtggggagaaaccttatgaatgtaacgagtgtggcaaggccttcatctggaaatctctcctgatcgttcatgaacgtacccacgcaggcgtgaacccttacaaatgctctcaatgtgagaagagtttctctggaaagcttcgcctgctcgtgcaccagcggatgcacacacgcgaaaagccttacgaatgctctgaatgcggaaaggcgttcatccgtaattctcagttgatagtgcaccaacgcacccattccggggagaaaccctacggatgcaacgagtgtggaaaaaccttctcacagaaatctatcctgtccgcccatcagcggactcatactggcgagaagccttgtaagtgcaccgaatgtggtaaagccttctgctggaaatcacaactgatcatgcaccagcgcacccacgttgatgataagcactag

SEQ ID NO: 141295 - DNA, 2193 bp, Artificial Sequence
  Description of Artificial Sequence: Synthetic coding sequence
atggattggcatcaggaaaacaaagacaagctgggcagtaccgccaaaagcttcgagtgcaccaccttcgggaagctgtgtctgctgtctaccaagtacctatcccggcagaaacctcacaagtgcgggacacacggcaagtccctcaagtatattgacttcacttctgattatgccagaaacaatccaaacggatttcaagtgcacggtaagtccttttttcactcaaagcacgaacagacggtcatcggcataaaatactgcgagtccatcgaaagtgggaagacagtcaataagaagtcccaactcatgtgccagcagatgtacatgggcgagaagccttttggctgcagttgctgcgagaaggccttttcttctaaatcctatctgctggtccatcagcagacccacgccgaggaaaagccatacggttgcaacgagtgtggcaaggatttcagctccaagtcatatttaattgtgcaccaacgcattcacaccggggagaagctccatgaatgctcagagtgtcgaaagacgttcagctttcattcgcaattagtcatccatcagcgtatacacacaggggagaacccttatgagtgctgtgagtgcggcaaggtgttttctcgcaaggatcagcttgtgtcccatcagaaaacccactctgggcagaaaccttatgtttgtaatgaatgtggcaaggcctttggtctaaaatcacagcttatcattcatgagaggattcacaccggagaaaagccgtacgaatgcaacgagtgtcagaaggcctttaacacaaaatcaaacctcatggtacaccagagaactcacacgggagagaagccttacgtctgctcagactgtggcaaggcctttacattcaagagccagttaattgtccaccaggggattcatacgggtgtgaaaccctacggttgcatccagtgtgggaaggggttctcgctgaagtctcagctgattgttcaccagcgatcacacacaggtatgaagccgtacgtatgtaatgagtgtggtaaagcttttagaagcaagagttacttaataattcacactcgcactcacacaggggagaagctgcatgagtgcaacaactgtggaaaagctttctctttcaaatcccaacttattatccaccagaggattcacacaggagagaatccttatgagtgccacgagtgcgggaaggctttttctaggaagtaccagctgatctcccaccagcgaacacacgccggcgaaaagccatatgagtgcacagattgcggcaaggctttcgggctgaagtctcagctgatcattcaccaaaggacccataccggcgagaaacccttcgagtgcagtgagtgtcagaaagcttttaacaccaagtccaacctcattgtccatcagagaacacacactggagagaagccatactcatgcaacgagtgcgggaaggctttcaccttcaagagccagctaatcgtccataagggggtgcacactggcgttaaaccctacggatgtagccagtgcgcaaaaacattttctctgaagagccaactgatagtgcaccaacgttcccatacaggggtaaagccatacggctgttccgaatgtgggaaggcctttcgttcaaagtcatatctcatcatccatatgcggacacacacgggcgagaagccacacgagtgcagagagtgcggtaagagcttctctttcaactcacagcttattgtgcaccaacggattcataccggtgagaacccatatgaatgcagtgaatgtggcaaggccttcaacaggaaagaccagctgatttcgcatcagagaacacatgcaggtgagaaaccatatggctgcagcgagtgtggcaaggccttctcatccaaatcatacttgataattcatatgagaacacacagcggtgagaagccttacgagtgcaacgaatgtggcaaagcgttcatctggaagagtcttctgatcgttcacgagcggacgcatgcaggagtcaatccctacaaatgttcacaatgcgaaaaatctttttctggtaagctgagactcctcgtacatcagagaatgcatacaagagagaagccgtacgaatgtacagaatgtggaaaagctttctgctggaaatcccagctgattatgcaccagagaacacacgtcgacgataaacattag

SEQ ID NO: 141296 - DNA, 303 bp, Artificial Sequence
  Description of Artificial Sequence: Synthetic coding sequence
atggcaacccgagttcggactgcttccatctggggtacgaatacaccaaacttaatttctagctcctcttggaataaagaaaagtcatgtgtgtggtgtcggccaaagtttcagattaggccagtgcaaactcagagtggaaaactgatgatcctgtggattggaatccgcaaaatcaagacctcatgggaggtgcgccaaaaagctctgaatgctcttcacctcgagaactatgttttcctggtacagtctatattccaggacaaaaatctgatcaacgtggcaaggatggagagggtttag

SEQ ID NO: 141297 - DNA, 381 bp, Artificial Sequence
  Description of Artificial Sequence: Synthetic coding sequence
atggccaccagagtgcgcacagcctccatctgggggcccctgagcttcatggacgtgttcgtcgatttcacatgggaagagtggcagctgcttgaccctgcccaaaaatgcctgtataggagcgtgatgcttgaaaactactcaaacctcgtcagcctgggatatcagcatacgaagcctgacattattttcaagctagagcaaggggaggagctttgtatggtgcaggcccaagttcctaatcagacctgccccattttgaaagcaggcaaatctaaagccaaagtgctcgcagggctggtcagcggggagggccttctgtgtgcctcaaaaatgactccatgctgctgcatcttatggaggcattcccttgaaaactag

SEQ ID NO: 141298 - DNA, 207 bp, Artificial Sequence
  Description of Artificial Sequence: Synthetic coding sequence
atggccaccagggtcagaaccgcaagcatatggactcagagtggcaaactgatgattttatggattgggatccgcaagatcaagacaagttgggaggtgcgccagaaggccttgaacgccctgcacctggagaactacgtcttcctcgtgcagagcattttccaggacaagaatctaattaatgtggcccggatggaacgcgtgtag

SEQ ID NO: 141299 - DNA, 504 bp, Artificial Sequence
  Description of Artificial Sequence: Synthetic coding sequence
atggctacgagggtgcggacggcctcaatctgggtccctcccctgcaggagaggaactcatcgtgggaccggatccggaaactccagggccaggaaagcatactgggacagggaaccccgggcctccagccattgccaggtacccctcgtcagaagcagaagtcaaggaggattgagaaagtcttagagtggctcttcattagccaggagcaacccaaaatcacaaagtcttgggggactaatactccaaacttgatttccagctcttcttggaataaggagaagtcatgcgtatggtgccgacctaaatttcaaatacggccagtgcagacccagagtggcaagttaatgattctctggattggcatccggaagatcaagacatcctgggaggttcgtcaaaaggcactgaatgcgctgcatcttgagaactatgtcttccttgtgcagtcgatctttcaggacaagaatctgatcaatgtcgcccggatggagagagtgtag

SEQ ID NO: 141300 - DNA, 381 bp, Artificial Sequence
  Description of Artificial Sequence: Synthetic coding sequence
atggccacacgcgtgaggaccgcttcaatatggggaccccttagtttcatggatgtgtttgtggactttacctgggaagaatggcaactgttggatcccgcccagaagtgcttataccgctctgtgatgctggagaattatagcaatcttgtgagcctagggtaccagcatacaaagcccgacatcatcttcaagctcgagcagggtgaggagctttgtatggttcaggcacaggtacctaatcagacctgcccaattctcaaagctggtaaaagtaaggccaaagtcttggccggtctggtgagcggggaagggctcctttgtgcgtctaagatgaccccctgctgctgcattctgtggcggcattccctggagaactag

SEQ ID NO: 141301 - DNA, 1959 bp, Artificial Sequence
  Description of Artificial Sequence: Synthetic coding sequence
atggcgtcacgcctgccaactgcttggtcctgtgagcccgtgaccttcgaggatgtgacgctcggattcactcctgaagaatggggtctattagacctcaagcaaaaatccctgtatcgggaggtgatgcttgagaactatagaaatctcgtgtccgtggagcaccagctgtccaagcctgatgtcgtatcccaactggaggaggctgaggatttctggccggtcgaacgcggcattccccaggacactattcctgagtatcctgaattacaattggatcctaaactggaccctctgcccgcagaatcccctttaatgaacatcgaagtggtggaggtgctgaccctgaatcaggaggtagccggacctcgcaacgcccaaatacaggccctctacgcggaagatgggtcactgagcgcagacgctccgtctgaacaggtccagcaacagggaaagcacccaggggacccagaggctgcccgacaacggtttcgacaattcagatataaagacatgaccgggccacgggagttggatcaacttcgcgagctctgtcaccagtggttgcagcccaaagccagatctaaagagcagatcttggagctcctggtactggaacaattcctgggcgcgctcccagtgaaattgagaacttgggtagaatctcagcaccctgagaattgtcaggaggtggtggctctcgtggaaggtgtcacctggatgtcagaggaagaggtgctgcccgcaggccaacccgctgaaggaacaacctgttgccttgaggtgactgctcagcaagaggagaagcaggaagacgccgctatctgccctgttacggtgctacccgaggagcccgtgactttccaagacgtcgcagtcgacttttctagggaagaatggggactgttaggccccacacaaaggaccgagtatagggacgtcatgctggagacgttcggccacttggtgtccgtgggctgggagacaaccctggagaataaggagcttgcccccaactccgacattcctgaagaggaaccagcgccgagcctgaaggtgcaagagtcgtcccgcgattgcgccctgagcagtactctggaggacacactgcagggaggtgtccaagaagtccaggacacagtgctgaaacagatggagagcgctcaggaaaaggacctgccccagaagaaacatttcgataatcgggagagccaggctaatagcggcgctctggacactaaccaggtatctctgcaaaaaattgacaatcctgaatctcaagccaatagtggtgcacttgatacaaatcaggtgttacttcataagattcccccccgcaaaaggttgcgaaagagggattctcaggtaaaatcaatgaagcataactctcgcgtgaagattcaccagaaaagctgcgaaaggcagaaggcaaaggaagggaatgggtgtaggaagaccttttccaggtccactaagcagatcacttttattaggattcacaagggttctcaggtgtgtaggtgttccgagtgtgggaaaatatttcggaatccaaggtatttttcggtccacaagaaaatccatactggggaaaggccatatgtgtgccaagactgtggcaaaggttttgtgcagtccagcagtcttactcagcaccaaagggtacacagtggcgagagaccgttcgaatgccaggaatgcggtaggacttttaatgacagaagtgccatcagccagcatctgcgcacacacaccggtgcaaagccttacaaatgccaagactgcggcaaagcgttcagacaatctagccatctgatacgccaccagaggacccatacaggggaacggccttatgcttgcaataagtgcggcaaggcgtttacgcagtccagccacctgatcggccaccaaagaactcataatcggaccaaaaggaagaagaagcagccgaccagctag

SEQ ID NO: 141302 - DNA, 1863 bp, Artificial Sequence
  Description of Artificial Sequence: Synthetic coding sequence
atggccagtcggctacccacagcctggtcttgtgagccggttacattcgaggatgtgacacttggctttacccctgaagagtggggcctgctggatctcaaacagaagtctctgtatagggaggtaatgttggagaattaccggaacctggtgtctgtcgaatatccagaactgcagttagatccaaaactcgacccgctgcctgctgagtccccactgatgaatattgaggttgtggaggtcctaacactgaatcaagaggtggctggtccaaggaacgcacagatccaagcattatatgccgaagatggttccttaagtgcagatgctcccagtgagcaggtgcaacagcagggaaaacaccccggagacccagaggcagcccgacagagattcaggcagtttaggtacaaagacatgacagggcctcgtgagctggaccaactacgcgaactttgtcaccagtggttacagccgaaagcgagaagtaaagagcaaattttggaacttcttgttctggaacagtttctgggagcgttgcccgttaaactgagaacatgggttgagtctcaacacccagagaattgtcaagaagtggtagccctcgtggagggggtcacgtggatgtccgaagaggaggtgctgcccgccggacagccagccgaagggacgacatgctgtttagaagtcactgcccagcaggaagagaagcaggaggatgctgctatttgcccagtaacggtattaccggaggagccagtcacatttcaggacgtggccgtggacttcagccgtgaggagtggggtctcctgggtccaacacagcgtactgagtatcgcgacgttatgctggagacattcggtcatcttgtgtcagttggctgggagactacgctggagaataaggagctggctcccaatagcgacatcccagaggaagagcctgctccttcacttaaggtgcaggagagctcaagagattgcgccctttctagcaccttggaggatacgctgcaggggggcgtgcaagaagtgcaagacaccgtgctcaagcaaatggagagtgcacaggaaaaagacttaccccagaagaagcactttgataacagagagagtcaagctaattctggtgccctagataccaaccaggtgtcactccagaagatagataatcctgaaagtcaggccaacagcggtgcactggatacaaatcaggtactgctacacaagataccaccccgcaagcgactccgtaaacgggattcgcaggtgaagagcatgaagcacaacagcagagtcaaaattcaccagaagtcgtgtgagcggcagaaggcaaaggagggcaacgggtgtcgaaagacgttctcccgcagcaccaaacaaatcactttcattcgcattcacaaagggtcacaggtctgcaggtgcagcgaatgcggtaaaatcttccgcaatccgaggtacttctctgttcataaaaaaatacacacaggtgaacgtccctatgtttgtcaggactgtggcaagggatttgtgcagagttcttcactcacacagcaccagagggtgcactctggtgagcgcccattcgaatgtcaagagtgcggccggacgttcaacgaccgcagtgctatatcacaacatttgcggactcatacaggagcaaaaccatataagtgccaagactgtgggaaagcctttcggcagtctagccacctaataaggcatcagcgcacccacaccggagagcgcccatatgcttgcaataaatgcggcaaggctttcacccaaagcagccacttaataggccaccagcgcacacacaacagaacaaaacgaaagaagaagcagcctacatcttag

SEQ ID NO: 141303 - DNA, 1644 bp, Artificial Sequence
  Description of Artificial Sequence: Synthetic coding sequence
atgaacattgaagtcgtggaggtgttaactctgaatcaggaagtggctggacctcggaatgcccagattcaggccttgtacgccgaggatggaagtctctctgctgatgcgcctagcgaacaggtgcagcaacagggaaaacatcccggagatccagaggctgctagacagaggttcaggcagtttagatacaaagacatgactggccccagggagctcgatcagctcagagagctgtgtcaccagtggttacagcccaaggccagatctaaggaacagatcctcgagttattggtactggagcagttcctgggcgcattaccggtcaaactccgcacatgggtggagagccagcacccagagaattgccaagaagtcgtggcactcgttgagggggtgacatggatgagcgaagaggaggtcctccctgcaggccagcctgcagagggaacaacctgctgccttgaggtcactgcccagcaggaggagaagcaggaggacgcagccatctgccctgtgacagtgctgcccgaggaaccagtaacatttcaggatgtggcggtcgatttctctagggaggagtggggcctgctggggcccacacagcgcaccgaatatcgtgatgtcatgctggaaacgttcgggcacttagtgtctgtgggttgggaaaccacattagagaacaaagaactggcacccaactccgacattccagaggaggagcctgcaccgagcctaaaagtccaggaaagtagcagagattgtgccctctctagcacgttggaagatacacttcagggtggcgtgcaggaggtccaggatacggtgttaaaacagatggagagtgcgcaggagaaagacctaccccaaaaaaaacactttgataacagggaaagtcaggccaatagtggggcactggataccaaccaagtgagtcttcaaaagatcgacaaccccgaatctcaggctaacagcggcgcactcgataccaatcaggtcttactgcataagattcctcccagaaagcggttaagaaagagagattcccaggtcaaatcaatgaagcataatagtagggtcaagatacatcaaaagtcttgtgaacgacaaaaagcaaaggagggcaacggatgccgcaagactttctcaagatctactaagcagatcacttttatcagaatacacaaagggtctcaggtgtgcaggtgttccgagtgcggaaaaattttccggaatccacggtatttctccgttcataagaagatccacaccggtgagcgaccttatgtgtgccaagattgcgggaaaggtttcgtccaaagctcttcactgactcagcaccagcgcgtgcactcaggagagaggccatttgaatgccaagaatgcgggaggaccttcaatgatcgcagcgccatttcacagcacttacgcactcacacgggggccaagccctacaaatgccaggattgtgggaaggcattccggcaatcttcacacctcatccgccaccagagaactcatacaggggagcgcccgtatgcttgtaataaatgcggaaaggcttttacacagagtagccatctgatcggccaccaacggacccataaccggaccaagcgaaaaaagaagcagcccacctcatag

SEQ ID NO: 141304 - DNA, 1353 bp, Artificial Sequence
  Description of Artificial Sequence: Synthetic coding sequence
atggcggcttctaaaactcagggagctgtggctcggatgcaagaagaccgggacggcagttgtagcaccgtgggaggcgtgggctatggggactcaaaggactgcatactcgagcctttgtcactccctgagagcccaggaggcacaaccacgctcgaagggtctccgtcggtgccgtgcatcttctgtgaggagcactttcccgtcgctgaacaagataagctcctgaagcacatgatcattgaacacaagattgtgattgcagacgttaagctggttgccgacttccaaaggtacattttatattggcgcaaacgctttactgagcagccaatcactgacttttgttctgtcattcgcataaatagcacggcaccatttgaagaacaagagaactacttcctcctgtgcgacgtcctgccagaggatagaatcctgcgggaggaactgcagaaacaaagactccgggaaatcctggagcaacagcagcaggaaaggaacgacactaacttccatggtgtctgcatgttctgcaatgaggagttcttgggcaaccggtctgttatactgaatcacatggccagggagcatgccttcaatatcgggcttcccgacaacatcgtcaattgcaatgaatttctgtgtactttgcagaagaaacttgataacctgcagtgtctttattgcgaaaagacatttcgggacaaaaacaccctgaaggatcacatgcgcaaaaaacagcacaggaaaataaatccaaaaaatcgagagtatgacaggttctacgtgataaactatcttgagctcggaaagtcctgggaagaggtgcaattagaggacgatagagagctgctggaccatcaggaggatgattggtcggattgggaagagcatcccgcctccgccgtgtgcctgttttgtgagaaacaggctgaaacgattgaaaaactatacgtgcacatggaggacgctcatgaatttgatctcctcaaaattaaaagtgaactgggcttgaatttctaccagcaggttaagcttgtgaacttcattcggcgtcaggtgcatcagtgcaggtgctacgggtgccacgtgaaatttaaaagcaaagcagacctgaggacccatatggaggagacaaaacacacctctttgctgcctgatagaaagacatgggaccagctggagtactactttcctacctatgaaaatgataccttgctctgcaccctgtccgactctgaatccgatctgaccgcccaggaacagaacgaaaacgtgcctattattagcgaagacacctctaagctgtatgcgctgaaacagtcatccatacttaatcagcttctcctttag

SEQ ID NO: 141305 - DNA, 873 bp, Artificial Sequence
  Description of Artificial Sequence: Synthetic coding sequence
atggcggcctcaaaaacgcaaggggccgtagctcggatgcaagaagatagggacggatcctgctctactgttggaggtgtgggctacggcgactccaaagattgcatcttagaacctctgtccctgccggaaagccctggaggtacaaccacgctggaaggaagccccagtgtgccttgcattttttgcgaagagcatttcccagtcgcagaacaagacaagttgctgaaacatatgattattgagcacaaaatagtgatcgccgatgtgaagctcgttgcggatttccagcgatacatcctctattggagaaaacgatttaccgagcaacctatcactgacttctgttctgtgataagaatcaactctaccgccccttttgaggagcaggaaaactacttcctgctatgcgatgtgttaccggaggacagaatcctaagagaggagctccagaagcagcgcctgagagagattttagagcaacagcagcaagaaagaaacgacaccaatttccacggggtctgtatgttttgcaacgaggagttcctagggaacaggagtgtgatcttgaaccacatggccagggagcacgctttcaatataggcttaccagataatattgtgaactgcaatgaatttctgtgcaccttacagaaaaaattggacaaccttcagtgcctctactgtgagaagaccttcagggacaagaataccctgaaggatcacatgcgtaagaaacagcatagaaagattaatcccaagaacagggagtatgatcgattttatgtgattaactacctggtcaggttatcctttcataatctcaaatttgattgttctacagctaataagatctttctgcgtaccaattag

SEQ ID NO: 141306 - DNA, 1428 bp, Artificial Sequence
  Description of Artificial Sequence: Synthetic coding sequence
atgagccggcgcaaagccggctcagcacccagaagagtagaaccagctccagccgccaacccggacgacgagatggaaatgcaagatcttgtcattgagctaaagccagagcccgatgcccaaccccagcaagcgccacgcctgggaccattctctccgaaagaggtgtctagtgccggacgcttcggtggagaaccccatcattccccggggcccatgcccgcgggagccgcactcctggcactgggcccaaggaatccgtggacactgtggacacctctgactccaaactatcccgatcgacagccttggaccgataagcatcctgatctgctgacgtgcgggaggtgtctccagacctttcctctagaagctatcaccgctttcatggaccacaaaaaacttggctgccagttgtttagaggtccatcccgcggacaagggagtgagagagaggaacttaaagcgctgtcctgcctgcggtgcggtaagcagttcaccgtggcatggaagctcttacgtcacgcacagtgggatcacggcctcagtatctaccaaacagagagtgaagcaccagaggcgcccctgctagggctcgctgaggtagctgccgccgtgtcagctgttgtgggacccgctgccgaggcaaagagtccaagagcttcagggtcgggtctgaccaggcgcagcccaacatgcccagtgtgtaagaaaactctgagctccttcagtaacctgaaagtgcacatgcgcagccataccggcgagcgcccttacgcctgcgaccagtgcccctatgcctgtgcccagtccagtaagctgaatcgccataagaagactcaccggcaggtgcctccccaaagtcccctgatggcggacaccagtcaggaacaagcatccgcagccccaccagagccagctgtgcacgccgctgcacctacaagtaccctgccgtgcagtgggggggagggagcgggcgctgcagccactgctggtgtccaggaacctggtgcacctggctctggcgctcaggcagggccggggggagacacttggggcgccatcactacagagcagcgcactgacccagccaactcacaaaaggcctctccaaagaagatgcctaaaagcggggggaaaagtagaggccccggtggctcatgtgaattctgtggcaagcattttacaaactcgtctaatttgaccgtccaccgaagatcacacaccggcgaacgaccatatacttgcgagttttgtaactatgcttgcgcccagtcctcaaagctcaatcgacaccgtaggatgcatgggatgactcccggcagcactcgtttcgaatgtccacattgccacgtcccattcggcttacgggcgacactggacaagcatttaaggcaaaagcaccccgaagctgccggagaggcttag

SEQ ID NO: 141307 - DNA, 1356 bp, Artificial Sequence
  Description of Artificial Sequence: Synthetic coding sequence
atggaaatgcaagacctggtgatcgagctcaagcctgagcccgacgcccagccgcagcaggccccgcggcttggccccttctcccctaaggaggtctctagtgctggcagatttggcggagagccacatcatagtccagggcccatgcccgccggggccgccctgctcgctctgggaccccggaatccatggacactgtggactccacttactcctaattacccagacagacagccttggaccgacaaacatcctgatctcctcacctgcggccgatgcctgcagacattcccactggaagccattacggcctttatggaccacaagaagcttggttgtcaactgttccgcggcccctcacgaggacaggggtcggaaagggaggaactcaaagctctgagctgtttgagatgcgggaaacagtttacagttgcttggaagctgctgaggcacgcacagtgggatcacggcctgtctatatatcaaaccgaatctgaagctcccgaagctcctctgctgggcctcgccgaggttgccgccgctgtctctgcagtggtgggacctgcggcagaagcaaagagcccaagggcgagcggttccggtcttactaggaggtctcccacgtgtccagtgtgcaaaaagaccctgtcttcattttccaaccttaaagtgcatatgagatcccacactggtgaaaggccctacgcatgcgaccagtgcccctatgcctgcgctcagagcagcaagctgaaccggcacaagaaaactcaccgccaggtgccccctcaatctcccctcatggcagatacttcccaagagcaagcctcagcagccccgcccgagcccgcggtacacgcggccgcgcctacctcgactttgccatgtagtggtggagaaggagccggggctgccgcgaccgctggtgttcaggaacctggggctccagggtccggagcccaggccggcccaggcggagatacttggggcgccatcactacagagcagaggacggacccggcaaactcccagaaagctagccccaagaaaatgcccaagagcggcggaaaatccaggggaccgggcgggagctgcgaattttgtggcaaacacttcacaaactcctccaacctcaccgttcacagacggtcacacaccggggaaaggccgtacacctgtgaattctgtaattatgcctgtgcccaatccagcaaactgaatcggcacaggcgtatgcatggcatgacccccggttccaccaggttcgaatgtccccactgtcacgtgccatttggactgcgcgcaaccttggacaaacacctgagacagaagcatccggaagccgcaggcgaggcatag

SEQ ID NO: 141308 - DNA, 1341 bp, Artificial Sequence
  Description of Artificial Sequence: Synthetic coding sequence
atggagacacaggctgacctcgtgtcccaggagccacaggctctccttgacagcgctctgccctcaaaagttccagcattcagcgataaagatagccttggcgacgaaatgctggctgctgctctactgaaggcaaaaagccaagaattggtaacattcgaggatgtggccgtctatttcatccgcaaagagtggaaacgtctcgaacccgcgcaacgggacctgtatcgggacgtgatgttggagaattacggaaacgttttctcactagatcgcgagactcggacggagaacgatcaagaaatatctgaagataccaggtcccatggggtgcttttgggcaggttccagaaagatatatcgcagggcctgaaatttaaagaggcctatgagcgcgaggtgagcctaaagcggcccctgggcaacagccctggcgaacggctcaacaggaaaatgcctgattttggtcaggtgaccgttgaggagaaactgaccccacggggagaaagatccgaaaagtacaacgacttcggtaacagctttactgttaacagcaatctgatttcccaccaacgcttgcctgtgggtgatagaccacacaaatgtgacgaatgttcaaagagcttcaaccggaccagcgacctcattcagcatcagcgcattcatacgggcgaaaagccctacgaatgcaacgaatgtgggaaagccttctcgcagtcatcccacctaatccagcaccaacggattcatacaggggagaagccctacgagtgttcagactgcggtaaaactttttcatgcagtagcgccctgatcttgcaccggaggatccataccggtgaaaagccttatgaatgtaacgagtgcggtaaaaccttctcttggtcatccacgttgacccaccaccagcgcattcatacaggagagaaaccttacgcgtgtaacgaatgtgggaaagcgttttctagatctagtacattgattcaccaccaacgcatccatactggagagaagccctatgaatgtaatgaatgcggcaaggcttttagccagtcaagtcacttatatcaacaccagaggatacatacaggtgaaaaaccgtacgaatgtatggaatgtggaggtaagtttacatacagttccggtctgattcaacaccaacgcatacatacgggagaaaacccttacgaatgcagtgagtgtggtaaagcctttaggtacagttccgcgctggtgagacaccagcgtatacatacaggcgagaagcccctcaacggcatcggaatgagtaagtcgagcctgcgcgttaccactgagctgaacatcagggaaagcacttag

SEQ ID NO: 141309 - DNA, 1341 bp, Artificial Sequence
  Description of Artificial Sequence: Synthetic coding sequence
atggagactcaggccgacctagtgtcccaggaacctcaagcactgctggattcagctttacccagcaaggtgccagccttctctgataaggacagtctgggagatgagatgctggctgctgcattgttaaaggctaaatcgcaggagttagtcacatttgaagatgtcgccgtgtacttcatacggaaagagtggaagcggcttgaacccgcccagcgcgacctttaccgcgatgtaatgttagaaaactatggcaatgtgttttccttggacagggagacccggaccgaaaatgaccaagagatcagtgaggacactaggtcgcatggcgtactcctgggtaggtttcagaaagacatctctcaggggcttaaatttaaggaggcgtacgagagagaggtgagcctcaagcggccactggggaactcccctggggagcgcctcaacagaaagatgcctgatttcggtcaggtgactgttgaggaaaagctaacaccacgtggcgagcgatccgaaaaatataatgattttggcaactcttttacagtgaattccaacttgatcagccatcagcgcttgccggtgggcgacaggcctcacaagtgtgacgaatgcagtaagagctttaaccggacttccgatttgatacagcaccaaagaattcacacgggcgagaagccctatgaatgtaacgaatgtggaaaagcgttttcccagtcatcacatcttatccaacaccagagaatccataccggtgaaaagccctacgaatgttctgactgcggcaaaacattcagctgttcttctgccttgatacttcatcggagaatccacaccggagagaagccatacgagtgtaacgagtgcggcaagacattctcttggagctctacgctgacccaccaccagagaatccacacaggagagaagccatatgcctgtaacgagtgcggcaaagcctttagccgttctagtaccctcatccatcaccagcgaattcatactggcgaaaaaccatacgagtgcaacgagtgcggcaaagccttcagccaaagttcacatctgtatcagcatcagcgcatccacacgggcgagaaaccgtacgagtgcatggagtgtggcgggaaattcacctattcatctgggttgatacagcaccaacggatacatactggggagaatccgtacgaatgctctgagtgcggaaaagccttcagatacagctctgctcttgtcaggcatcagcgtattcacacgggtgagaaacctctaaatgggataggaatgagcaagtccagtctcagggttactaccgaactcaacattagagagagcacttag

SEQ ID NO: 141310 - DNA, 396 bp, Artificial Sequence
  Description of Artificial Sequence: Synthetic coding sequence
atggagacacaggcagatctggtgagccaagaaccacaggccttgctggacagcgcattaccatccaaggtccctgcctttagcgataaagactctctgggggatgaaatgctcgctgcagctctgctaaaggcaaagagtcaggagctggtgacgttcgaagatgtggccgtctacttcatacggaaggagtggaagcggcttgagcctgctcagagagacctatatagagacgtcatgctcgagaactatgggaacgtcttctctctggattggatccacgtatgtttgacgacacagaaggttatgctggcatggctcacaggcaccctgtccgtggctaagggcctgtgttcaagtgaactggcaagcgttgaaccccctgacactttttag

SEQ ID NO: 141311 - DNA, 315 bp, Artificial Sequence
  Description of Artificial Sequence: Synthetic coding sequence
atggagacacaggcagacctggtcagccaagagcctcaggcacttttggattccgctctgccttctaaggtccctgctttctccgacaaggatagtcttggggacgagatgctggcggcagcattgctgaaagctaaaagccaggagcttgtgactttcgaggatgttgctgtctacttcataaggaaagagtggaaacgattggagcccgctcagcgggatctgtatcgcgatgtcatgctggaaaactacgggaacgtgttctctcttgaccgggaaactagaactgaaaatgaccaggagatctctgaatag

SEQ ID NO: 141312 - DNA, 1341 bp, Artificial Sequence
  Description of Artificial Sequence: Synthetic coding sequence
atggagacacaggcagacttggtttcacaggagccgcaggcactcttggactctgcactgccaagtaaggtacctgctttttctgacaaggacagcctcggagatgaaatgctggctgccgctctgttaaaagccaagagccaggagctggtgacgtttgaggacgtggccgtgtactttattcgtaaagaatggaagaggcttgagcccgcacagcgtgacctctatcgtgacgtcatgcttgaaaactacggtaatgttttttccttggaccgagaaaccagaaccgagaacgaccaagaaatttccgaggacacccgctctcatggcgtgctgctgggtcgatttcagaaagatatctcccagggcctcaagtttaaagaggcttatgaacgcgaggtttcgcttaagagaccacttggcaactccccaggcgaaaggttaaatcgaaaaatgcccgattttggccaggtgaccgttgaggaaaagctcactcccagaggcgaaagaagcgagaagtacaacgactttgggaatagtttcacagtcaatagcaacctgatatctcatcagcggttgccagtaggtgacaggccccacaaatgtgacgagtgcagcaaaagttttaacaggacgtctgatttaatccaacaccagcgcatacacacaggggagaagccttatgagtgcaacgagtgcggaaaggccttttctcagtcttcccacctgatccagcatcagcgcatacacaccggggaaaagccgtacgaatgttctgattgcggcaaaaccttctcctgctccagtgccctaatccttcaccggcgaatacacacaggagaaaagccatatgagtgcaatgaatgtggaaaaaccttcagctggtcttcaacactcacccaccaccagcgcatccatacaggggaaaaaccatatgcttgcaatgagtgcggaaaggctttttccagatcatcaacacttatacaccatcaacgtatccacacaggggagaagccctacgagtgtaacgagtgtgggaaggccttctctcagtcttctcacctgtaccagcaccagaggatacataccggggaaaagccttacgaatgtatggaatgcggagggaagttcacctattcgagcggcctgattcagcaccagagaatccacacgggtgaaaatccctacgagtgcagtgagtgcggcaaggcctttagatattcctctgcactcgtgcgtcatcagcggatccataccggagaaaaaccactgaacggaattggcatgtctaagtcctccttaagagtgactactgagcttaatattcgggaaagtacttag

SEQ ID NO: 141313 - DNA, 558 bp, Artificial Sequence
  Description of Artificial Sequence: Synthetic coding sequence
atggaaactcaggcagatctggtctcacaggagccacaggcactgttagactccgcactccccagtaaagttcccgcctttagtgataaggattcgctaggggatgaaatgctggcagcagcattactgaaggccaaaagtcaggaactcgtgacgtttgaggacgtggcagtctatttcatccggaaagagtggaaacggttggagcctgcacagagagacctttaccgagatgtgatgctggagaactacggcaatgttttctcgttagaccgagagacccgtactgagaacgaccaggagataagtgaggatacgcgcagtcacggtgtgctgctcggtcggttccagaaagacatatcacaggggctgaaatttaaagaagcatatgaaagggaagttagcctcaaaagacccctggggaacagtcccggagagaggctgaatagaaaaatgcctgattttgggcaagtgacggttgaggaaaaactgactcccaggggggagagatcagagaaatacaacgacttcgggaactcattcacagtcaattcctag

SEQ ID NO: 141314 - DNA, 558 bp, Artificial Sequence
  Description of Artificial Sequence: Synthetic coding sequence
atggaaactcaagccgatctggtcagtcaggagccccaggcgttgctagactccgccctacccagcaaagtccctgccttctccgacaaggattccctgggcgatgaaatgttagcagccgccttgcttaaggccaagtcccaagaactagtgacctttgaagacgttgctgtctattttatccgtaaggagtggaagagactggagcctgcgcagagggacctgtaccgggatgtgatgctggagaactacggtaacgtattttcactggaccgggaaaccagaactgaaaatgatcaggagatttctgaggacacacgcagtcatggagtgctgctgggcaggtttcaaaaagacatttcccaaggactgaagtttaaagaggcttacgaaagggaagtttcccttaagcgtccgctgggcaactcacctggagagcgtctcaaccggaaaatgcctgattttggccaggtcaccgtggaggagaaactcacgcctcgaggagagcgtagcgaaaaatataacgactttggcaatagtttcaccgtcaacagctag

SEQ ID NO: 141315 - DNA, 1509 bp, Artificial Sequence
  Description of Artificial Sequence: Synthetic coding sequence
atggggactgaaaacaaggaggtgataccgaaagaagagattagcgaggagtctgagccccacggctccctacttgaaaagttccctaaggtggtataccaagggcacgaatttggtgctggctgcgaggaggatatgctcgaaggacacagcagggagagtatggaagaagttattgaacaaatgtctcctcaggagcgggatttcccttcaggtctgatgatttttaaaaagtcgccatcaagtgaaaaagatagggaaaataatgagagcgaacgggggtgtagtccaagccccaacctggtaactcatcagggggacaccaccgagggtgtgagtgcctttgccactagcggtcagaatttcctggagattctggagagcaataagacacagagaagcagtgtcggcgaaaagcctcatacatgtaaagagtgcggaaaggcatttaatcagaattcccacctgattcagcacatgagggtgcactcaggcgaaaaaccattcgaatgtaaagagtgcggcaaaacttttgggaccaactcttctttaaggcgccatttgagaatacacgccggcgagaaacctttcgcttgcaatgaatgtgggaaggcgttcatccagagctctcacctgatacaccatcaccgcattcacaccggcgagaggccatataagtgcgaggagtgcggcaaggccttctcacaaaattctgcccttatcttacatcagagaatacataccggcgagaagccctatgagtgcaatgagtgcggaaagacttttcgcgtctctagccagttaattcagcatcaaagaattcatactgaggagcggtaccatgaatgcaacgagtgtgggaaagccttcaaacattcaagtggcttaattcgtcaccaaaagattcacacaggggaaaagccttatctttgcaatgaatgcggcaagggcttcggacagtcatccgagctgattaggcaccagaggatacacacaggggataaaccgtacgaatgcaatgagtgtggcaaaaccttcggccagaatagcgaaatcatccgacacattaggattcacaccggcgaaaagccttatgtgtgtaaagagtgtgggaaggcattccgtgggaattctgagctcctgaggcacgagagaatccacactggggagaagccctatgagtgctttgaatgcggaaaggcatttcgaaggacatcacacctgatcgtgcatcagagaatccacaccggggaaaagccacaccagtgcaacgagtgtgcacggacgttttgggacaatagtgaactcttgctgcaccaaaagattcatatcggggaaaaaccttacgagtgcagcgagtgcgaaaaaaccttctcgcaacattcccagctgattattcaccagcgaatccatacaggcgaaaaaccatatgaatgtcaggagtgccagaagactttcagcagaagcagccacctgctgcgccaccagtctgtccactgtatggaatag

SEQ ID NO: 141316 - DNA, 1815 bp, Artificial Sequence
  Description of Artificial Sequence: Synthetic coding sequence
atgatgaagtcgcagggactggtgagcttcaaggatgtagctgttgatttcacccaagaagaatggcagcagctggacccaagtcagcgaaccctgtatagagatgtgatgctggaaaactatagccaccttgttagtatgggctaccccgtgagcaagcccgacgtgatctcgaaactggagcagggggaggaaccgtggatcataaagggagacattagtaactggatctaccccgacgagtatcaagcggacggccgtcaggatagaaaaagcaatctgcacaatagtcagtcatgcatcttgggaacggtgtccttccatcataagattctcaagggtgtgactagggatggatccctgtgttctatattgaaggtctgtcagggggatggacagctgcagagatttctcgaaaatcaggacaaactgttccggcaagttaccttcgtcaattcaaaaaccgtgaccgaagcatcaggacataagtataacccactgggcaaaatcttccaggagtgcatcgagacagatatttccatccagcgcttccacaaatatgatgccttcaagaagaatctcaagccgaatattgatctccccagctgttataagtcaaactccagaaaaaaacctgaccagagcttcggtggtggtaagagcagttcacaatctgaacctaactcgaacctggagaagatccacaacggggtgatcccattcgatgacaatcaatgtggcaacgtgtttcggaatacgcagtccttgatccagtatcagaacgttgagacaaaagagaagagctgcgtttgcgtgacctgtggaaaggctttcgcgaagaagtcccagcttatcgttcatcagagaatccatactggaaagaaaccttacgactgtggcgcttgcggaaaagccttctccgaaaaattccatctagtggtccaccagcggacgcatactggagagaagccctatgactgttctgagtgtggaaaagctttttcacagaagtcatccctaatcattcatcagcgggtccataccggcgagaagccctatgagtgttccgaatgtggaaaagcttttagccagaagtcgccgctcatcatccatcagaggatacacacaggggagaagccatacgaatgcagagagtgtggaaaagcattcagccagaaatcccagctgattatacaccatcgtgcgcacaccggggaaaagccgtacgagtgcacggaatgtggcaaagcattctgtgaaaagagtcatctcatcatacataaacggatccatacaggtgaaaaaccttacaagtgtgcgcagtgtgaagaagcgttcagcaggaaaactgaattgataactcaccagctcgtccacaccggcgagaagccctatgagtgcactgaatgtggtaagacattcagccggaagtctcagctgatcattcatcagaggacccacaccggggaaaagccatacaagtgctcggaatgtggaaaggccttttgccagaagtcccatcttattggccaccaacggattcatacaggagagaagccatacatttgtacagaatgcggcaaagctttctctcagaagagtcacttgcctggacatcaacgcatccacacgggcgaaaagccatacatttgcgctgaatgcgggaaggcgttctctcagaagtccgacctggtgctgcaccagaggatccacactggtgagcggccctatcaatgcgccatttgcggaaaggcctttatccagaaatctcagcttacggtgcaccagaggattcacacagtggtgaaatcttag

SEQ ID NO: 141317 - DNA, 1815 bp, Artificial Sequence
  Description of Artificial Sequence: Synthetic coding sequence
atgatgaaatcccaagggttggttagctttaaagacgtcgctgtcgactttacacaggaggagtggcagcagttggacccttctcaaagaaccctttatcgggatgtaatgttagaaaactactctcatctggtgtccatgggttacccagtcagcaaaccagacgtcatttctaagttggagcagggagaagagccctggataataaagggcgatattagtaactggatatatcccgatgagtaccaggccgacggccgtcaggggaaaaagtctaaccttcataattcccaaagctgcattcttggtaccgttagctttcatcacaagatcctcaaaggagtgactcgcgacggcagcttatgctctattctgaaagtgtgccagggcgacggtcaattgcagaggtttctggaaaaccaggacaagttgtttcgtcaggttaccttcgtgaattctaagaccgtcacagaagctagcgggcataagtacaatcctctggggaagatcttccaggaatgcatcgaaaccgacatctctatccagcgtttccataagtatgacgccttcaaaaagaatctgaagccgaatattgacctcccaagctgttacaagagcaacagccgcaagaaacccgaccagtctttcggcggcgggaaatccagttcacagtcagaacctaattccaacttagaaaaaatccataacggggtaattccgttcgacgataaccagtgcggcaacgtcttcaggaatactcaaagcctgattcagtaccaaaatgtagagacaaaagagaagtcatgtgtgtgcgtcacttgtggaaaagcgtttgcaaaaaaaagccagctcatagtacaccaaagaattcatacaggcaagaaaccctacgactgcggcgcctgtggcaaagctttctccgaaaagttccacctcgtcgtgcatcaacgcacgcatacaggagaaaaaccctatgattgttcagagtgcggcaaagcttttagtcaaaaaagttccctcatcatacaccagcgcgttcacaccggagagaaaccctatgaatgctccgagtgtggtaaggctttttctcagaagtctccacttatcattcaccagcgcattcatacgggggagaagccttatgaatgtcgggagtgcggtaaagcattttcccagaaatctcaattgataatacaccaccgcgcccatacaggggagaaaccttatgagtgcacggaatgcggcaaagctttctgtgaaaagagccaccttataatacataagcgaattcatacaggagagaaaccctataaatgtgcacagtgcgaagaggcattctcccggaaaactgaactgattacccatcagctggtgcatactggagaaaagccctacgagtgtaccgaatgtggtaagactttctcaagaaaaagccagcttatcattcatcagcgcacccatactggcgagaaaccatacaagtgcagtgagtgtggcaaggccttctgtcaaaagagccatttaatcgggcatcagcggattcacactggcgagaagccatatatctgtactgagtgtggaaaagctttctcacagaagagccatctgcctgggcaccaacggatccataccggagagaagccatatatctgtgccgagtgcggtaaggcgttttctcagaaaagcgacttggtgttacatcagcggatccatacaggggagagaccctaccagtgtgctatatgcggcaaagccttcattcagaagagtcagctcactgtccatcagcggatccacaccgtggtgaaatcttag

SEQ ID NO: 141318 - DNA, 1707 bp, Artificial Sequence
  Description of Artificial Sequence: Synthetic coding sequence
atgctcgaaaattattctcacctggtctccatgggatatcccgtgtcaaaacccgacgttatatctaaactggagcaaggcgaggagccctggattataaaaggtgatatatccaattggatttaccccgatgagtatcaggccgacgggagacaggaccgcaagagcaatcttcacaattctcaaagttgcattctcggaactgtgagtttccaccacaagattttgaaaggggtgacgagggacggaagtctttgctccatactgaaggtgtgccagggtgacgggcagctacagaggtttctggagaaccaggacaagttgtttcgacaggtaacgtttgtgaatagcaagactgtgactgaagcctctgggcacaagtataatccactcggcaaaatttttcaggagtgcattgaaacggatatctctatccaaaggttccataaatatgatgccttcaagaaaaacctcaaaccgaacattgatctgccaagttgctacaaatctaactctcggaagaaacctgatcaatccttcggggggggcaagagcagctctcaatcagagccaaactctaacctcgagaagatacataatggggtgatccccttcgacgataaccaatgcggcaatgtattcagaaacacccagagtctgatccagtaccagaacgtagagactaaggaaaagtcctgtgtgtgcgtgacctgtggcaaagcctttgctaaaaaatctcaattgatagtgcaccagagaattcataccggcaagaagccatacgattgcggcgcatgcggtaaggcattctcagagaaatttcatctcgttgtgcatcagcgtacccatactggcgagaagccctatgactgcagcgagtgtggaaaggccttcagccagaagtcaagtttaatcatccatcagcgggtgcacactggagaaaagccttacgagtgtagtgaatgtggaaaagcttttagtcagaaatctccacttattattcaccagcgtatccacactggtgagaagccttatgaatgccgagagtgcggcaaggcattctcacagaaaagccaactgattattcaccacagggcacacacgggagaaaagccctacgaatgcaccgaatgtggcaaagccttctgcgagaagtcgcacttaattatacataaaagaatccacacaggggagaagccttataagtgtgctcagtgtgaggaagccttcagccgaaaaaccgaactgatcacccaccagctcgtacacacaggagagaaaccgtacgagtgcaccgagtgtggcaagactttctccaggaaatcacagctgatcatccatcagcggactcacaccggggaaaagccttacaaatgctctgagtgcggcaaggctttttgccagaaatcgcatcttatcggccaccagcggattcacaccggagagaagccttacatttgtaccgaatgcggaaaggccttttcacagaagagtcatcttcccgggcaccagaggatccacacaggcgaaaagccctatatctgcgcggagtgcggcaaggcattttcacagaaatcggacctggtcctgcatcagcgcatccacactggcgaaagaccctatcagtgtgccatttgcgggaaggcttttattcaaaaaagtcagctgactgtacaccagagaatccatactgtggtcaagtcctag

SEQ ID NO: 141319 - DNA, 1863 bp, Artificial Sequence
  Description of Artificial Sequence: Synthetic coding sequence
atggtgccagcagagacctcttcatctgggcttctcgaagagcagaagatgatgaaatcacaaggattagtttcatttaaggacgtggcagtcgatttcacccaggaggaatggcaacagctggacccctcacagcgcaccctctaccgggatgtgatgctcgagaactactcacacctcgtctcaatgggatatccagttagcaaaccagacgtaattagcaagctcgagcagggagaagagccatggataattaaaggagacatttctaactggatctatccagacgagtatcaggcggatggaaggcaggataggaaatctaacctgcataactctcaatcatgcatccttggaactgtgagcttccatcataaaatattgaaaggcgtgacacgtgacggttccctctgcagcattcttaaggtctgtcagggcgatgggcagctccagcgtttcctggaaaaccaagacaaactgttcagacaagtgacctttgtgaatagcaagactgttacagaggcttctggccataaatacaatcctttggggaagatttttcaggagtgcatagaaaccgacatctccattcagaggtttcataaatacgatgccttcaaaaagaatctgaagcccaatattgacctaccaagttgctacaagtcgaattctaggaagaaacccgatcagtcctttggaggcgggaaaagctcctctcagtctgagccaaactcaaatttggagaaaattcacaatggggtgattccatttgatgataaccagtgcgggaacgtatttaggaacacacagtccctgatacaatatcaaaatgttgaaacaaaagagaagagctgcgtctgtgtgacgtgtggaaaggcatttgccaagaaatcacagcttatcgtccaccagagaatccataccggcaaaaaaccctacgactgtggcgcttgtggtaaagcattcagcgaaaagttccatctagtcgtccaccagcgtactcacaccggcgagaagccatatgactgtagcgagtgcggcaaggcatttagtcagaaaagttctctgattatccaccagcgagtgcatacaggcgagaagccttacgagtgcagcgaatgcggcaaggcttttagtcagaaatcacccttgatcatccaccagagaatccacactggtgagaagccatacgagtgccgcgaatgcgggaaggccttttcccaaaaaagccagcttatcatccaccaccgagcccacactggagaaaagccatacgagtgcacagaatgcgggaaagctttctgtgaaaagtcacacctgatcatccacaagcggattcacactggggagaaaccctacaaatgcgcccagtgcgaggaggcgttcagcaggaagacagaattgattactcaccagttggttcacacaggcgaaaaaccttacgagtgcacagagtgtggaaagacgttcagtaggaaaagccagctaattatccaccagcggacacatacgggggagaagccttacaagtgttccgaatgtggtaaggcattctgccagaaatctcatctgatcgggcaccagaggattcacaccggtgagaaaccatacatctgcaccgaatgtggaaaagcattctcccagaaatcacatctacccgggcaccagcggatccatactggcgagaagccgtacatctgcgcggagtgcggcaaagccttttcccagaaatctgacctcgtactgcaccaacgcattcacacaggcgaaaggccctatcaatgtgccatctgtggtaaagcattcatccagaagagtcagctgacagtgcaccagcggatacacaccgtcgtgaagtcttag

SEQ ID NO: 141320 - DNA, 1980 bp, Artificial Sequence
  Description of Artificial Sequence: Synthetic coding sequence
atggctgccgccgtgctcatggatcgcgtccagagctgcgtgacttttgaagacgtattcgtctattttagccgggaagagtgggagctgcttgaagaagcacaaagatttctgtaccgggatgtgatgctggaaaatttcgcacttgtggcaacactgggcttctggtgcgaagccgaacacgaagctccttcagaacagagtgtctcagtggagggagtgagtcaggtgcggactgccgagagcggattgtttcaaaaggcacacccctgcgagatgtgcgacccattgctgaaggacatcttacaccttgctgagcaccaggggtcgcaccttacccagaagttgtgtactcgaggcctgtgtagacgaaggttttcattcagcgccaacttctatcagcatcagaagcagcacaatggcgagaattgcttcaggggcgacgatgggggcgcttctttcgtgaagtcatgtaccgtgcatatgctcggccggagtttcacctgcagagaagaaggtatggatctgccggattcatctggtctgtttcagcaccagacaacatacaatagggtgtctccttgtcgaaggaccgagtgcatggaatctttcccccattcaagtagcctaaggcagcaccagggcgattacgacggacagatgcttttttcctgtggagacgaaggtaaggccttcctggatacttttaccctgctcgatagccagatgacccacgcagaagtgcgtccatttcggtgcctgccctgtggaaacgtctttaaagagaaaagcgctctcattaaccatcgaaagatccactcaggcgagatctctcacgtgtgcaaggagtgcggcaaagcgttcattcacctgcatcacctgaagatgcaccagaagtttcataccggcaaaagacattatacgtgctctgaatgtgggaaagcctttagccgaaaggacacacttgtgcagcatcagcgcgtgcacaccggcgaacggtcttatgattgttctgagtgcggcaaggcgtattcacgatcctctcacctcgtgcagcaccagagaatccatacaggcgagagaccctataaatgtaacaagtgcggcaaagcatttagtaggaaggataccctagtccagcatcagaggtttcacacgggcgagcgcccgtatgaatgctccgagtgcggcaagttcttctcccagagcagtcatctgatcgagcactggagaatccacaccggggctcgtccttacgaatgcatcgaatgcggaaagttcttttctcacaactcctcccttatcaaacacaggcgtgtgcataccggcgccagatcatacgtgtgctcaaagtgtggaaaggcattcggctgcaaagacaccctggtgcagcaccagataattcacacaggagctcgcccctacgaatgctctgaatgcggcaaagccttcagtaggaaggacaccttggtacagcaccagaaaatccacactggagagcgtccgtacgagtgtggggaatgcggaaaattcttttcacattcatccaatctcatcgttcatcagaggattcacactggcgcgaagccctatgaatgtaacgagtgcggaaagtgctttagtcataacagctccctgatcctgcaccagagggtgcataccggagcgagaccctacgtatgttccgagtgcggtaaggcgtacatctctagttctcacctggtacagcacaagaaagtccacaccggagcacgtccgtacgaatgctccgagtgcgggaagttctttagccgaaattccggactgattctgcaccaacgcgttcacacgggggaaaagccctatgtttgttcagagtgtggcaaagcatatagcaggtccagccacctagttaggcaccaaaaagctcacacaggggaacgtgcccacgaatgtaattcgtttggcggccctctggccgctagcctgaagctggtttag

SEQ ID NO: 141321 - DNA, 1980 bp, Artificial Sequence
  Description of Artificial Sequence: Synthetic coding sequence
atggcagcagccgtcctaatggacagagtgcagagctgcgttaccttcgaagacgtgttcgtgtactttagccgggaggaatgggaactattggaggaggctcagagatttctgtatagagatgtcatgctcgagaacttcgcattggttgccacactgggattctggtgtgaagccgagcatgaagcaccctcagaacaatcagtctcagtcgaaggcgtgagtcaagtacgaacagcggagtctgggctattccaaaaagcgcacccatgtgaaatgtgtgacccactgctcaaggacatattgcacctggccgagcaccaggggtctcacctgacacagaagctgtgcacacggggtctctgtcgccgacggttttctttcagcgccaacttttatcaacatcagaaacaacataatggggagaattgctttaggggagatgacgggggagcatcctttgtcaaatcttgcacagtgcacatgctcggtagatcatttacctgccgggaggaggggatggacctgcccgactcatccgggctctttcagcaccagacaacttacaacagagtgtccccatgccgtcgcaccgagtgtatggaatcttttccacatagtagtagccttcgtcagcaccagggagattacgatggacaaatgctcttctcctgcggtgacgaggggaaagcctttttagatacattcaccttgctggacagtcagatgactcacgcagaagtcaggccttttaggtgtttaccctgtggcaacgttttcaaagagaagtctgccttaattaaccacaggaagatccactctggcgagatctctcatgtttgcaaggaatgcggcaaagcattcatccatctgcatcacctcaagatgcaccagaagtttcatactggcaaacgccactacacctgctctgagtgcggcaaagccttctccagaaaggatacgctggttcaacatcagcgggtccatacaggcgaaaggtcttacgattgctcagaatgcggcaaggcttatagcaggagtagtcatctggttcagcaccagagaatccacacgggcgagcgaccttataagtgtaacaagtgcgggaaggctttctcccgtaaggataccctcgtgcagcaccagcgctttcacaccggtgaaaggccctacgagtgtagcgagtgcgggaaattcttcagccagtcgtcacacctgatagagcattggagaatccacacaggggcccgcccttacgaatgtattgagtgcgggaagttcttcagccacaattctagcctgataaagcataggagggtgcacacaggcgccaggagctacgtctgttccaaatgcggtaaagcatttgggtgcaaggacacccttgtgcagcaccagattatccatacaggagcccgcccgtacgagtgctctgagtgcggtaaggccttttcgcgcaaggacacactggtgcaacaccagaaaatccacaccggagagcggccctacgagtgcggcgagtgtggcaagtttttctcccactcgtctaacttgatcgtgcatcagagaatacacacgggggcaaagccatacgaatgtaatgagtgtgggaaatgcttttcccataactcctccttgatcttgcaccagcgcgtgcatacaggcgcacgcccatacgtatgtagtgagtgtggcaaagcctatatcagcagtagccatttggtacagcataagaaggttcataccggggcacggccatatgaatgtagcgagtgcgggaaattcttcagccgtaacagcggactaatcctacaccagagagtccataccggcgagaagccttatgtgtgttcggagtgtgggaaggcttattctcggagttcacacctggtccgtcaccaaaaagcacataccggggaacgtgctcacgagtgtaacagcttcgggggcccacttgccgcctccctgaaattggtgtag

SEQ ID NO: 141322 - DNA, 2121 bp, Artificial Sequence
  Description of Artificial Sequence: Synthetic coding sequence
atggctgcagctgtgctaatggacagggtgcagagctgtgtgaccttcgaagatgttttcgtttacttctctcgggaagagtgggaactcctggaggaagcgcagcgattcctgtaccgagacgtcatgctggaaaacttcgccttagttgccactctcgcctttatttttcccgtgccatgctcctgtgctgttgggggcggccggaaaccctgggtccccgatcgcgcggatatcaccgccgcgactgtgaaagagacctatagaggtcatggtcctgccgaatgggagctggaagaaggtttctggtgcgaagctgaacatgaggcacctagcgaacagtctgtttctgtagaaggtgtctcgcaggtgcgcacagctgagtccggactgtttcagaaagcccacccctgtgagatgtgcgaccctctcctgaaggacattctgcatctggccgaacatcaggggtctcacctgacgcagaagctctgcactcgtggtctgtgtcgcaggcggttcagcttcagcgccaacttttatcagcaccagaagcagcacaacggagaaaactgctttcgcggagatgatggcggcgcctctttcgttaagtcatgtacagtgcatatgttgggccggtccttcacctgtagagaggaggggatggacctgcccgacagcagcggactgttccaacaccagacgacctataatcgggtgtccccttgtcgtagaacagagtgtatggaatcatttccacacagctcctccctgcgacagcaccaaggcgattatgatggtcagatgttgttcagctgcggcgacgagggaaaagccttcctcgacacttttactttactcgatagtcagatgactcatgcagaagtaaggcctttccgttgcctcccttgcgggaacgtgttcaaggaaaaaagtgccctgattaaccaccgcaaaatccactccggcgaaatctcgcatgtatgcaaagagtgcggcaaggcgttcattcacctgcaccatctcaaaatgcatcagaaattccacaccggcaaaagacattacacctgctctgagtgcgggaaagccttttcccggaaggatacactggtgcaacatcagcgggttcacaccggcgagcgatcttacgactgttccgagtgtggtaaggcatactcacggagctcccatttagtccaacatcagcgtattcacacaggggaacgcccgtataaatgcaacaagtgcggcaaagctttcagccgaaaagacaccctcgtgcaacaccagagattccatacaggcgaacgcccatacgagtgcagtgaatgcggcaagtttttttcccagtcatcgcatctcatagaacattggaggattcacacaggcgccagaccctacgaatgcattgagtgcggcaaattttttagccacaactcatctcttattaagcatcgccgggttcacacaggtgctagaagttacgtgtgcagcaaatgcggcaaagccttcggatgtaaggatactcttgtgcaacaccagattatacatactggcgctagaccttatgaatgttctgaatgcgggaaggcattcagcagaaaggataccctggtccagcaccagaagatccacaccggtgagaggccttatgagtgtggagagtgtggtaagttcttctcccattcatctaatttgatagttcaccagagaatccacactggcgcgaagccatacgagtgcaatgaatgcgggaagtgtttctctcacaactcctcgcttatcctacatcagcgtgtccatacaggcgcgcgcccgtacgtctgtagcgaatgcggtaaggcctatatctccagttcccacctggtccagcacaaaaaggtgcacacaggggctagaccatatgagtgtagtgaatgtgggaagtttttcagcaggaacagcggactaatcctgcaccagagggtgcacaccggcgaaaagccttatgtctgttctgaatgcggaaaggcctattctaggtcctcccatctcgtccgacaccaaaaggcccacaccggagaaagggcccacgagtgtaatagctttggggggcccttggccgcatcattaaagttagtgtag

SEQ ID NO: 141323 - DNA, 1788 bp, Artificial Sequence
  Description of Artificial Sequence: Synthetic coding sequence
atggctgctctctcaccgacttttgcgacatccacccaggactccacttgtctgcaagactccgagttccctgtgtcttccaaggatcactcatgcccacagaacttggatctttttgtctgttcgggactggaaccccataccccctccgtaggtagccaggaatcagtcactttccaggacgtcgctgtggacttcacagagaaggagtggcccctgttagattccagtcagagaaaactgtacaaagacgtcatgctggagaattactcaaatctgacttccctgggctatcaagtaggaaaaccctcactgatctcccacttggaacaagaggaggagcccaggacagaagagcgcggggctcaccaaggcgcttgtgcagactgggaaaccccatctaaaacaaaatggtctcttctaatggaggatatcttcgggaaggaaactccgtccggtgtgactatggagagggcaggtctgggtgagaagtccactgaatatgcacacttgtttgaggtgttcggcatggacccccatctgacccagccaatgggacggcatgcaggaaaaaggccttaccaccgccgggattacggcgtggcatttaaagggcgcccccatctgacacagcacatgagcatgtacgatggtcggaagatgcacgagtgccatcagtgccaaaaagccttcaccacttctgcttctctcacgcgtcaccgtagaatacacacaggggagaagccgtacgaatgctctgactgtggcaaggcctttaacgacccttcagctctgaggtcccatgcaaggacccatcttaaagaaaagcccttcgactgcagccagtgtggaaacgcctttaggactctctccgcgctgaagatccatatgagagtccataccggtgaaagaccttacaaatgcgaccagtgtggcaaggcttacggtagatcctgccatttgatcgctcacaaacggactcacaccggcgagcgcccctacgagtgccacgactgcgggaaggccttccagcatcccagccatctaaaggagcatgtaagaaaccacactggcgaaaaaccttatgcctgtacacagtgcggcaaagcctttagatggaagagcaatttcaacttgcacaagaagaaccacatggtcgagaaaacctatgaatgtaaggaatgtggaaaatcattcggcgacctagtgtcgcgcagaaagcacatgagaattcacatcgtcaagaagcccgtagaatgtcgacagtgcggcaaaacctttaggaatcagtctatattgaagacccacatgaattctcacaccggcgaaaagccttacggttgtgacctgtgtgggaaagcattctcagcttcttctaacttgacggcccacaggaaaatccacacgcaagagagacgctacgagtgcgcagcctgtggcaaagtctttggagactacctcagccggagaagacacatgtctgtgcatttagttaaaaagcgcgtcgagtgtcggcagtgcgggaaggcctttcggaaccaaagcaccctgaaaacacacatgcggtctcatactggagagaagccgtacgagtgtgatcactgcgggaaggcattcagcataggttccaacttgaacgtgcacagaagaatacatactggcgagaagccttatgaatgtctggtatgcggcaaggcattctctgatcattcatctctgcgttcccacgtgaaaacacaccgaggggagaagctctttgtgtctagtgtttggaaaaggctacaatag

SEQ ID NO: 141324 - DNA, 1692 bp, Artificial Sequence
  Description of Artificial Sequence: Synthetic coding sequence
atggccgcactgagccctacttttgctaccagcacccaggactcgacctgtttgcaggacagcgagttccccgtgtcctccaaagatcatagttgcccccagaacctggacttgttcgtctgtagcggtttagaaccccacacaccaagcgtcggatcgcaggaatcagtcactttccaggatgtggcggtcgatttcaccgaaaaggagtggccactcctcgacagctcacaaaggaaactgtacaaggacgtgatgcttgaaaactattcgaacctcacaagccttgactgggagacgccctctaagaccaagtggagtctactcatggaggacatctttgggaaagaaaccccatccggagtgacaatggagagggccggtctcggggagaaatcaacagagtatgctcacttatttgaagtcttcggaatggatccccatcttacacagccgatgggtaggcacgctggaaaaaggccttatcatagaagggactacggcgtcgccttcaagggccgacctcatttaactcaacacatgtccatgtacgatggtcgaaaaatgcacgaatgtcatcagtgccagaaggccttcacaacctctgctagcctcaccaggcacaggaggattcacactggtgagaagccttacgagtgttctgactgcggcaaagccttcaacgacccctctgctttgcgcagccacgcaaggactcatcttaaagaaaaaccgtttgactgttcacaatgcgggaatgcatttaggaccctaagcgccctgaaaatccatatgcgcgtacacactggggagcggccttacaagtgcgaccaatgcgggaaggcctatggtcgctcttgtcacctgattgctcacaagagaactcacaccggtgaaaggccatacgaatgtcacgactgcggcaaagcctttcagcatccatctcatctgaaagaacacgtccggaatcataccggcgaaaagccttacgcctgcacgcagtgtgggaaggcattccgctggaagagcaattttaacctccacaagaagaatcatatggtggaaaaaacatatgaatgcaaagagtgtggaaaaagctttggggacctggtgtctcgacgcaaacatatgcgcattcacatagtgaagaagccagtggagtgtcggcagtgcggcaagacctttaggaaccagtctattctgaaaacacacatgaattcccacacaggagagaagccatatggatgcgacctctgtggaaaggctttctcggccagttccaacctcacggcgcacaggaagatccacacccaagaacgacgatacgagtgtgcagcctgtgggaaggttttcggtgattatctttcacgaaggcgccatatgtctgttcatctcgtgaagaaacgggtcgagtgtcgccagtgcggcaaagctttccggaaccagtctaccctgaagacccacatgagatcgcatacgggcgagaaaccgtacgaatgcgaccattgcggtaaggcattttccatcggatccaatctgaacgtccaccgcagaattcacactggcgagaagccctatgaatgtctcgtgtgcggaaaggcattcagcgaccatagctcactcagaagtcacgtgaagacgcacagaggggagaaactgttcgttagctccgtgtggaaacgactgcagtag

SEQ ID NO: 141325 - DNA, 369 bp, Artificial Sequence
  Description of Artificial Sequence: Synthetic coding sequence
atgaatttttctagccaccgtaggagattgccaagtcctcccctccctcggtcgtattcacagtctagcactagcacgcaagactccacgtgcctgcaggattctgagttcccagtcagtagcaaggaccacagctgtccccagaacttggacctgtttgtatgtagcggcctggagcctcacacgccgtcggtcggatctcaggaatccgtaacatttcaagatgtggctgtggacttcactgaaaaggaatggcctctgctggatagctctcaacgcaagttatacaaagatgtcatgctggaaaactacagtaacctcacctctctgggcaaagctagtgctatcagcccgctgattcatccatag

SEQ ID NO: 141326 - DNA, 822 bp, Artificial Sequence
  Description of Artificial Sequence: Synthetic coding sequence
atgtttgggttcccaacggccacgctgctggactgtcacgggcggtacgctcaaaacgttgcattcttcaatgtcatgaccgaggcccaccacaagtacgatcactctgaggctacggggagctcttcctgggacatccagaactcttttcgacgcgagaaacttgaacagaagagtcccgactctaagaccctgcaagaggactcaccaggcgttcgccagcgcgtctacgagtgtcaggaatgcggcaagagctttcgtcagaagggcagtctcacccttcacgaacggattcacaccggtcaaaaaccctttgagtgtacacattgcggaaaaagctttagggctaaaggcaatctggtgacccaccagaggatacacaccggcgagaaaccctaccagtgcaaagagtgtggtaagtctttctctcagcgggggagcctggccgtacatgaaaggcttcacacaggacagaagccatacgagtgcgctatatgccagcggtcctttcgtaaccagagcaatttggcagtgcaccggcgtgttcactctggagaaaagccttatcggtgtgatcagtgtggcaaagcctttagccagaaaggttcactgattgtacacattcgggtgcatacgggactcaagccatatgcgtgcacacagtgccgcaagtccttccacacgaggggcaactgtatcttacacggtaagatacataccggcgaaacaccttatctctgcggacagtgcggcaagtctttcacacagagaggctctttggcggtccatcagcggtcttgttcacagaggctgaccctgtag

SEQ ID NO: 141327 - DNA, 822 bp, Artificial Sequence
  Description of Artificial Sequence: Synthetic coding sequence
atgtttggttttcccaccgccacactgctggattgccatggaagatatgcccaaaatgtggcattttttaacgttatgaccgaggcacaccataagtatgatcatagcgaggctacaggaagcagctcgtgggacattcagaacagttttagacgtgagaagctagagcaaaaaagccctgactctaagacactgcaggaggatagtccaggggtgagacagagagtttacgagtgtcaggagtgcgggaagagctttcggcagaaaggctctctgaccttgcacgaacggattcatacaggccagaaaccattcgaatgtacgcactgtggaaagtcctttcgggccaaaggcaatctggtcactcatcaacggatccacacgggagagaagccataccagtgcaaggagtgcggaaagtcattctctcagcgaggcagtctggctgtccacgaaagattgcatactgggcagaaaccgtatgagtgcgccatttgccagcgctccttccgcaatcaaagtaacctcgcagtccatagaagggtacacagcggcgagaaaccctataggtgcgatcagtgcggaaaggccttctctcaaaagggttccctgatagtgcacatcagagtacacaccggcctaaagccatatgcctgcacacagtgtcgcaagtctttccatacacggggcaattgtatcctacatggtaaaatccacacaggagagactccctacctgtgcgggcagtgcggtaagtcctttactcagaggggttccctggcggtccatcagcgctcctgttcacagcgcttgactctttag

SEQ ID NO: 141328 - DNA, 1530 bp, Artificial Sequence
  Description of Artificial Sequence: Synthetic coding sequence
atggcgctatcgcagggactcctgacctttcgggatgtagcaatcgaattttcccaggaggagtggaagtgcttggacccagcccagagaaccctgtacagggacgtaatgttagaaaattatcggaacctagtaagtctcgatatctcgtctaaatgcatgatgaatactctgtcctctaccggccagggtaacactgaagttatccacacaggcaccctccaacgtcaggcgtcttatcatatcggagccttttgtagccaggaaattgagaaagacatccatgacttcgtgttccagtggcaggaagatgaaacaaatgaccatgaggcacccatgaccgagatcaaaaaactgacttctagtaccgatagatacgatcagagacacgccggaaacaaacctataaaaggccaacttgagagcaggtttcatctccatctgagacgtcacaggcgcatccacacaggcgagaagccatacaaatgtgaggaatgcgaaaaggtgttcagttgtaaatcccacctggagatccacagaattattcataccggggagaaaccgtataaatgtaaggtttgtgacaaggcatttaaacacgacagccacctggcaaagcatacccgaatccaccgcggcgataaacattatacctgtaatgagtgtggaaaggtcttcgaccagaaggctaccctagcctgccatcacagatcacacacaggggagaagccatataaatgtaatgagtgcggtaaaacgttttcccaaaccagtcatctggtgtaccaccataggctccacaccggcgaaaagccatataaatgcaatgagtgtggaaagacattcgctagaaactctgtgctggtcattcataaggcggtgcacactgcggaaaagccttacaagtgtaacgagtgcggcaaggtgtttaaacagcgagcgacgctagcgggacatagacgggtccatacaggtgagaagccatatcgctgtgaggagtgtgataaagtcttcagccgcaagtcccacttagagaggcacagacgaattcacaccggggagaagccctacaaatgcaaagtctgtgataaagccttccgtagcgatagtcgtctggcagaacatcagcgcgtacatactggcgaacgcccatatacctgcaacgaatgcggcaaggtcttcagcactaaagcctacctggcctgtcaccagaagctacacactggcgaaaaactatatgaatgtgaggaatgcgacaaggtgtacattagaaaatcgcacttagaacggcacaggcgtatacacactggagagaagccacacaagtgtggagattgcggcaaggccttcaatagtccgtcccacctgatcagacatcagcgcatccacaccggtcaaaagagctacaaatgccatcagtgcggaaaggtcttttcgctgaggtcactgctagctgaacaccagaagattcctttcggggacaactgtttcaagtgcaacgaatacagtaagccatccagcatcaattag

SEQ ID NO: 141329 - DNA, 1530 bp, Artificial Sequence
  Description of Artificial Sequence: Synthetic coding sequence
atggccctgagccagggccttctgacattccgcgacgtcgctattgaattcagccaggaagagtggaaatgtttagaccctgcgcagcgaacactgtacagagatgtcatgttagagaattaccgaaacctcgtgtccctggatatcagctctaaatgtatgatgaatactctgtctagtactgggcagggcaatacagaggtgatccacaccggaaccctgcaacgccaagcttcttatcatatcggcgccttctgctcacaagaaatcgaaaaagacatccatgactttgttttccaatggcaagaggacgagactaacgatcatgaagctcctatgaccgaaataaaaaaattgaccagcagtacagaccggtatgaccagcggcacgcggggaacaagcctatcaagggacagctggagtctcggttccatttgcaccttcgcagacacagaagaatccatactggagagaagccttacaaatgtgaagagtgtgaaaaagttttttcatgcaaaagccatttagaaatccacagaattatccataccggggaaaagccctataaatgtaaagtgtgcgacaaggccttcaaacatgacagccatctcgctaagcataccagaattcaccggggcgacaaacattatacttgcaacgagtgcggcaaggtattcgaccagaaggctacactggcatgtcatcaccgcagccacactggagagaagccctataagtgtaatgaatgcggaaagacctttagccagacttcccacctggtatatcatcatagactgcacacaggagagaagccatacaaatgtaacgagtgtggaaagacattcgctagaaacagcgtgctcgtgatccacaaggctgtgcatacagctgagaagccatacaaatgtaacgagtgcggcaaggtatttaagcagcgggctactcttgcgggccatcgtcgcgtgcataccggagagaaaccctatcgctgtgaggaatgtgataaggtgttctcccgcaagtcgcatctagagaggcatcgacgcattcacactggagaaaaaccttacaagtgcaaagtgtgcgataaggcctttaggagcgatagccggctcgccgagcaccagagggtccacactggggaacgaccttatacgtgcaacgaatgcggaaaagtcttttccaccaaagcctatttggcctgccatcaaaagttgcatacaggggagaagctttatgagtgtgaggagtgtgataaggtgtacataaggaagtctcacttagaacggcacaggagaattcacactggcgaaaagccgcataagtgcggggattgtggcaaggcttttaattcacctagccacctcattaggcaccagagaatacataccggacagaagagctacaaatgccaccagtgcggaaaggtgttctctctcagatctctattagcggagcatcaaaagattccttttggagataactgctttaagtgcaacgaatacagtaaaccatcgtcaatcaactag

SEQ ID NO: 141330 - DNA, 1209 bp, Artificial Sequence
  Description of Artificial Sequence: Synthetic coding sequence
atgtacaccagcgaggaaaaatgtaaccagcggacccaaaaacgtaaaatttacaatgtgtgcccacggaagggcaaaaagatttttatccacatgcatgagattatccagatcgacgggcatatctaccagtgtctcgagtgtaaacagaatttctgtgagaacctggccttgattatgtgcgagagaacccatacaggcgaaaagccatacaagtgtgatatgtgtgaaaaaacattcgttcaaagctcagacctcacgtcgcatcagaggatccacaactatgagaaaccctacaagtgtagtaaatgtgagaagtctttctggcatcacctggccctgtcagggcaccagcgtacccatgccggcaagaaattttacacttgcgatatctgcggaaagaacttcggtcagtcctccgatttgcttgtgcaccagcggagtcatactggcgaaaagccatacctgtgctccgagtgcgataagtgttttagcagaagtaccaatctgattcgccatcggcgcactcacacaggggagaagccttttaagtgcttggagtgcgaaaaggcctttagcggaaagagcgatctgatctcccaccagcgaacgcacactggcgaaaggccctataaatgtaacaaatgtgagaagagctaccgacacaggtctgcatttatagtgcacaaaagagtgcacactggtgaaaagccttacaaatgcggtgcctgcgaaaaatgtttcggccagaaatctgatcttattgtacatcagcgggtccataccggcgagaaaccatacaaatgtttagagtgtatgcgcagcttcacaagaagtgctaacctgatcagacaccaggccacacacacgcataccttcaaatgtctggagtatgagaaatcctttaactgcagctcagaccttatagttcaccagcgcattcatatggaagagaaaccccatcagtggagcgcgtgcgagtctgggtttctgctgggcatggactttgtggcccagcagaaaatgaggactcagacagaggagctgcattacaagtacaccgtctgtgacaagtcgttccaccagtcctctgccctgctccagcatcagacagtgcatattggcgagaaaccatttgtttgcaatgtttctgaaaaagggcttgaattgagtcctccacacgcctcagaggcatcccaaatgtcctag

SEQ ID NO: 141331 - DNA, 1209 bp, Artificial Sequence
  Description of Artificial Sequence: Synthetic coding sequence
atgtacacaagcgaagagaagtgcaatcagcggacccaaaagagaaagatctacaatgtctgtccccgcaaggggaaaaaaattttcatccacatgcacgagattatccagattgatgggcatatctaccagtgcctggagtgcaaacagaacttttgcgaaaatctcgcgcttatcatgtgtgagcgcacccataccggcgaaaagccttataagtgtgatatgtgcgaaaaaacattcgttcagtctagcgatctcacctcccaccaaaggatccataattacgaaaagccatacaaatgctccaagtgtgaaaaatccttttggcaccacctcgctctctccggacatcagagaacacacgctggcaagaagttttacacctgcgatatctgtgggaagaacttcggacagtccagtgatctgctagtgcaccagaggtcacatactggcgaaaaaccctatctctgctctgaatgtgacaaatgtttcagtagatcaactaatctaatcagacatagaaggacacacaccggcgaaaaacccttcaagtgcctcgaatgcgagaaagctttttcgggtaagtcggacctgatcagccaccagaggacacacaccggggagagaccttataagtgcaacaaatgcgaaaagtcatatcggcaccgttccgctttcatagtccacaagcgtgtgcatacaggggagaaaccctacaaatgcggcgcctgtgaaaaatgctttggccaaaaatccgatttgatcgtgcaccagagggtgcacactggagagaagccttacaagtgcctagaatgtatgcggagttttactcgcagtgctaacttgatacggcaccaggcgactcacacccacaccttcaagtgcctcgaatatgaaaagtcatttaactgctcttctgatctgatcgtgcaccagagaatccacatggaggagaagccacaccagtggtctgcctgcgagtccgggttcctgttgggtatggatttcgtggcacagcagaagatgagaactcagactgaagagttgcactacaagtacacagtgtgtgataaaagttttcatcagagctcagccctcctccaacaccaaaccgttcatatcggcgagaaaccttttgtgtgtaatgttagcgagaagggtctagaactgagccctccccacgcgtcggaggcgagccagatgtcttag

SEQ ID NO: 141332 - DNA, 81 bp, Artificial Sequence
  Description of Artificial Sequence: Synthetic coding sequence
atgtatacaagcgaagagaagtgtaaccaacgaactcagaaaaggaagatatacaacgtgtgtccgcgcaaaggcaaatag

SEQ ID NO: 141333 - DNA, 1221 bp, Artificial Sequence
  Description of Artificial Sequence: Synthetic coding sequence
atggcgtctactgaagaacagtacgacctcaaaattgtcaaggttgaggaagacccaatctgggaccaagaaacccacctgaggggaaataacttctccggccaggaagcttctaggcagctattccggcaattttgttaccaagagacacccggaccgagggaagcactgtcacgactgagggagctttgccatcagtggctgcggccagagattcacactaaagagcagattctggagcttctcgttctggaacagttcctcacaattctccccgaagaactccaggcttgggtgcgggaacaccaccccgaaagcggggaggaggctgtggctgtcgtggaggatctggaacaagaattgtctgaacctggcaaccaggcgcctgaccacgagcacggccactctgaagtgctcctggaagatgtcgagcacttgaaggtgaaacaagaacctactgacattcaactgcagcccatggttactcaactgcgctacgagtccttttgcctgcaccaatttcaggaacaggatggagagagtatacccgagaaccaggagctggcgtcaaagcaagagatcctgaaggaaatggaacatctgggggattcaaagttgcagcgggacgtgagcctcgacagtaagtacagggagacctgcaagcgcgatagtaaagctgaaaaacaacaggcccacagcacaggagaaaggcgccacaggtgtaacgagtgcggtaaatctttcaccaagtcctccgtgctcatcgagcatcagagaatccataccggagaaaaaccttacgagtgcgaagagtgtgggaaggccttctcgcggcggtcctcgctgaatgagcatcgccgatcccataccggggaaaaaccatatcagtgcaaagagtgtggcaaggccttctctgcaagcaacgggttaacgcggcacagacggatccataccggcgagaaaccatacgaatgcaaggtttgcggcaaagcctttctcctcagcagttgccttgtgcagcaccagcgaatccacactggcgaaaagcgctatcagtgccgggagtgtggcaaggctttcattcagaatgcgggactgttccagcaccttagagtgcacaccggtgaaaagccctaccagtgttcgcagtgttcaaaactgttcagcaaacgcaccctacttaaaaagcaccagaagatacataccggagaaagaccttag

SEQ ID NO: 141334 - DNA, 1221 bp, Artificial Sequence
  Description of Artificial Sequence: Synthetic coding sequence
atggcttctaccgaagagcagtatgatctaaaaatcgtaaaagtggaggaagatcctatttgggaccaagaaacacacctgcggggaaataacttctccggccaggaggcatctagacaattgtttcggcagttctgctaccaggaaacccctggtcctcgcgaggcgctgtctcggttgcgtgagttgtgtcatcaatggctcaggcctgagattcataccaaggagcagattttggaattgctcgttcttgagcagtttctaaccatactgccagaggaactgcaagcttgggttagagagcatcatccggaatcgggggaagaggcagtggccgtggtcgaagacctagagcaggagctgtctgagccagggaatcaggctcctgaccacgaacatggacactctgaagttcttctggaagatgttgaacatctaaaagtgaagcaggagccaactgacattcagcttcaaccaatggtcacccagctccgatatgagagtttctgtttgcaccagtttcaggaacaagacggagagagtattcccgaaaaccaggaactggcctctaagcaagaaatcctgaaggaaatggaacatctgggcgattctaagctccaacgcgacgtatccctggacagtaaataccgggagacatgcaagcgggatagcaaagccgagaagcagcaggctcactcgacgggtgagaggcggcaccgctgtaacgagtgtggaaagtcttttacaaaatcgtccgtgctaatcgagcatcaacgaatccacactggagaaaagccctacgaatgtgaggagtgcgggaaagcgtttagccggcgatctagcttgaacgaacacaggagatcccacaccggagagaaaccttatcagtgcaaggagtgcggaaaagcattctctgcctctaatggtctgactcgccatcgccgaatacatacaggggagaaaccgtacgagtgtaaggtgtgcggtaaggccttcctcctctcaagctgtttggtgcaacaccagaggatccataccggagagaagaggtaccagtgtagggaatgtgggaaggcatttatacagaacgctgggcttttccaacatctcagggtgcacactggggaaaagccataccagtgcagtcaatgctccaaattgttctctaagagaacactgctcaagaagcaccaaaagatacacacgggggagaggccatag

SEQ ID NO: 141335 - DNA, 1221 bp, Artificial Sequence
  Description of Artificial Sequence: Synthetic coding sequence
atggcatctacagaggaacagtacgacctgaagatcgtgaaggtggaagaagacccaatctgggatcaggagactcacctacggggtaacaacttttctggtcaagaagccagccgccagctcttcaggcaattttgttaccaggagacccccggccctcgtgaggctctttctcggctgcgagagctgtgccaccaatggctgcgccccgaaatacatactaaagaacagatcctggagctacttgtcctggaacaatttctcaccatactccctgaagaactacaggcttgggtgcgggagcaccatcctgagtcaggcgaagaagccgtcgcggttgtggaggatctggaacaggaactcagcgagcctggaaaccaggcccccgaccatgagcatggccatagtgaggttctgttggaggatgtggaacatctgaaggtcaaacaggaaccgacggacattcagctgcagccgatggtgactcagctgaggtacgaaagcttctgccttcatcagtttcaggaacaggatggagaaagcatccctgagaatcaagagctcgcaagtaagcaagaaatccttaaggaaatggaacacctgggggatagtaaactgcagagagacgtgtctttagattcaaagtacagggagacgtgtaaaagggactctaaggctgagaaacaacaggcccactctacaggagaacggcggcatagatgcaacgagtgtgggaagagtttcactaaatcaagcgtcctgatcgaacatcaacggattcacacaggcgaaaagccatatgaatgtgaggaatgtggcaaagctttcagcaggcgctctagtcttaatgaacatcgaagaagtcataccggcgaaaagccttatcagtgtaaggagtgtggcaaagcttttagtgccagcaacggcctgaccagacatcggaggatccacaccggagagaagccctatgagtgtaaagtgtgtgggaaagccttcctgctgagctcatgtctggtacaacaccagaggatccacacaggcgaaaagcggtatcaatgtcgcgagtgcggtaaggcctttattcagaatgctggactattccagcatctgagggtacatactggcgagaagccataccagtgcagtcagtgctccaagcttttctctaagaggacgctgctgaaaaaacaccaaaagattcataccggagagcggccttag

SEQ ID NO: 141336 - DNA, 324 bp, Artificial Sequence
  Description of Artificial Sequence: Synthetic coding sequence
atggcctctaccgaggaacagtatgacctgaaaatagttaaggtcgaagaagatcctatctgggaccaggagacccacctgcggggaaataactttagcgggcaagaggcaagccggcagctgttccggcaattttgctaccaggagacccccggtccgagggaagctctgagccggttgcgcgagctttgccaccaatggttaaggcccgaaatccatacaaaggagcagattcttgaattactcgttctggagcagtttctgacgattcttccagaagagctgcaagcctgggtccgcgagcaccacccagaatccggctag

SEQ ID NO: 141337 - DNA, 237 bp, Artificial Sequence
  Description of Artificial Sequence: Synthetic coding sequence
atggcatcaacagaagagcagtatgacctgaagatagtcaaggtggaggaagatcccatttgggatcaagaaacgcacctccggggcaacaacttctcaggtcaggaggcctccagacaattgtttaggcagttctgctatcaggaaaccccaggacccagggaagcgctcagcagactcagggaattgtgtcaccagtggcttcgtccagagattcatactaaagagcaaatctag

SEQ ID NO: 141338 - DNA, 1221 bp, Artificial Sequence
  Description of Artificial Sequence: Synthetic coding sequence
atggcctccactgaagaacaatacgatctgaagatcgtgaaggtggaggaagaccccatctgggaccaagagacacacctgcgtggtaacaacttctctggacaggaggcaagcagacagttgttcagacaattttgctaccaggaaacgcctggacctcgggaagccttgtcccggctgagagaactctgccaccagtggctgcgccctgagatccatacgaaggagcagattctggagctgctcgttctcgagcagttcctgaccattctgccagaggagctgcaggcatgggtgcgcgagcatcatcccgaatcaggagaggaggcagtcgcagtcgtggaagacctggagcaggaattatccgagcctggcaatcaggccccggaccacgagcatggacactccgaagtcctcctggaagacgtagagcacctaaaggtgaagcaggaacccactgatatccagctccagccaatggtcacccagctccgatacgaatctttctgcctgcaccagtttcaggagcaggacggcgagtctattcccgagaatcaggagctggcaagtaagcaagaaattttgaaagagatggaacaccttggcgacagcaaactgcagcgggacgtgagtcttgatagtaagtaccgtgaaacctgtaaacgcgatagtaaagcggagaaacagcaggcccattctactggagaaagacgtcatagatgcaatgagtgcggcaagtcgtttacaaagtcgtcagtcctaatcgaacaccagaggatccatactggggagaagccctatgaatgtgaagagtgtggcaaggccttcagtcggcgtagctcactgaacgaacatagacgttcccatacaggcgagaagccataccagtgtaaagagtgtggcaaggccttttccgcttcaaatggcctaactcggcacagacgcatccatacaggtgagaaaccatatgagtgtaaagtatgtggcaaggcatttctgctgtccagctgcctcgtgcagcatcaaagaatacacacaggtgagaagcgctaccaatgcagggagtgtgggaaagcttttattcagaacgctggattgtttcagcacttgcgagtccatacaggagaaaaaccttatcagtgttctcaatgcagcaagctcttctcaaaacggacactcctgaaaaagcaccagaaaatccacacaggagagcgcccttag

SEQ ID NO: 141339 - DNA, 54 bp, Artificial Sequence
  Description of Artificial Sequence: Synthetic coding sequence
atggcatccacagaggaacagtatgacctgaaaattgtcaaggtagaggaatag

SEQ ID NO: 141340 - DNA, 468 bp, Artificial Sequence
  Description of Artificial Sequence: Synthetic coding sequence
atggcatcaacagaggagcagtatgacctgaagatcgtcaaggtcgaagaggatccaatctgggatcaagaaacgcatctccggggaaataacttctcaggacaagaggcgtctcgacagctcttccgtcagttttgttatcaggagacccccggccctagagaagccctgagtcgcttgcgcgagctgtgccaccagtggctcagacctgagatacacacgaaggagcagatcctggagctcctggtgttagagcaatttctgaccatattacccgaagaactgcaggcctgggtccgagagcaccaccctgaaagcggggaggaagctgtagcagttgtggaagatctcgagcaagaactgtcggagccgggaaaccaggcgccggaccacgaacacggccactctgaggtgttactggaagacgtagaacatctcaaagtgaagcaggagcctactgatatctag

SEQ ID NO: 141341 - DNA, 75 bp, Artificial Sequence
  Description of Artificial Sequence: Synthetic coding sequence
atggcaagcactgaggagcagtatgacctgaaaatagtaaaagtggaggaagatccgatatgggatcaagaatag

SEQ ID NO: 141342 - DNA, 312 bp, Artificial Sequence
  Description of Artificial Sequence: Synthetic coding sequence
atggcaagcactgaagagcagtacgatttaaagatcgtcaaggtcgaggaagatccgatttgggaccaggaaacccaccttcggggtaataacttcagtgggcaggaagccagccgccaactgtttagacaattttgttaccaggaaactcctggtcctcgggaagcgttaagccgcctgcgcgaactgtgtcaccagtggttaagacctgagatccacactaaggagcagatactcgagttactggtcctagagcagtttctcactatcctccctgaggaactacaggcttgggtgcgggagcatcactag

SEQ ID NO: 141343 - DNA, 447 bp, Artificial Sequence
  Description of Artificial Sequence: Synthetic coding sequence
atggcctctaccgaagagcaatatgatctcaaaatcgtgaaagtggaggaagaccccatttgggaccaggaaacacacctcagggggaacaacttctctggccaggaggcctcccggcagctattcaggcagttctgctaccaagaaacgcccggcccgcgggaagctctgtcgcgacttcgagagctctgccaccagtggctgagacctgaaatccacactaaagaacagattctggaactgctcgtattagaacaatttcttacaatcctgcctgaagagcttcaggcctgggtgcgcgagcatcaccccgaaagtggagaggaggctgtggccgtcgtggaagacttggagcaggagcttagcgaacccgggaaccaggctcctgaccatgagcacgggcacagcgaagtgctgctggaggatgtggaacatctaaaagtgtag

SEQ ID NO: 141344 - DNA, 654 bp, Artificial Sequence
  Description of Artificial Sequence: Synthetic coding sequence
atggcttcaacggaagagcagtacgatttgaagatagttaaagtggaggaggatcctatctgggatcaggaaacacatttaaggggcaacaacttcagtggccaggaggcgagtaggcagttattccggcagttctgttatcaggaaactcccggaccccgggaggccttgagtaggctgagagagttatgtcatcagtggctgcgacctgaaattcataccaaggagcagatactggagctgctggtactggagcaatttctgacaatactgccagaggagctccaagcatgggttcgcgaacaccaccccgagagtggcgaagaagctgttgctgtcgtcgaagacctggaacaggaactgagcgaacccgggaatcaagcacccgatcacgaacatggacattccgaggtactccttgaggatgtggaacacttaaaggtcaagcaagaaccgactgatattcaactgcagccaatggtgacacagcttagatacgaaagcttttgcctccatcaattccaagagcaggacggcgagagcattcctgagaatcaggaactggcatcaaagcaggagatcctgaaagagatggaacacctaggcgatagcaaactgcagagagacgtcagcctggatagcaaataccgatag

SEQ ID NO: 141345 - DNA, 963 bp, Artificial Sequence
  Description of Artificial Sequence: Synthetic coding sequence
atgcctaagaaaaaaacaggcgctcggaagaaggccgaaaatcggagggagagagagaagcagctccgagccagtcgcagcactatcgatctcgccaagcatccctgcaacgcaagcatggagtgtgataaatgtcaaaggagacaaaagaatagagctttttgttacttctgtaattctgtccagaagttacctatttgcgctcagtgcggtaaaactaagtgtatgatgaaatccagcgactgcgtcatcaaacatgctggcgtatactctacaggactggcaatggtcggggcgatatgcgacttctgtgaagcctgggtctgtcacgggaggaaatgcctctccacccacgcgtgcgcatgtcccctgacagatgctgagtgcgtggagtgtgaaagaggcgtgtgggaccatggaggacgaatctttagctgctctttctgccataacttcctctgcgaggacgaccagtttgagcatcaggccagctgtcaagtgttggaggccgaaacgtttaagtgtgtgagctgtaacaggctgggacagcattcttgccttcggtgcaaggcctgcttctgtgacgatcacacaaggtccaaggtatttaaacaagaaaagggtaaacaaccaccttgcccaaagtgcggtcatgagacacaagagacaaaagatttaagcatgtccaccaggagcctcaaattcggaaggcaaactggcggcgaggagggtgatggtgcctccggctacgatgcctattggaaaaacctctcctccgacaaatacggtgacaccagctatcacgacgaagaagaggacgagtatgaggcggaagatgacgaggaagaagaggatgagggtagaaaggactctgatacagagtctagcgacctcttcacaaacctgaacctgggccgcacctacgcttccgggtatgcccactacgaagaacaggaaaattag

SEQ ID NO: 141346 - DNA, 783 bp, Artificial Sequence
  Description of Artificial Sequence: Synthetic coding sequence
atgcctcagtggaacgttacttccgtcaggggcaagactaagtgtatgatgaaaagtagcgactgtgtcatcaagcacgccggggtgtacagtaccggcctcgccatggtaggcgctatttgcgacttctgtgaggcatgggtgtgtcacggacgaaagtgtttgtcaacccatgcttgcgcatgccctctcaccgacgctgaatgcgtagagtgcgaaagaggcgtatgggaccacggcggcaggattttctcttgctctttctgccataattttctatgcgaagatgaccaattcgagcaccaagcctcctgtcaggtgctcgaggcggagacgttcaagtgtgtgtcctgcaacaggctagggcagcattcttgtttaagatgtaaggcctgtttctgtgatgatcacacaaggtctaaagtatttaagcaggagaaaggtaaacagcctccttgtccaaaatgcggacacgagacacaggagaccaaagaccttagcatgtctacacgatcgctaaaatttggtcgccaaactgggggcgaagagggggacggtgccagtggctatgacgcttactggaaaaacctgtctagtgacaagtatggcgatacatcctatcatgacgaggaggaggatgagtacgaagccgaggatgatgaagaagaggaggatgaaggccgtaaggactctgatactgaatcatctgacctcttcactaatctgaatttaggcagaacctatgcaagcggctacgcccactacgaagaacaagagaattag

SEQ ID NO: 141347 - DNA, 423 bp, Artificial Sequence
  Description of Artificial Sequence: Synthetic coding sequence
atgccaaaaaagaaaacaggtgcaagaaaaaaggcagaaaaccgaagggagcgggagaagcagctccgtgcgagtaggagtacaatcgatctggccaaacacccatgcaatgcatccatggagtgtgataaatgccagcggaggcagaaaaaccgcgccttctgctacttttgtaattcagtgcagaagctgcccatatgcgctcaatgcggcaagaccaagtgtatgatgaaatcgtcggattgtgttattaaacacgccggagtgtactctaccgggctggcgatggtcggcgcgatttgcgatttttgtgaggcctgggtgtgtcatggacgaaaatgcctctcaactcacgcttgtgcttgtcctttaaccgatgccgaatgcgtggaatgcgagcggggtgtttgggatcatgggtag

SEQ ID NO: 141348 - DNA, 462 bp, Artificial Sequence
  Description of Artificial Sequence: Synthetic coding sequence
atgcccaagaagaagaccggggccagaaaaaaagccgaaaataggagggagagagaaaagcagctgagagccagcagatcaaccattgatctggctaagcacccctgcaacgccagtatggagtgtgataaatgccaaaggcgacaaaaaaacagggcattttgttacttttgcaatagcgtgcagaaactgccaatctgcgcgcagtgtggcaaaaccaagtgtatgatgaagtcctcggactgcgtcataaagcacgccggagtgtatagcactgggctggcaatggtgggggcgatttgcgacttttgcgaggcatgggtgtgtcacggtaggaagtgtctgagcactcatgcctgcgcatgtcctctgacagatgcagagtgcgtcgaatgtgagcgcggagtgtgggatcatgggggcaggatcttttcctgcagcttttgccataactttctgtag

SEQ ID NO: 141349 - DNA, 690 bp, Artificial Sequence
  Description of Artificial Sequence: Synthetic coding sequence
atgcctaagaaaaagactggcgcccggaaaaaggcggagaatagacgagagcgcgagaagcagctaagagcatccagatcaacaatagaccttgcaaagcacccatgcaacgcatccatggagtgcgacaagtgccaacgacgacaaaagaacagggccttctgttacttttgcaactctgtgcaaaagctccccatctgtgcacagtgcgggaaaaccaaatgcatgatgaaaagtagtgattgcgtgatcaagcatgcgggtgtgtacagtaccggactggctatggtgggtgctatatgtgatttctgcgaagcctgggtatgtcatggtagaaagtgcctgagcacccacgcctgcgcctgccctttgacagatgctgagtgtgtggaatgcgagcggggcgtgtgggatcacggtggcaggatcttctcatgttccttctgtcataacttcctgtgcgaggatgaccagttcgaacaccaagcgtcctgccaggtgctggaagccgagacctttaagtgtgtctcctgtaacaggttaggacaacactcttgcttacgctgtaaggcatgcttttgcgacgaccacactaggagcaaagtgtttaagcaggagaaaggtaagcagccaccgtgtccaaagtgtggccacgagacccaggagaccaaggatctctcaatgtcctag

SEQ ID NO: 141350 - DNA, 1392 bp, Artificial Sequence
  Description of Artificial Sequence: Synthetic coding sequence
atggcacagggactcgttaccttcgcagatgtagcgatcgatttctcacaagaagaatgggcctgcctcaattccgctcagcgcgatctctattgggatgtgatgctcgagaattacagcaatttagtctctctcgatctggaatccgcgtatgagaataagtccctccctacagagaagaatatccatgagatccgggccagcaagcgtaacagtgaccgacggagtaagtctcttgggcgaaactggatttgtgagggcaccctggagcgcccccaaaggtcacgcggtagatacgtgaatcagatgatcattaattacgtcaaaaggccggccacaagagagggtactcccccacgcactcaccagagacatcacaaggagaactcttttgagtgcaaggattgtgggaaggcattctcacgcggctaccagctctctcaacatcagaaaattcatactggcgagaaaccttacgaatgcaaagagtgcaagaaggcatttaggtggggcaatcaactgacccagcatcagaagatccacacaggagaaaagccatacgagtgtaaagactgcgggaaagcctttcgctggggctctagcctggtaatccataagcgcatccacactggggaaaagccatacgagtgcaaagactgcgggaaagcatttcggcgcggagacgagctgacccagcaccagagatttcacacgggcgaaaaggactatgaatgcaaagattgtggcaaaacattctccagagtttacaaattaattcagcataaacgcatccattcaggagaaaaaccgtatgagtgtaaggactgtgggaaagcctttatttgcgggtcttctttaattcagcataagaggatccataccggcgaaaaaccgtatgagtgtcaagagtgcggcaaggccttcaccagggtgaattacttaacacagcatcagaagatccatacaggcgagaagcctcacgaatgtaaagagtgtggcaaagcctttcgctgggggagctcactagtgaagcacgagagaattcacaccggcgagaaaccttacaagtgtacagagtgtggaaaagcatttaactgtggctatcacctcacccagcacgagcgaattcatactggagaaacgccgtacaagtgtaaagaatgcggcaaggcctttatttatggcagtagcctggtaaaacacgagcgaattcatacgggcgtgaaaccgtatggttgtaccgagtgcggcaagagcttcagccacggccatcagctaacccagcatcagaagacacactctggggcaaagtcctatgaatgtaaagagtgtggcaaggcctgcaaccacctgaatcatcttcgagagcaccagcgaattcataactcatag

SEQ ID NO: 141351 - DNA, 1392 bp, Artificial Sequence
  Description of Artificial Sequence: Synthetic coding sequence
atggcccagggcctggtaactttcgcagacgtggccattgactttagccaagaggagtgggcttgtctcaattctgctcagcgggatctctactgggatgtgatgttggagaactacagtaacctcgtatcacttgacttagaaagcgcttacgagaacaagtccctcccaacagaaaagaacatccacgaaatccgggcctcgaagcgaaacagtgatcggcggagcaaaagcttggggagaaattggatttgcgagggcacactggaaagacctcagagaagccgcggacggtatgtgaatcagatgataattaactatgtcaagcgacccgccacacgagagggaaccccacccaggacacaccaacgccatcataaagaaaacagcttcgaatgtaaggattgcggtaaggctttttctcggggctaccaattgtcccagcaccagaaaattcacaccggggagaaaccgtacgaatgcaaggaatgcaagaaggcattcaggtgggggaaccagttgacacagcatcaaaagattcacacaggggaaaagccatacgagtgcaaggactgcggtaaggccttccgctggggcagctcactggtgatccataaaagaattcatacgggagagaaaccctacgagtgtaaggactgtggcaaagcctttcgccggggagatgagctaacacagcaccagaggttccatacgggagaaaaagattatgagtgtaaggactgcggtaagacgtttagtagggtttataagctcatccagcataagcgcattcactctggtgagaagccctatgaatgtaaggactgtggcaaggcgttcatctgcggcagctctttaatccaacacaagcgaattcacacaggagagaaaccatacgagtgccaggaatgcggcaaagcgtttacccgtgtgaactacctgactcagcatcaaaaaattcacactggagagaaaccccacgaatgtaaagagtgtggaaaagcgttccggtgggggtcatcactggtgaagcacgagcgcatccacacaggggagaaaccgtacaagtgtaccgaatgtggcaaagcgttcaactgcggctaccacctgacacaacacgagagaattcacactggcgagaccccgtataagtgtaaagagtgcgggaaggcatttatatatgggtcatcattggtaaaacatgagaggattcatactggggtaaagccctatggctgtaccgagtgtggcaagtcattctctcacgggcaccagctgacacagcatcaaaagacccatagtggggctaagagctacgaatgcaaagaatgtggtaaggcctgtaaccacctgaaccatctcagagagcatcaaaggattcacaacagctag

SEQ ID NO: 141352 - DNA, 1392 bp, Artificial Sequence
  Description of Artificial Sequence: Synthetic coding sequence
atggcccagggtctggtgactttcgccgatgtggccatcgacttttcccaggaggaatgggcctgcctaaattcagcccagcgggatttatactgggatgtaatgctggaaaattactctaatctggtcagtttagacctcgaaagcgcatatgagaataaatccctgcctacagagaaaaacatccacgagatccgtgctagtaagcgaaattcagaccgtagaagcaagtccctcggcaggaattggatctgtgagggcaccctggagagacctcagcgctctcgcgggcgatacgtgaaccagatgataatcaattacgtcaaacgacctgcgacccgagaaggaacaccacccaggacacatcagcggcaccataaagagaattcttttgagtgcaaggattgtggaaaagctttcagcaggggataccagctctcccagcatcagaagatccacacgggggagaagccgtacgaatgtaaggagtgcaagaaagcttttcggtgggggaatcagcttacccaacatcaaaagatccacactggcgaaaagccatatgagtgcaaggactgtggtaaagcttttcggtggggttcttccctggtgattcataaaagaatccatacaggagagaaaccgtatgagtgcaaagattgtgggaaggccttccgccgcggcgatgagctgactcagcatcagcgattccataccggggagaaagactatgaatgcaaggattgtggaaagacttttagcagggtttacaagctcatccagcataagcgaattcatagtggcgagaagccctacgagtgcaaagactgcgggaaagcgttcatttgtggatccagtctgatccagcacaagcgtatccacactggtgaaaaaccatacgagtgtcaggaatgtgggaaggcgttcacacgtgtgaattatctcactcagcaccaaaagatccataccggtgaaaagcctcacgaatgtaaagaatgtggcaaagcttttcgctggggttcctccctggtgaaacatgaacgaatccacaccggtgagaaaccatacaagtgcacagaatgtggaaaggcgttcaactgtgggtatcacctgactcagcatgagagaattcacaccggggagaccccttacaagtgtaaggagtgcggcaaagcattcatctatggtagttcgctggtgaaacacgagcggatccacacaggcgttaaaccatatgggtgcacagaatgcgggaagagcttctcacatggacatcagctgacacagcaccagaaaacgcattccggtgctaaaagttacgaatgcaaagaatgtggcaaggcctgtaatcatctcaatcatctcagggagcaccaacgtattcataactcctag

SEQ ID NO: 141353 - DNA, 192 bp, Artificial Sequence
  Description of Artificial Sequence: Synthetic coding sequence
atggcgcagggattagtcactttcgccgacgttgctattgacttctcacaggaggaatgggcctgcctgaatagtgctcagcgagacctgtactgggacgtgatgctagagaattactcgaatctcgtgtccctggacctagagtctgcttacgaaaacaaatccctgccaacagaaaagaacattcattag

SEQ ID NO: 141354 - DNA, 258 bp, Artificial Sequence
  Description of Artificial Sequence: Synthetic coding sequence
atggctcagggactggtgaccttcgccgatgttgctattgatttttcccaggaagagtgggcatgtctgaacagtgcccaacgcgatctgtactgggatgtgatgctagagaactattcgaacctggtgtcactagaccttgaatccgcttatgagaataagtcccttcccacagaaaagaacatccatgagatcagggcttcaaaaaggaactcggaccgccgctcaaagagtctgggtagaaattggatctgctag

SEQ ID NO: 141355 - DNA, 201 bp, Artificial Sequence
  Description of Artificial Sequence: Synthetic coding sequence
atggctcagggccttgtgacctttgcagatgtcgcgatagatttctcacaagaagaatgggcttgtcttaattctgctcagagggacctgtactgggatgtcatgttagagaattacagtaatctcgtttccttggacctcgaatcagcctacgaaaataagagtctgcccacggagaagaatatacatgagatcagatag

SEQ ID NO: 141356 - DNA, 195 bp, Artificial Sequence
  Description of Artificial Sequence: Synthetic coding sequence
atggcccagggactggtgaccttcgccgatgtagccatcgactttagtcaggaggagtgggcatgtctcaacagcgctcagagagacttgtactgggacgttatgcttgaaaactactccaacctggtctcattggaccttgagtctgcctacgagaataaatctttaccaactgaaaaaaacattcatgagtag

SEQ ID NO: 141357 - DNA, 534 bp, Artificial Sequence
  Description of Artificial Sequence: Synthetic coding sequence
atggcccaagggctggttactttcgctgacgttgcaattgacttcagccaggaggagtgggcttgtctgaattccgctcaaagggatctgtattgggacgttatgttagagaattacagcaacctggtgagcctggacctcgagagtgcctacgaaaataaatccctaccaaccgaaaaaaatatacacgaaattagagcctccaagcgaaatagtgaccggcggagcaagtcccttggaagaaactggatttgtgagggcacactggaaaggcctcagcgcagtagaggacgctatgtgaatcaaatgataatcaactacgtgaaacgcccagccacccgagagggcacccccccaagaacccaccagagacatcacaaggaaaacagtttcgagtgcaaagattgcggcaaagccttctctagagggtatcagctctctcaacatcagaaaattcatactggagaaaagccttacgagtgcaaggagtgcaaaaaggccttccgatggggcaatcagttgacccagcattag

SEQ ID NO: 141358 - DNA, 264 bp, Artificial Sequence
  Description of Artificial Sequence: Synthetic coding sequence
atggcccaggggcttgtgacttttgctgatgtggcaatcgatttttcccaggaagagtgggcctgcctcaacagtgctcagagagacctgtattgggatgtgatgctggaaaattattccaacctggtgagtctggacctggaaagtgcctatgagaataaatcactgcccacagagaagaacatccacgaaatccgggcttccaaaagaaattcggataggcgctcgaagagcctcggtagaaattggatctgtgagggttag

SEQ ID NO: 141359 - DNA, 144 bp, Artificial Sequence
  Description of Artificial Sequence: Synthetic coding sequence
atggctcaagggttggtaaccttcgcagacgtggcaatcgactttagccaggaagagtgggcttgcttgaactcagcgcagagggacctgtattgggatgtcatgctggaaaattacagtaacttggtttcacttgatctctag

SEQ ID NO: 141360 - DNA, 1392 bp, Artificial Sequence
  Description of Artificial Sequence: Synthetic coding sequence
atggcacagggactggttacatttgcagacgtcgcgattgacttcagtcaagaggagtgggcctgccttaacagcgcgcaaagagacttgtactgggacgtgatgctagagaactattccaatctggtatccctagatctggagtcagcctatgagaataagtccttacctaccgagaaaaacatccatgagatacgcgctagcaagcgtaatagcgaccggcgatcgaagagtctgggacgtaattggatttgtgagggcacgttagagcgaccgcagcgttcaagaggcaggtacgtcaatcagatgatcatcaattacgtcaagagaccggccacgagggaaggcacgccaccccggacccaccagcgccaccacaaggagaattcatttgagtgcaaggactgtggcaaggcctttagcaggggttatcagctgtcacagcaccagaagatccacactggcgagaaaccttatgagtgtaaggagtgtaagaaagctttccggtggggcaaccagttgactcagcaccaaaagattcacaccggagagaaaccttacgagtgtaaagactgtggaaaagcctttaggtggggaagctctctggtgattcacaagaggattcacactggagaaaaaccatacgagtgcaaagactgcggaaaagcatttagacggggcgatgaattaacacagcaccagaggtttcacactggggagaaggattacgagtgtaaggactgcgggaaaaccttttccagagtgtataagctgatccagcacaagaggatacacagcggcgagaagccctacgaatgtaaggactgcggaaaggcctttatttgtgggtcaagcctgatccagcataaacggatccatactggggaaaaaccttatgagtgccaagagtgcgggaaggccttcaccagggtgaactacctgacacagcatcagaaaatccacacgggcgaaaaacctcacgaatgcaaagagtgtggcaaggccttccggtgggggagttctcttgttaagcatgagcgcattcacactggggaaaagccttataaatgcactgagtgcgggaaggctttcaattgcgggtaccacctcacccagcatgagaggatccatacgggggaaactccttacaaatgtaaagaatgtggcaaagcattcatctacggatcctctctggtaaaacacgaacggatccacacaggtgtaaagccatatggatgcacggagtgcggtaagagctttagtcatgggcatcagctcactcaacaccagaagacacatagcggcgctaaatcctacgaatgcaaggaatgcggaaaggcgtgcaaccatctcaaccacctgagggaacaccagaggatccacaatagctag

SEQ ID NO: 141361 - DNA, 318 bp, Artificial Sequence
  Description of Artificial Sequence: Synthetic coding sequence
atggcacagggattggttaccttcgctgatgttgctatcgacttttcccaggaggagtgggcatgcttgaattccgcgcagagggacctgtattgggatgtgatgctggaaaattatagtaacctagtctcccttgacctcgaatccgcctatgagaacaaaagcctgcctaccgagaagaatattcacgaaattcgtgcttcaaagcggaactccgatagaaggtccaaatcactgggacgaaactggatttgtgaaggcactctggaaagaccgcagcggtctcggggtaggtacgtgaatcagatgattatatag

SEQ ID NO: 141362 - DNA, 1392 bp, Artificial Sequence
  Description of Artificial Sequence: Synthetic coding sequence
atggcccagggacttgtcacatttgccgacgttgcgatagattttagccaagaagaatgggcatgtctgaacagcgctcaaagggatctgtactgggacgtaatgctggaaaactacagtaacctcgtctcactagacctggaatccgcttatgaaaacaaatcactcccaaccgagaaaaacattcacgagattcgtgcaagtaaacgaaactctgacagacgtagcaaaagcttgggccggaactggatctgcgaaggaacactagagcggccccaaagaagccgcgggcgctacgttaaccagatgattatcaactacgtgaagaggccagccacaagagaggggactccccctcgcacacaccagaggcatcacaaggagaactctttcgagtgtaaggactgtggaaaagccttctctagaggctatcagctctcccagcatcagaagattcatactggcgaaaagccctacgaatgtaaagagtgcaagaaagccttcaggtggggtaaccagctgactcagcatcaaaaaatccacactggcgaaaaaccatacgagtgcaaggattgcgggaaagctttcagatggggttcttcccttgttattcacaagagaatacataccggagagaagccctacgaatgcaaggattgcggaaaggcttttagacgcggggacgagttgacgcagcatcagcgcttccataccggagagaaggactatgaatgcaaagattgcggtaaaactttctcacgagtctacaaacttatccagcacaagcggatccatagcggggaaaaaccgtacgaatgcaaggattgcgggaaagcctttatatgcgggtcctctctgatccagcacaagcggattcacaccggggagaagccttacgaatgtcaggaatgcggtaaggcctttacaagagtgaactacctgacccagcaccagaagatccacactggcgaaaaaccccatgagtgcaaagaatgcgggaaagcgttccgatgggggtcatcactagtgaaacatgagagaatccatactggggaaaaaccatacaaatgtacggaatgtgggaaggccttcaattgtggctatcatctgacacagcacgagaggattcataccggcgagaccccatacaagtgcaaggagtgcggcaaggcctttatctacggatcctccttggtaaaacacgagcgcatacataccggcgttaagccttatggatgcacagagtgtgggaagtctttttcacacggccaccagctgacacagcatcagaagacccactcaggtgccaaaagctacgaatgcaaggagtgcgggaaggcgtgtaaccatttaaaccacttaagggagcaccagaggattcacaactcttag

SEQ ID NO: 141363 - DNA, 1392 bp, Artificial Sequence
  Description of Artificial Sequence: Synthetic coding sequence
atggcccaggggttggtcacattcgccgacgtggccatcgactttagccaggaagaatgggcctgtctcaattcagcgcagagagatctttactgggatgttatgctagagaactactctaacttagtaagtttggatctcgagtccgcgtacgagaataaaagcctgcccaccgaaaagaatatccatgagattcgggcctcaaaacgaaactctgatcgacgatccaaatccctgggtagaaactggatctgtgagggaacccttgagagaccgcagaggagccgcggaagatatgtgaaccagatgattatcaactacgtcaagcgccccgccactcgtgaagggacccctcccagaactcaccagcggcatcacaaggagaactcgtttgagtgcaaggactgcgggaaagcgttttctcggggataccagcttagtcaacatcagaagattcacacaggagaaaaaccttacgaatgcaaagagtgtaaaaaagccttccgctggggcaatcagctcactcagcatcagaagattcacactggtgagaagccatatgaatgcaaagactgcggcaaagctttccggtgggggtcctctcttgtcatccacaaacggatacacactggagaaaagccatatgagtgtaaggattgtggaaaagcctttcggagaggcgacgaactgacgcagcatcagcgctttcacaccggggaaaaggattacgaatgcaaagattgtggaaagacgtttagcagggtatataagctcattcagcataagcggatacatagcggagagaagccctatgaatgcaaagactgcgggaaagcatttatctgtggctcatccctgatccaacataaaagaatccacaccggcgaaaagccatacgaatgccaggagtgcggcaaagcattcacccgcgtgaactatctgactcaacatcagaagattcataccggagaaaaacctcacgagtgcaaagaatgtggtaaggcttttcgttggggcagcagtttggttaaacacgagaggattcacacaggggaaaagccatataaatgcactgagtgtggtaaagccttcaattgtggatatcatcttacccagcatgaacggatccataccggcgaaaccccctacaaatgcaaggaatgtgggaaggccttcatttatgggtcgagtctcgtgaagcacgagagaattcacaccggggtgaaaccgtacggctgtacagaatgtggcaagagcttctcacacggtcaccagctcacccaacatcaaaagacgcattcaggcgcaaagtcttacgaatgtaaggaatgcggaaaggcgtgcaaccatttaaaccatctgagagaacaccagcgcatccacaacagctag

SEQ ID NO: 141364 - DNA, 297 bp, Artificial Sequence
  Description of Artificial Sequence: Synthetic coding sequence
atggcgcaagggctagtaacctttgctgatgtagccatcgacttcagccaggaagagtgggcatgcctgaatagcgcccaaagagatctgtactgggatgtcatgcttgagaattacagcaacctggtctctcttgacctggagtctgcgtacgagaacaaatctttaccgaccgagaagaatattcacgagattcgcgctagcaaacggaattccgaccggcgaagcaagtccctcggaaggaattggatctgcgaagggacattggagcgccctcaacgtagtagagggaggtag

SEQ ID NO: 141365 - DNA, 1392 bp, Artificial Sequence
  Description of Artificial Sequence: Synthetic coding sequence
atggcccaaggtctcgtaacgtttgccgatgtcgccatcgacttttcccaagaagaatgggcctgtctgaactctgcccaaagagatctctattgggacgttatgctcgagaattactccaacctggtaagccttgatttagagtcagcatacgagaacaaatctctgcccacagaaaagaacattcacgaaatccgtgccagtaaaaggaactctgatcgacgctctaagtctcttggcagaaattggatatgcgaaggcaccctggaacgaccccagcgtagtcgggggagatatgttaaccagatgataattaactatgtcaaacgacccgccacgagagaaggtaccccccccaggactcaccagcgtcatcacaaggaaaattcttttgagtgcaaggattgcgggaaagcattctcacggggctaccagctgtcccaacaccaaaaaattcacacaggggagaagccttacgagtgtaaagaatgtaagaaggcgttccgatggggcaaccagctcacccagcaccagaaaattcatactggcgagaagccatacgaatgtaaagattgcggaaaagcatttcggtggggttcctcactggtgatacacaagaggattcacacaggcgagaagccatatgagtgcaaggactgtggaaaggccttccggaggggggacgaactcacgcagcatcagcgcttccacactggcgagaaagactacgagtgcaaggattgcggcaagacgttctctcgggtgtataagctgatccaacacaagcgcatccattcaggcgagaagccctacgaatgtaaggactgtggaaaggcattcatctgcggctcgagtctgatacaacataaacggatccacactggggaaaagccgtatgagtgtcaagagtgcggcaaggcctttacccgcgtgaattacctgacgcagcatcagaagattcacacgggtgaaaaaccccatgagtgcaaagagtgcggcaaggcttttaggtggggcagctccctggtaaaacacgagcggatacacactggcgaaaagccatataagtgtacggagtgcggcaaggcgttcaattgtgggtatcacctcacccaacacgagcggatccataccggtgaaaccccttacaagtgcaaggagtgtggaaaggcattcatctacggatcgagtctcgttaaacacgagcggatccatacgggagtcaagccgtatggatgcacagaatgcggaaagagcttttctcacggtcatcagctcacccagcaccagaagacacactcaggagccaaaagctacgaatgcaaagaatgcggaaaagcttgcaatcacttgaaccatctgagagaacaccagcggatccataacagctag

SEQ ID NO: 141366 - DNA, 504 bp, Artificial Sequence
  Description of Artificial Sequence: Synthetic coding sequence
atggctcaggggttggtgaccttcgccgacgtggcaatagacttctcccaagaggagtgggcatgtctgaactctgctcagcgggacctatattgggatgtgatgctggaaaattattccaacctcgtgtctctcgatctggagtctgcttatgagaataaaagtcttccgacggaaaaaaatattcatgagatccgggcgtccaagcgcaatagcgacaggcgctccaagagtctgggccgtaactggatctgcgaagggactctggaacgaccccagagaagtaggggaaggtatgtgaatcagatgattattaactatgtaaagcgccccgctactagggaggggactccgcctcggactcatcaacggcaccataaagagaacagcttcgaatgcaaggattgcggcaaggccttctcacggggttaccagctaagccagcaccagaagatccacactggagagaagccgtatgagtgcaaggagtgtaaaaaagcctag

SEQ ID NO: 141367 - DNA, 303 bp, Artificial Sequence
  Description of Artificial Sequence: Synthetic coding sequence
atggcacaaggtctggtcacattcgccgatgtggccattgactttagccaggaggaatgggcctgtctgaatagtgcacagagagacctttactgggacgtgatgctcgagaactactcaaaccttgtgtccctggacctggaaagcgcatacgagaacaagagtctgcctaccgagaagaacattcacgagatacgcgcttcaaagaggaattctgacagacgctccaagagcctggggcgaaactggatctgtgaaggtactctggaacgcccccagcgcagcagaggacgctacgtgtag

SEQ ID NO: 141368 - DNA, 1998 bp, Artificial Sequence
  Description of Artificial Sequence: Synthetic coding sequence
atggagtcggttacatttgaggacgtggcagtcgagtttatccaggagtgggctctgttggattcagctcggaggagtctctgtaaatacagaatgctggaccagtgcagaacactggcctcaagagggacacccccttgcaagccttcatgcgttagtcagctggggcagcgagccgagcccaaggctactgagaggggaatcctgcgggcaacaggggtggcatgggaaagccagctgaaaccggaagagctgccctctatgcaggacctcctggaggaggccagtagccgggatatgcaaatgggcccaggcctctttttaagaatgcagcttgttcccagcatagaagagcgggaaacccccttaacacgggaggatcgccccgccctgcaggagcccccctggtcactgggatgcacagggctcaaggcagcgatgcagatccagagagtcgttattcctgttcccacacttggacaccggaacccctgggtcgctcgagattcagcagtgcccgccagagacccggcctggctgcaggaggacaaagtggaagaggaagcgatggcacccggcctgccaaccgcctgctcccaggaaccagtgactttcgccgatgtggcagtggtgtttacgccagaagagtgggtctttctggacagcactcagcggagtctgtaccgggatgtcatgctcgagaactatcgcaacctcgccagtgttgccgaccaattgtgcaagccgaacgccctgtcctatctggaagagagaggcgaacagtggactaccgacaggggcgtgctttccgatacctgtgctgaacctcagtgccaaccacaagaggccatcccgagccaggacacctttactgaaattctaagcatcgacgttaagggtgaacagccccagcctggagaaaaactctacaaatacaacgagctcgaaaaacccttcaattccattgaaccgctgttccaatatcaaagaatccacgccggggaagcctcgtgcgagtgtcaggaaatccgcaactcctttttccaatctgcccatctgatagtgccggagaagatccggtctggcgataagagctacgcgtgcaacaagtgcgaaaagtccttcagatatagctccgatttgattagacacgaaaagactcacaccgcagaaaaatgctttgactgtcaggagtgtgggcaggcgttcaaatattccagcaacctgaggagacacatgcggactcatacaggcgagaaaccctttgaatgctcccaatgcgggaagacattcactaggaactttaatctcatactgcaccagcggaaccatacgggggaaaagccgtacgaatgtaaggattgtggcaaggcattcaatcagccaagcagtctgcgctctcatgtacgaacccatacgggtgagaagcccttcgagtgtagtcagtgcggaaaggcttttcgcgaacatagcagcctgaaaactcatctgagaacacacactagagagaaaccttatgagtgtaaccagtgtggcaaaccgtttcgaacgtcaacccatttgaacgtacacaaacgtattcacacaggggagaagctttacgaatgtgccacctgtggtcaggtactctcacgtctgtctacactgaaaagtcatatgcgcacccataccggtgaaaaaccctacgtgtgccaggagtgtggcagggcattcagcgagccatcttccctacgtaagcacgctcgcacacacagcggaaaaaaaccttacgcttgtcaggagtgtggacgagccttcggacagagttcccatctgatcgtgcacgtacgcacccatagtgccggtcgcccataccagtgcaaccagtgcgaaaaggcctttcgtcactcctcttcgttgactgtgcacaagcgcactcacgtcggtagggagacaattagaaatggaagtctgcccctgagcatgagtcatccatattgcggtcccctggcaaattag

SEQ ID NO: 141369 - DNA, 549 bp, Artificial Sequence
  Description of Artificial Sequence: Synthetic coding sequence
atggaatccgtcacattcgaagatgttgccgttgaatttattcaggaatgggcactgttggacagcgcaaggcgcagcctgtgcaaatataggatgctcgatcaatgtaggacactggccagtcgtggaacgcccccttgtaaacccagttgtgtaagccaactcggtcaaagggcagagcctaaagccactgagcgtggcatactgagagccaccggagtggcctgggagagccagttaaaacccgaagaactaccatcaatgcaggatttgttggaagaggcttcttctagggacatgcagatgggccctgggctgtttctgcgcatgcagctcgtgccaagcatcgaagaaagagagacacccctaacccgtgaggaccgaccggcactccaggagcctccctggtccctaggctgtaccctgcccctgctctcgttactgcttccatcttgtccagaacctcctctggtgcttctggattcttcttccgcacccgacaggcaccttgggtccactctggacacggaagcccggggaattccctag

SEQ ID NO: 141370 - DNA, 1671 bp, Artificial Sequence
  Description of Artificial Sequence: Synthetic coding sequence
atgcagttagtgccttcaatcgaggaacgggaaaccccattaaccagggaggatcgtccagcactccaggaacccccttggagtttgggatgtactggactgaaagccgcaatgcagatacagcgagtggttattccagtgcctacactgggccatagaaatccctgggtggcaagggactccgccgtcccagcgagagatccagcatggctgcaggaagataaggtggaagaggaggccatggcacccggccttccaacggcatgtagccaggagccagtaacctttgccgatgttgctgtcgtgtttaccccggaggaatgggtgttcctcgacagtacccagagatccctgtatagggatgtcatgctggaaaactatcggaatctggcctcggtggccgatcagctgtgtaagcctaatgctctgagttacctggaggaacgcggggaacagtggactaccgatcgcggcgtgctgagcgacacttgcgccgagccacagtgtcagccccaggaggcgattccatctcaagacaccttcaccgaaattctgagcatcgatgtcaagggcgagcaacctcagccaggggaaaaactgtacaagtacaatgagctggaaaaaccatttaattcaattgaaccacttttccagtatcagaggatccacgccggtgaggcctcctgcgaatgccaggagatcagaaactccttttttcaatccgcccatctcatcgtgccagagaaaatccgatccggcgataaatcctatgcgtgtaacaaatgcgaaaagagtttcagatacagctcagacctgattcgccatgaaaagacccataccgcagaaaagtgcttcgattgccaggaatgcggtcaagcattcaaatattcttccaatctccgccgacacatgcgcactcacactggcgaaaagccctttgagtgttctcagtgtgggaagacttttactcgcaattttaatttgatcctccatcagaggaaccacacaggagagaagccatacgagtgtaaggactgcggaaaggctttcaaccagcctagcagtctcagatctcacgtgaggacccatactggcgagaaaccgtttgagtgtagccagtgtggcaaggcatttcgtgagcattcttctctgaaaacccatcttaggacccacaccagggaaaaaccttatgaatgcaatcagtgtggaaaaccatttcgtacatccacacacctgaacgtccacaaacggatccacacaggcgaaaagttgtacgagtgtgccacatgcggacaagttttgtcccggctgtccactctaaaaagccatatgaggactcataccggggagaagccttatgtgtgtcaggagtgcggaagggcgttttcagagcctagctcgttgcggaaacatgccaggactcactccggcaagaaaccctacgcctgtcaggagtgcggcagggctttcggacagagctcccaccttatcgtgcacgtgcgaactcattcagccggtaggccataccagtgtaatcaatgtgaaaaagccttccgccattccagttccctgacagtgcataagcggacacacgtcggtcgggagacaattcgaaacggatcgcttcccctctccatgtcccacccatactgcggtccgctggccaactag

SEQ ID NO: 141371 - DNA, 912 bp, Artificial Sequence
  Description of Artificial Sequence: Synthetic coding sequence
atggagtccgttacgttcgaggatgtcgcagtcgaattcattcaggaatgggccctcctcgactctgctagacgctccctctgcaagtacaggatgttggaccagtgtcggaccttggcatctcgcggaacccccccttgtaagccaagctgtgtgtctcagttgggccagcgagctgagcccaaggcgaccgaacggggtatcctaagagctacaggagtggcgtgggagtcacagctcaagcccgaggagctgccatctatgcaggaccttcttgaagaagccagctcacgcgatatgcagatgggcccgggtctgtttctgcggatgcaactcgtgccctcaattgaggaacgggaaacaccgctaacacgggaggatcggcccgcccttcaggaacctccctggagtctaggttgcactggcttgaaggccgccatgcagatccaaagggtagtgatcccggtcccaacacttgggcacaggaacccatgggttgccagagattcagctgtgcctgcacgtgaccctgcctggttgcaggaggacaaggtcgaggaagaggcaatggcccccggccttccaaccgcatgctcacaggagcccgtgacattcgccgatgttgctgtcgtgttcactcccgaagagtgggtgttcctggacagcacccagcgctccctttacagagatgtgatgctggagaactatagaaatctggcgagcgttgcggatcagctgtgtaaacctaatgctctctcctacctggaggagcgcggggagcagtggaccactgataggggggtgctcagcgatacctgtgcagaaccacagtgccaaccacaggaggctatcccttcacaggacacattcacagagatcttgtccatcgatgtcaaaggccccccaaactag

SEQ ID NO: 141372 - DNA, 3360 bp, Artificial Sequence
  Description of Artificial Sequence: Synthetic coding sequence
gcagccgaagagcggggatggcgacctcgccggtgtcgcagccaacggggaacatggcttaggaagccacgatcagaggtacccagaccatatgctccattgtcaggttcgcctccgatcaggtggagacggacccgctggagagccgcagctacacggcccctgggtcttgccggtccaaggtcacccctgagggcagcatgggtttgggcgccgtcccgcgtccggagacaacagcgacgtcggggcagacctggcgccgggagaggcatcgacgacctcgaagaagattccgattacaatccagccgaagacgaacccagaggccgtcaactgagacttcagcggcctacaccttctactccaagaccacgaagaagaccaggccggcctagaaagctgcctcggctggagatctccgaccttcccgatggtgtcgaaggggaacccctggtgagctcccagtcaggtcagtctcctcctgaaccccaggatcctgaagcccctagcagctcaggtccgggccatctcgtggccatgggaaaggtgagccgcactcctgtggaagccggagtttcccaatcggacgccgagaacgcagccccttcctgtcccgacgagcacgataccctgcctcgccggaggggtcgaccgtccaggaggtttctggggaagaaatacaggaaatactactacaagtctccaaaacctctgttgcgccccttcctgtgtcggatctgcgggtctagattcttaagccacgaggatttgaggttccatgttaattcgcacgaagccggcgaccctcagctttttaaatgcctgcagtgctcttatcgaagtcggcgatggagtagcctgaaagaacacatgtttaatcacgtcggtagcaaaccttacaagtgtgacgaatgctcctacacctccgtgtatcggaaagacgtgattagacacgccgccgtacactcgcgtgaccgtaagaagagaccagatcctacacctaagctgagcagctttccttgtcccgtctgcggacgcgtctacccgatgcagaaaaggctaacccagcacatgaaaactcattcaaccgaaaagccccatatgtgcgataaatgtggcaagagtttcaagaagcggtacacattcaagatgcatctcctgacccacatacaggcagtcgctaataggcggttcaaatgcgagttttgcgaatttgtttgtgaagacaaaaaggcgctcctcaaccaccagcttagtcatgtgtccgacaaaccttttaaatgtagcttctgcccctaccgcacctttagggaggacttcctcctcagccacgtcgcagtcaaacatacaggagcaaaaccgttcgcctgtgagtattgccacttttccacgcggcacaagaagaatctccgcctgcacgttcgatgtcgacacgcaagttcatttgaagagtggggtagaaggcatccagaagagcccccctcccgccgacgaccctttttcagtctgcagcagatcgaggagctgaaacaacaacactcagcagcccctggacctccaccctcttctcccggtccacctgagatcccacccgaggctaccacctttcagtcttcagaagcgccatccctgctctgttccgataccctcggtggagccaccatcatataccagcaaggggccgaggaaagtacagccatggcaacacagactgctctggatctcttgctgaacatgtccgctcagcgggaactagggggcacggccctgcaagtcgccgtggtcaaatcagaagatgtggaggctgggcttgcctcaccgggcggccagcccagcccagagggcgccaccccccaggtggtgacactgcatgtagccgaaccaggcggaggcgcggccgccgagtctcagctcggcccaccagacctgccacaaatcactttggccccaggacctttcggcgggaccggctacagcgtgatcaccgccccccccatggaggaaggcacctcagcccctggtacaccatacagtgaagagcccgccggggaggctgcacaggcagttgtggtttccgacacactgaaggaggctggaacccactatatcatggccaccgatgggacacaactgcaccatatcgagctcacagccgacgggagtatttcttttcccagccccgacgctttagcgtcaggcgccaagtggccgctgcttcagtgtggaggcctccctcgtgatgggccagagcctccttcccctgctaagacccattgcgtgggagacagccagtcatcagcttcatcaccaccggccacctctaaggcactgggcttagcggtacctccaagccctccttctgcagccaccgcggcttccaagaagttttcctgtaaaatctgcgccgaggcctttcctggcagagccgagatggaatcacacaaaagggcccacgcgggacctggagcattcaagtgtccagattgcccgttttcagcccgacagtggccagaggtccgggcacacatggcccagcattcaagcctgaggccccaccaatgctcacaatgtagtttcgcctctaagaacaaaaaagatcttcggagacacatgctcactcacactaaggaaaagccattcgcctgccatctgtgtgggcaacgcttcaatcgcaacgggcatctcaagtttcacattcaaagacttcattcacccgatgggaggaaatctggaaccccgaccgccagggcccccacacagacacccacccagactattatccttaattccgacgacgagacacttgctactctgcacaccgccttacagtcgtcacacggggtcctgggaccggaacgactgcagcaggctttgagccaggagcacataatagttgctcaggaacagactgtgacgaaccaggaggaagctgcctacattcaggagatcacaacggctgatgggcagaccgttcagcacctcgttacgagcgacaatcaagtccaatacatcatttcgcaggatggggtccaacatttgctgccccaggagtatgttgtcgtcccagagggacatcatatccaggtccaggaggggcaaataacccacatccagtacgagcagggcgcaccgttccttcaggagagccagatacagtacgttcccgtgtctcccggccagcagctagtgacccaggctcaattagaggccgctgctcacagcgcagtcacggccgtagctgacgcagcgatggcccaggctcagggtctcttcgggaccgatgagaccgttccagaacatatccaacagctccagcatcaaggaattgaatatgatgtaataacccttgccgatgactag

SEQ ID NO: 141373 - DNA, 4029 bp, Artificial Sequence
  Description of Artificial Sequence: Synthetic coding sequence
atggaggagaacgaggtcgagtcctcgtccgatgcagctcctggccccggtcgtcctgaagagccttccgaaagtggattgggcgtcgggacatcagaagcagtgagcgccgactcttcagatgctgcagccgcgcccgggcaggcagaagccgatgacagtggcgtgggtcaatcatcggaccgcggaagccgctcacaggaggaagtatcagaatcaagctcttcagccgacccattacctaattcatacctgcctgactcctcctcggtttctcatggaccagtggctggcgtgactggtggccctcccgcccttgtccattcctcagccttgcctgaccccaacatgctcgtgtctgactgcaccgcgtcttctagcgacttggggagcgctatcgataaaattattgagagcactatcggcccggatctgatccagaattgcattacagttacaagcgctgaagacggaggggctgagaccacaaggtatctgatactgcagggaccggatgacggtgccccaatgactagccccatgtcctcttcaacactggctcatagtctcgccgcaattgaagccttagccgatggcccgactagcacttccacctgtctcgaggcccaggggggcccctccagcccagttcaactacctcctgccagcggggccgaggaaccagatctccagagtttagaggccatgatggaagtggttgtcgtgcagcagttcaaatgcaagatgtgccagtataggtcaagtaccaaagcgaccttgcttcgccatatgcgggaacgacactttcggcccgttgctgcggctgccgcagcggctgggaagaagggaagactcaggaagtggtctacttccactaagagccaggaggaagaaggtcccgaggaggaggatgatgacgacatcgtagatgccggagctatcgacgacttggaggaggacagtgactataatccagctgaggatgaaccacgcggaagacaattacgactgcagcgcccgacccccagcaccccgcggccacggcggagacccggtcgaccgagaaaattgccccgtctggagatctccgaccttccagacggcgttgaaggagaaccgctggtaagctcacagtccgggcagtctcctccagaaccccaagacccagaggcaccttccagcagtggaccaggtcacctggtggctatggggaaagtgtccaggacacctgtggaagctggcgtatcacagtcagacgctgaaaacgccgcaccatcttgtcccgacgaacatgacactctgcctcggaggagaggccggccctcccgccgatttctgggcaaaaaatacagaaagtattactataagtcgcccaagccccttctgaggcctttcctgtgccgcatttgtggctccaggttcctaagtcacgaagatcttaggttccatgtgaactctcatgaggcaggcgatccacaactcttcaaatgccttcagtgttcatacagaagccggcgctggtcctctttaaaggagcacatgtttaatcatgtagggtcgaaaccctataaatgcgacgagtgcagctacaccagcgtgtacagaaaagatgtcatccggcacgcagccgttcacagccgcgatcggaagaaaaggcccgaccccacacccaagctctcctcttttccatgccctgtgtgtggaagggtgtacccaatgcagaaacggttgacacaacacatgaagacgcattcaacggagaaaccacacatgtgcgacaagtgtggcaagagtttcaagaaacgctacacctttaaaatgcacctgctcacacacatccaagccgtcgccaacaggcggttcaagtgtgagttctgcgagttcgtgtgcgaggacaaaaaagcactcttgaatcaccagttgtctcacgtttcagataagccgttcaaatgttctttctgcccttaccggacttttcgcgaggacttcctgctgtcgcacgtagctgtgaaacataccggtgctaagccgttcgcgtgtgagtactgccacttttcaacaagacacaagaaaaatctgagactccacgtgagatgccggcacgccagtagctttgaagaatggggacgaaggcacccggaggaacccccgtcccggcggcggcccttcttctccctgcaacaaattgaagaactcaaacagcaacattctgcagcaccagggccgcctcccagctcacccggaccccctgagattccacccgaagctacaaccttccagagctcagaggccccatcactgctatgttccgacactctagggggtgccacaataatttatcaacagggggcagaggagtctacggccatggcaactcaaactgctctggatctgctcctgaatatgagtgcacagcgcgaactcggggggacggctctgcaggttgccgtcgtgaaatcagaagacgtcgaggccggcctggcatcacccggaggacagccgagtccagagggcgccacgcctcaagtggtgacactgcatgtggccgaacctgggggcggcgctgccgccgaatcgcagctgggccctccagatttgcctcagatcactcttgctcccgggccgtttggagggaccggatactctgttatcacagctcccccgatggaggaaggcacaagcgcccctggcaccccctatagcgaagagccggccggtgaagcagctcaggccgtcgtggtctcagacactctcaaggaggctgggactcattacattatggcaaccgatggcacgcagctccatcatatcgagctgactgcggacggtagtatttctttcccttctcctgatgctctggcttctggagctaaatggccattactgcaatgcggcgggctgccccgagacgggccagaaccacctagccccgcaaagacacactgcgttggtgactcccagtcctctgcgtccagcccgcccgcaacgagcaaagccctcggcttagccgtgcccccttcccctcccagtgcagcgacagccgccagtaagaaattcagttgcaaaatttgcgccgaagcttttcccggtcgcgcagagatggaatcccacaaacgggcccacgcgggccccggcgccttcaagtgcccagactgccccttctccgcaagacagtggcccgaggtccgggcccacatggcccaacactcctccctgagaccacatcagtgctcgcaatgttctttcgcatcaaaaaataaaaaggatctgagacggcacatgctaacccacaccaaagaaaaaccctttgcctgccatctgtgtgggcagcggttcaaccgaaatggccatcttaagtttcatatccagcgtctgcattcccccgatgggaggaaaagtggcacacccaccgcacgggcccccactcaaactccaactcagactatcattctgaattctgatgatgaaaccttggctacccttcatactgccttgcagagcagccacggtgtcctcgggcctgagcgcctgcagcaggcgctgtctcaagagcacattatcgtggcccaagagcagaccgtgaccaaccaggaggaggctgcatatattcaggagattaccaccgccgatggccaaacggtgcaacacttagtcacctctgacaaccaggtacaatacatcataagccaagacggggtccagcacctgctgcctcaggagtatgtagtcgttccagagggtcaccacatccaagtacaggaagggcagataacacatatacagtatgaacaaggagcacctttcctccaggaatctcaaattcagtatgtacctgtaagtcccgggcaacaactggtgacccaggcccagctagaggcggccgcacacagtgctgtgactgccgtggctgatgccgctatggcacaggcccaagggttgtttggaaccgacgagaccgttccagagcatattcagcagcttcagcatcagggtatcgagtacgacgtgattactctggccgatgattag

SEQ ID NO: 141374 - DNA, 3564 bp, Artificial Sequence
  Description of Artificial Sequence: Synthetic coding sequence
atggccaccagctccatgcctgagtctgagcgcaacgtggccacaaaggccagtggggcccccatgacttcacccatgtccagcagtactctggcccatagtctggccgcaatcgaggctctggccgatggccccacatccacctcaacttgtttggaggcgcaagggggccccagctcccctgtccagctgcctccagccagcggcgctgaggagccagatctgcagtcactggaagccatgatggaggttgttgtggtgcagcagtttaaatgtaagatgtgtcagtatcgttccagcactaaagccacattgttgaggcatatgcgggaaaggcacttcaggccagtagccgcagcagctgctgccgccggcaaaaagggtcgcctgagaaagtggtccacatcaacgaaaagtcaggaggaagaaggcccagaagaggaagacgacgacgacatcgttgatgctggagccatcgacgatctggaggaggattccgactacaatccagctgaagatgagcccagagggcgccagcttcgattgcagagacctacccctagtacgccgcggccaagaaggagacccggccggccccggaagttgccgagactggaaataagtgatctgcctgacggggtggagggggagcctcttgtcagctcacagagcggacagtccccacccgaaccacaagaccctgaagccccttcttcctccggaccaggtcacctggtcgcaatggggaaggtcagtaggacccccgtggaagccggggtttcacagtccgacgccgagaatgcagccccgagctgccccgatgaacacgatacccttccaaggcgcagaggtcgtccatcccggcggtttctcggcaaaaagtatcgcaagtattactacaagagtcctaagccactgctgcggcctttcctctgcagaatttgcgggtcccgattcttgtcccacgaggacctccggtttcatgtgaacagccatgaagcgggcgacccacagttgttcaaatgcttgcagtgctcttacagaagccgaaggtggtcgtccctgaaggagcacatgtttaatcacgtgggctctaaaccttacaagtgtgacgagtgctcttacacaagtgtgtaccggaaggatgttattcgccatgcagctgttcacagtcgggatagaaaaaagagacctgaccctacacccaagcttagctcctttccctgtccggtgtgcggccgcgtttaccctatgcagaaacggttgacgcagcatatgaaaacccactctactgaaaagccccatatgtgcgacaagtgtggcaagtcttttaaaaaacggtatacttttaaaatgcatctgctcacgcacattcaggccgtcgcaaaccggcgctttaaatgtgagttttgtgaatttgtgtgtgaagataagaaggcgctactgaaccaccaattatcccacgtgtcagataagccttttaaatgctcattttgcccttacaggacattccgtgaagatttcctgctgtcccacgtggccgttaaacatactggtgctaagccctttgcgtgtgaatactgtcacttctcaacgcgccataaaaagaatcttcgtttgcacgtccgttgtcggcacgcaagctccttcgaggaatggggccggaggcaccctgaggaacctccatccagaagacggccttttttttcactgcagcagatcgaggagttgaagcagcagcacagcgccgctccgggaccccccccaagttctcctggtcccccagaaatccctcccgaggctaccacatttcagtccagcgaagcccccagcttgctctgcagcgacacactggggggggcaacaatcatataccagcagggcgcagaggagtctaccgccatggccacccagactgcactggacctgcttctcaacatgagcgcgcagcgcgagctgggaggaaccgctctacaggtggcagtggtcaagagtgaagacgtcgaggcagggttggccagtcctggcgggcagccgagtcctgaaggtgccactcctcaggtggtgaccttgcacgtcgcagagcctggggggggagccgccgccgagtctcagcttggtccccctgatctacctcagattacactggcccccgggccgtttggaggaacaggctatagcgtgattacagccccacctatggaggagggaacctcagcccccggtaccccctactcagaagagccggccggggaggcagctcaagcggttgttgtgagcgatactctgaaagaggcaggcacacactacattatggcgactgacggcacgcagctgcaccatatagaattaacagccgacggttccatcagttttccatcccctgatgcactcgcttctggggctaaatggccgttgctccagtgtggaggcctgccccgcgatgggcctgagcctccttcccccgccaaaacacattgtgtgggggacagccagtcaagtgccagctcccctccagctacctcgaaggccttaggtctcgcagtgccgccttcccccccatctgccgcaactgccgccagtaagaaatttagttgcaagatatgcgccgaggccttccctgggcgcgcagaaatggaatcacataagcgggcccacgctgggccaggcgccttcaagtgtccagattgtcctttcagtgcacggcagtggccagaagtccgtgcccatatggcccagcactcatcactgaggcctcaccagtgcagtcaatgtagtttcgcaagtaaaaacaagaaagacctgcgccgtcacatgttgactcatactaaagaaaaacccttcgcatgccacctctgtggccaacgatttaacaggaatggtcacttgaagtttcatatacagcggctgcactctcccgatgggcgaaaatcagggacccccacagcgcgggcaccgactcagacgcccacgcagacgatcattttgaattcagatgacgaaactctcgccaccttgcacacggcactgcagtcaagtcatggcgtgcttggcccggaaaggctgcagcaggcactgagccaggagcatatcatcgtggcacaggagcagaccgtgaccaaccaggaagaggcagcttacatacaagagattactacagccgatggacagactgtgcagcacctggttacctccgataatcaggtccagtacatcatctctcaggatggagtccaacacctattgccacaggagtacgtagtcgtacccgaaggacaccatatccaagttcaggagggacagatcactcatattcagtacgaacagggtgcgccttttcttcaggagagtcaaatccagtacgtgcctgtaagtcctggacagcaactcgtgactcaggcccagctagaagccgccgcccactcagctgttacagctgttgctgatgcggcaatggcgcaggcacaggggctgttcggcactgatgaaactgtacctgagcacatccagcagctgcaacaccaggggattgagtatgatgtgatcaccctcgccgacgactag

SEQ ID NO: 141375 - DNA, 330 bp, Artificial Sequence
  Description of Artificial Sequence: Synthetic coding sequence
atgctagagaattacagtaacctagtttccgttgggtactgcgttcacaagcccgaggtgatttttcgcctgcaacagggtgaggagccgtggaaacaggaggaggagtttccgtcgcaatccttcccagagatggggttccaccacgttcccgcaggtctgaagttgctgtcctccagcgacccgccggccttggcttcccagtccggtcggatcacaggtatgtctcactccatccccccggtgatgggctctttcaagttcacaacgtccatattcacgtgtgtgggattgttcagattcttttttttttacctgtcctggttttag

SEQ ID NO: 141376 - DNA, 417 bp, Artificial Sequence
  Description of Artificial Sequence: Synthetic coding sequence
atgaataaagtcgagcagaagagtcaagagtccgtgagctttaaggatgtgaccgtcgggtttacccaggaagaatggcagcatctcgacccctcgcagcgggcactctaccgcgatgttatgctagaaaactacagtaacttagtcagcgttgggtattgcgtgcataagccagaggtgatcttccgactccagcagggcgaggagccatggaagcaggaagaggagtttccctcacagagcttcccagaagtgtggactgctgaccacttgaaagagagaagccaggaaaaccagtcaaaacatctgtgggaggttgtgttcataaataacgaaatgctcaccaaggagcagggtgacgtgatcggtatcccattcaatgttgatgcccctgagatgctgatgcctctggactag

SEQ ID NO: 141377 - DNA, 2433 bp, Artificial Sequence
  Description of Artificial Sequence: Synthetic coding sequence
atgaacaaggtggaacagaaatcccaagaaagtgtgagcttcaaagatgtaactgtgggttttacccaggaagagtggcagcatctggaccctagccagcgcgctttgtatcgggacgtaatgctggagaactactcaaacttggtctccgtgggctactgcgttcacaagccagaagtgatattccgactgcagcaaggggaagaaccgtggaagcaggaagaagagttccccagccagagtttccctgtttggactgccgatcatctgaaagagaggagtcaagagaaccaaagtaagcatctgtgggaggtggtcttcatcaataacgaaatgctgaccaaagagcagggcgacgttattgggattccattcaatgtggacgtgtcaagcttcccatcgagaaaaatgttctgccagtgtgactcttgtggaatgagctttaacacagtcagcgaattggttatatctaaaattaactatttgggcaaaaaaagtgacgaattcaatgcgtgcggaaaacttctcctgaatatcaaacatgatgagacccatacccaggagaaaaacgaggttttgaaaaatcggaacacactttctcatcatgaagaaactcttcagcatgagaagatacagactcttgagcataactttgaatatagcatatgtcaggaaaccctgctcgagaaagctgttttcaatactcagaagagagagaacgcagaggagaacaattgcgattacaatgaattcggacgtactctttgcgactccagcagtctcctgttccatcaaatttctccaagtagggataaccactatgagttctctgattgcgagaagttcctgtgcgtgaagtctaccttgagtaagcctcatggcgtttccatgaagcattacgactgtggagaaagcggcaataactttagaagaaagctctgcttgtcccacctgcagaagggcgataaaggagagaaacactttgagtgcaacgaatgcggtaaagcgttctgggagaagtctcacttgacgcgacaccagagagtgcacacagggcagaaaccctttcaatgcaacgagtgcgagaaagccttctgggacaaaagtaatcttactaagcaccagcggtctcacactggtgagaaacccttcgagtgcaatgagtgtggaaaggccttttcacataagtcagccctgacactgcaccagaggactcataccggtgaaaaaccttatcagtgcaacgcctgcggaaagactttttgtcagaaatccgacttgactaaacatcaacgtactcataccggtctcaagccatacgagtgttacgaatgtggtaaaagttttcgcgtcaccagtcatttgaaggttcatcaacgcacccacacaggtgagaagccttttgaatgccttgagtgcggcaaatctttctcggagaagtccaatctcactcaacaccagcgaattcacattggtgataagtcgtatgagtgcaatgcctgtgggaaaacattttatcataagagtttgctaactcggcaccagattattcatactgggtggaaaccctatgaatgttacgagtgcggcaaaacattctgcctgaaatccgacttgacggttcaccagcggacccacaccggacagaagccttttgcctgtcctgaatgcggtaaatttttttcccacaaatcaaccttgagtcaacattaccggacccacaccggcgagaagccttacgaatgtcacgagtgtggaaaaatattctataataagagctacctgactaagcacaatcgtacacacaccggtgagaagccttacgagtgtaatgagtgtggcaaagcattttatcaaaaaagtcagctgacccagcaccaacggatccacatcggggaaaaaccctacaagtgcaatgaatgtggcaaggctttttgccataaaagtgcactgattgtccaccagcgcacacatacccaggagaagccctacaaatgtaacgaatgcggcaagagcttttgtgttaagagtggtcttatcttccacgaacgcaaacacacaggagagaaaccctacgagtgcaatgagtgtggaaaattctttagacataaaagcagtttgacagtacatcatcgggcacacaccggagagaagtcgtgccagtgcaacgaatgcggtaaaattttctatcgtaaaagcgaactcgcccagcatcagaggagccacacgggggaaaaaccatacgagtgcaacacgtgcaggaaaaccttctctcagaagtcgaacctgatcgtacaccaacgcaggcacattggcgagaacctgatgaatgaaatggacatccgcaatttccagcctcaggtgagccttcacaatgctagcgagtactcccactgcggagagtctcccgatgatatcctaaacgtccagtag

SEQ ID NO: 141378 - DNA, 2436 bp, Artificial Sequence
  Description of Artificial Sequence: Synthetic coding sequence
atgaataaagtggagcagaaatctcaggagagcgtgtcgttcaaagatgtcaccgtaggctttactcaggaggagtggcagcatctggatccttcacaaagggctctgtaccgcgacgtgatgctcgagaactactccaacctcgtgtcagtgggctactgtgtgcacaaaccagaggtgattttccggcttcagcaaggagaagaaccctggaagcaagaggaagaatttccctcccagagctttcccgaggtgtggacagcagaccacttgaaggaacgatcccaggagaaccagagcaagcacttgtgggaggtagtatttatcaacaatgaaatgttgaccaaggagcagggggatgttatcggtattcccttcaatgttgatgttagctcttttcctagccgaaagatgttctgtcagtgcgattcttgtgggatgtctttcaacactgtaagcgaacttgttattagcaagataaattacctggggaagaagtcagatgagtttaatgcatgtggcaagctgttactgaacatcaaacacgatgaaacacacactcaggaaaaaaacgaagttttgaagaatcgcaacacactgagccaccacgaagaaacgcttcagcatgagaagatccaaaccctcgaacacaactttgaatatagcatatgccaggaaactcttttggaaaaggctgtgtttaacacccagaaaagagagaatgccgaagaaaataactgtgactataatgagttcggcagaaccctctgcgacagttcctctctgctctttcaccagatcagccctagtagagacaatcactatgaattttccgattgtgagaaatttctgtgtgtaaagtctactttaagcaaaccacatggtgtgtcaatgaaacattacgactgtggggagtctggaaataacttccgccggaagctttgcctaagccatctacagaaaggcgacaagggcgagaagcactttgaatgcaatgaatgcggtaaggccttttgggagaagtcccacctgactcgacaccagcgggtgcacacaggccaaaaaccattccagtgcaatgaatgcgagaaagctttctgggataaaagcaatctgaccaagcaccaaagaagccacaccggcgaaaagcccttcgagtgcaatgaatgcgggaaggcattttcgcataagtcagccctgaccttacaccagagaacacacacaggcgagaaaccgtatcaatgtaacgcttgcggaaagaccttctgccagaagtctgatcttaccaaacaccagcggacccataccggtcttaagccatacgagtgttacgaatgcggaaaaagcttcagggttacaagccacttgaaagtgcatcagagaactcatactggcgagaaaccttttgagtgcctcgagtgcggaaagagttttagcgagaaatccaacctcacacaacatcagcgaattcatattggcgacaaatcgtacgaatgtaacgcttgtggtaagaccttctatcacaagagtctgcttaccaggcatcagatcatacacaccgggtggaagccatatgagtgctatgagtgtggcaagactttctgtctgaagtccgacctcacagtgcatcagaggactcacaccgggcaaaaaccgttcgcctgtccagagtgtggaaagttcttcagccacaagtccactctgtcccagcactaccgcactcacaccggcgagaaaccttacgaatgtcacgagtgcggtaagattttttataataaatcctatctgactaagcataacaggacgcacacaggcgaaaagccatatgagtgtaacgagtgtggcaaggccttctatcagaagtcccagcttactcagcaccagcgcatccacattggggaaaagccttataagtgcaatgaatgcgggaaggctttctgtcacaaatccgccctgatagtgcatcagagaacacacacgcaggaaaagccttacaaatgtaacgaatgtggcaagagcttctgcgttaagtcaggactgatttttcacgaacgcaagcacacaggggaaaaaccctatgagtgcaacgaatgcggcaaattctttagacataagagttccctcactgttcatcatagggcccatactggggagaagtcctgtcagtgcaatgaatgtggcaagattttctaccgcaagtccgaattggctcaacaccaaaggagccacacgggagaaaagccatacgagtgtaacacttgcagaaagacattttctcaaaaaagtaatttgatcgtgcatcagcgacgccatatcggcgagaatctcatgaacgaaatggatatcagaaactttcagcctcaggtatccttacataatgcttctgagtactcccactgcggggaaagtccagacgacatcctaaacgtgcaatag

SEQ ID NO: 141379 - DNA, 2454 bp, Artificial Sequence
  Description of Artificial Sequence: Synthetic coding sequence
atggccaatgctaccagacggggctccggggtggaacaaaagtctcaagagagtgtttctttcaaagatgtgactgtggggtttacgcaggaggagtggcagcatctagatcctagtcagcgagctctttatcgggacgtgatgctggaaaattatagtaacctcgtgtccgtaggatattgcgtgcacaaacccgaagtaatctttaggcttcagcagggcgaggagccctggaaacaagaggaggagttcccatcacagtcttttcctgtgtggactgccgatcacttgaaagaaaggtcccaggagaatcagagtaagcatttgtgggaggtcgtcttcattaataacgaaatgctaactaaggaacaaggggacgtgattggtatccccttcaatgtagacgtgagcagctttccctctagaaagatgttttgccaatgtgacagttgtggaatgtcattcaacactgtttccgaactcgtgatttccaaaattaactacctcggtaagaagtctgacgagtttaacgcctgcggcaagcttctgcttaatataaagcatgatgagacacatacacaggaaaaaaatgaagtactgaagaacaggaacacactttctcaccacgaagagactctgcaacacgaaaagattcagacactggaacataattttgagtattccatttgccaggagacattgctggaaaaggccgtctttaatacgcagaaacgggaaaacgccgaagagaacaactgtgattataatgagttcggacggaccctgtgtgattcgagttcactgctctttcatcagataagtccatcccgagataaccactatgaattcagtgattgcgaaaaattcctgtgcgttaagtctacactgtctaaaccacatggggtctccatgaagcattacgattgtggggagtcaggaaataactttcgacgtaagctgtgcctgtcccatctgcagaaaggagataaaggtgaaaagcacttcgagtgtaatgaatgcgggaaggccttctgggaaaagtctcacttaacacggcatcagcgtgtgcacacgggccagaaaccatttcagtgcaatgagtgcgaaaaagcattttgggacaaaagtaatttaactaaacaccagcgcagccatactggggaaaaacctttcgagtgtaacgagtgcggaaaggcattctcccacaagtctgccctaactctccaccagcgcactcacaccggcgagaagccgtatcagtgcaacgcttgtgggaagaccttttgtcagaagtcagacctgaccaagcaccagcgcacacataccggactgaagccttacgagtgttacgagtgtggcaaaagtttcagagtgactagccacctcaaagttcatcagcggacccacacaggtgagaagccatttgagtgcctggagtgtggtaaatcctttagcgaaaagagtaacctcacacaacaccagcgtatccacatcggcgataagagctacgagtgcaatgcttgcggaaagaccttctaccacaagagcctgttgacaagacatcagataatacacacaggctggaagccatatgagtgctacgagtgcggaaagacattctgcctgaagtccgatctgacagttcaccagcggactcacacaggccagaaaccatttgcctgccctgaatgcggcaagttcttctcccataagagcaccctcagccagcactaccgcacccacacaggcgaaaagccctatgaatgtcacgaatgcggtaagatcttttataataaaagttatttgaccaagcacaatcgcacccacaccggagaaaaaccatacgagtgtaacgaatgtggcaaagctttttaccagaaaagccagctgacacaacatcagagaatccatataggtgagaaaccttataaatgcaatgaatgcggaaaagccttctgccataagtctgctctgatcgttcaccagcgcacccatacacaggagaagccttataagtgtaatgagtgcggcaagtccttttgcgttaagtccgggcttatatttcacgaaaggaagcatactggcgagaagccctatgagtgtaatgagtgcgggaagtttttccggcataaatcctctctcacagtacaccatcgcgcacataccggagaaaagagttgccaatgcaacgagtgcggcaaaatcttttatcgcaaatcagagcttgctcagcaccagagatctcacacaggggagaagccctacgaatgtaacacttgccggaagacattttcccagaagtcaaatctcatcgtgcaccaacggcgccatatcggggagaacttgatgaatgagatggatattcggaactttcagccccaggtcagcttgcacaacgcctccgagtactctcactgtggggaatcacccgacgacattcttaacgtgcagtag

SEQ ID NO: 141380 - DNA, 2433 bp, Artificial Sequence
  Description of Artificial Sequence: Synthetic coding sequence
atgaataaggtggagcagaagtctcaggagagtgtgtccttcaaggatgtcactgtcgggttcacacaagaggagtggcaacacctggacccctctcaacgcgccctctatcgggatgtgatgctggaaaattactctaacctggtgagcgtgggctattgcgtgcataaacctgaggttatcttccggcttcagcagggcgaagaaccttggaaacaagaagaagaatttccaagccagtcttttcccgtctggacggcagaccatttgaaagaacgctcccaggagaaccagagcaagcacctgtgggaagttgtgtttatcaataacgaaatgctgacaaaggaacagggcgatgttataggcattccctttaacgtggacgtgagttcattcccttctcgcaaaatgttctgtcagtgcgactcctgtggaatgtcctttaataccgtaagtgagctggtgatatctaagatcaactatcttggaaagaaatctgacgaattcaacgcatgcggcaaattactgttaaacattaagcatgacgagacacatacgcaggagaagaatgaggttcttaagaacagaaatacactgagtcaccacgaggaaactctgcagcacgaaaagattcaaactttagaacataacttcgagtactccatctgtcaggagaccctgttggagaaagcggtttttaacacgcagaaacgcgagaacgctgaggaaaacaactgcgattataacgagttcggacgaacactgtgtgatagttccagccttctgttccaccagatttcaccatcaagagataaccactacgaattcagcgactgcgaaaagtttctatgcgtcaagagcacgctaagcaaaccccatggcgttagtatgaagcattatgattgtggagagtccggtaataacttccgacggaagctgtgcctgtcccatctgcaaaaaggagacaaaggtgagaaacacttcgaatgcaacgagtgcggaaaggctttttgggaaaaatcgcatctcacacgacaccagcgcgttcacacgggtcagaagcccttccagtgcaatgaatgcgaaaaggctttttgggataaaagtaatctgacaaaacaccaacgaagccacacaggggagaaacccttcgaatgtaacgagtgtggaaaggcattctcccacaagtccgcccttacattacaccagaggactcacaccggggagaagccctaccagtgcaatgcctgtggcaagacgttttgtcaaaagagcgacctgacaaagcaccaaaggactcacactggtctgaagccctacgagtgttacgagtgcggcaaatccttcagggtgacctctcacctgaaggtacatcagagaactcacactggggagaaaccattcgagtgtctcgaatgtggaaaaagtttttcagagaagtccaacctgacacagcatcaacggatacatatcggggataaatcctatgaatgcaacgcttgtggaaaaacattttaccataaatccttactgactcgacatcaaattatacatactggatggaaaccctacgaatgttatgagtgtggcaaaacattttgcctgaagtctgatttaacggtgcaccagcggacccatactggccagaagcccttcgcttgtccggaatgtggaaaattcttttcacacaagtccactctgtctcagcactaccggacacatactggggaaaaaccttacgagtgccatgagtgtggcaaaatcttttacaataagagttatcttaccaagcacaataggactcacactggtgagaaaccatatgagtgcaatgaatgtggcaaagccttctatcagaagagtcagttgactcagcaccagcgaatccatatcggagaaaaaccttataagtgtaatgaatgcgggaaggccttttgccacaagtctgcgctgatcgtgcatcagagaacccacacacaggaaaaaccatataaatgtaatgaatgcgggaagagcttttgcgtcaaatccggactgatctttcacgaaagaaaacataccggcgagaaaccctatgaatgcaacgagtgcggaaagtttttcagacataaatcatcactgaccgtccaccatcgcgctcatacaggtgaaaagtcatgtcagtgcaacgaatgtggcaaaatcttttataggaagagcgagctcgcccaacaccaacgttctcatacaggtgaaaaaccatatgagtgcaacacctgtcgaaaaactttttcccaaaagtcgaacctgattgtccaccagagacggcacatcggtgagaatttaatgaacgaaatggatatccggaattttcagccccaggtgtctctgcacaatgccagtgagtacagccattgtggagagagcccagatgacatactgaacgtccaatag

SEQ ID NO: 141381 - DNA, 417 bp, Artificial Sequence
  Description of Artificial Sequence: Synthetic coding sequence
atgaataaggttgaacaaaaatcacaggaaagcgttagcttcaaagacgtgacagtcggattcacgcaggaagaatggcaacacctggacccaagccaacgcgccctttaccgcgacgtcatgctggagaactattctaacctggtttcagtgggctactgtgtacataagcctgaggttatatttcggctccagcaaggagaggagccttggaagcaggaggaagaattccctagtcaaagcttcccagaagtctggactgctgaccatctcaaggaacggtctcaagagaaccagtcaaagcacctgtgggaggtggtgtttataaataacgaaatgctgactaaagaacaaggcgacgttattggtatcccattcaatgtggacgcccccgaaatgctcatgcccctcgactag

SEQ ID NO: 141382 - DNA, 2337 bp, Artificial Sequence
  Description of Artificial Sequence: Synthetic coding sequence
atgaacaaggtggaccagaaattccagggatccgtgtcttttaaggatgtcaccgtggggtttactcaagaggagtggcagcatttagacccatcccagcgcgccctttatagagacgtaatgctggagaattattccaaccttgtgagtgtggggtactgcgcccataagcctgaggtgatttttagacttgaacagggagaggagccctggcggctggaagaagagttcccctctcaatcatttccagaggtttggaccgccgaccaccttaaagagcgctcgcaagagaaccaatccaagcatttgtgggaggtggtgttcatcaacaacgagatgctcactaaagagcagggtaacgtcattggcattccgttcaacatggacgtgagctcttttccttcaagaaaaatgttctgtcagtacgactcccggggaatgagctttaacacagtgagtgagcttgtgataagtaaaatcaattatcttggaaagaaaagcgatgagtttaatgcttgcggaaagttgttgctgaacattaagcatgacgaaactcacacaagggaaaaaaatgaagtgctgaagaacaggaacaccctgagccaccgtgaaaacacactgcagcacgagaaaatacagaccctcgaccacaatttcgagtatagcatctgccaggaaaccctgctggagaaggctgtatttaacacccggaagagggaaaatgccgaagaaaacaactgcgattataatgagtttgggcggactttctgtgacagcagctctttactgtttcaccagatacctccaagcaaagactcccattacgagttctccgactgcgaaaagtttctgtgcgtcaagagcacgttgtctaaacacgacggagtacccgtgaagcactacgactgtggagagtcgggcaataacttcagacggaagctctgtctcagccagttacagaagggtgataagggtgagaaacacttcgagtgcaatgagtgtgggaaagccttctgggagaaatcacacctgactagacaccagagggttcacaccggagaaaaacattttcagtgtaaccagtgcggaaaaacattctgggagaagtccaatctcacaaaacaccagcgttcacacactggcgagaagccattcgagtgcaacgagtgtggcaaggcattctctcataaatcagccctcaccctccaccagaggacccacaccggagagaagccataccaatgtaacgcctgcggaaagaccttctatcagaagagcgacttaacaaagcaccagcggacccataccggacaaaagccctacgaatgctatgaatgcggcaagagcttctgcatgaattctcacctgacagttcatcagaggactcacaccggagagaagccctttgagtgtctggaatgtggcaagtccttctgccaaaagtcccacctgacgcaacaccagcgaacccacattggggataaaccgtatgagtgcaatgcttgcgggaagacattttaccacaagtcagtcttaactcgccaccagattatccacacagggttaaaaccctacgagtgttacgaatgcggtaaaactttctgcctgaaatcagatttgaccatccatcaaaggacacacaccggagagaagcccttcgcctgtcccgaatgcgggaaattcttctcgcataagtcaactttgtcacaacactaccggacccataccggggagaaaccctacgagtgccacgaatgcggaaagattttttataacaagtcctaccttacaaaacacaatcgcactcacaccggcgagaagccatatgaatgcaacgaatgcggcaagactttctgccagaaatctcagctgacccagcaccagcgcattcacatcggcgagaaaccctacgaatgcaacgaatgtggcaaggcgttctgtcataagtcagcccttatcgtgcaccagcgaacacacactcaggaaaaaccatacaaatgcaatgaatgcgggaaatccttctgcgtaaaatcaggactgatcttacacgagcgcaaacacaccggtgagaagccttacgagtgtaacgaatgcggtaagtccttctcccataagagtagcctgaccgttcatcaccgagcgcacaccggggagaagtcgtgccagtgcaacgagtgcggcaagatattctacaggaagagcgatctggcaaaacaccaacgctcccacaccggcgagaaaccctatgaatgtaatacttgtagaaagactttctcacagaaaagcaacctgatagttcaccagagaacccatatcggggaaaaaccttatgagtag

SEQ ID NO: 141383 - DNA, 2235 bp, Artificial Sequence
  Description of Artificial Sequence: Synthetic coding sequence
atgaacaaggtcgaccagaagtttcaaggaagtgtgagcttcaaagacgtcaccgtaggttttacccaggaagagtggcaacacctggatccaagccagcgcgctctatacagagatgtgatgctggaaaactatagtaacctggtgtctgtaggaaccgcggaccacctgaaagaaagatcacaggagaatcagtcaaagcacctgtgggaggtcgtgttcatcaacaatgaaatgctgacaaaagaacagggcaacgtgattggcatcccattcaacatggacgtgtcatcttttccaagtagaaagatgttctgccagtatgactccagggggatgtcattcaacacagtgtcggagctggtgatatcaaagataaattatctcggcaagaagtccgatgagtttaacgcctgcggcaaattgcttttgaatataaagcacgatgagacccacacgagagaaaagaatgaggtgctgaagaatcgaaatacactgtcacatagagagaatactttgcagcatgagaaaatccagacattagatcataactttgagtattctatttgccaggaaaccttactggaaaaggctgtctttaacacccgcaagagagaaaatgccgaagaaaataactgcgattacaacgagttcggaaggacattctgcgactcatcttctctcctgtttcaccagattcctccaagcaaggactctcactacgagtttagtgattgtgagaagttcctgtgtgtcaaatccactttgagtaagcatgacggagttcccgttaaacactacgactgcggagagagcggcaacaactttaggcgcaaactgtgcctgtctcagctgcagaagggtgataagggtgaaaagcactttgagtgcaatgagtgcggtaaagccttttgggaaaagtcacatcttactaggcaccagagagttcataccggggaaaagcacttccagtgcaaccagtgcggcaagactttctgggaaaaatccaatctcaccaagcatcagaggagtcacactggcgagaagccatttgagtgcaacgagtgcggtaaggcgttcagccacaagagcgctctgactcttcaccagaggacacacactggggaaaagccataccagtgcaacgcatgcggaaagaccttctaccagaagtcagacctaacaaagcatcagagaacccacacgggacagaaaccatacgagtgctacgaatgcgggaagtctttctgtatgaatagccatctcaccgttcatcaacgcacccacaccggggaaaagcccttcgagtgtctggagtgtgggaagagtttctgccagaagagtcatctcacacagcaccagcgcactcacatcggcgacaagccatacgagtgcaatgcgtgtggcaagactttttatcacaaatctgtgctcactaggcatcagattatccatactggactgaagccttacgaatgttacgagtgtggcaaaactttctgcttgaagagcgacctaactatccaccagagaacccataccggcgagaagccatttgcctgtcctgaatgtggtaagtttttctctcacaagtccaccctgagtcagcactatcgaacgcatacgggtgagaaaccttatgagtgtcacgaatgtgggaaaatattttataataagtcataccttaccaagcataaccgcacccatacgggtgagaagccttacgagtgcaacgagtgcggcaagacgttctgccagaaatcacagcttacccagcatcagaggatacatattggcgaaaaaccatatgaatgcaacgagtgcgggaaagcattttgtcacaagagcgccctgatcgttcaccagcgtacccacactcaggaaaagccttacaaatgtaatgaatgtggaaaatccttttgcgtgaaaagcggcctgatcttgcacgaacggaagcatacgggagagaaaccttacgaatgtaacgaatgtggaaagagtttttcccacaagagctcacttaccgtgcaccatagggcacacacgggtgagaagtcatgtcagtgcaatgagtgtggaaagatattttaccggaagtctgatttagctaagcaccagcgctctcacactggggaaaagccgtacgagtgtaacacctgtaggaaaacgttctctcagaaaagcaatcttattgtgcaccagcgaacacatataggcgagaagccttatgagtag

SEQ ID NO: 141384 - DNA, 1683 bp, Artificial Sequence
  Description of Artificial Sequence: Synthetic coding sequence
atgctgctacttcttagcgaccagctgctgctaactgccctgcgtaagccgaatccgcaggccatggcagccctgtttcttagcgccccccctcaggctgaagttacgttcgaagatgtggcagtgtatctctctagggaggagtggggtcgcctgggacccgcccagagaggcctatacagagatgtcatgctggaaacttacggtaaccttgtgagtctcggagttggtcccgctgggccaaagccgggcgtaattagccagctagagaggggtgacgagccttgggttcttgacgtgcagggaacatcaggaaaagagcatttgagggtgaatagccctgctctcggaactagaaccgaatataaggagcttacgtctcaggaaacatttggagaggaggacccccagggctccgagccagtggaggcatgcgatcatattagtaaaagcgaaggatcactggagaagctggttgagcagaggggcccaagagccgtcaccttgacaaacggtgagtcttcccgggaatccggcggtaatctgcggcttctctctaggccagtgccggaccagagaccccacaagtgtgatatttgcgaacaatccttcgagcagaggagctacctgaataaccataaacgtgtgcataggagtaagaaaacaaacacggtccggaattctggagaaatcttttccgccaatctggtagtgaaggaggatcagaaaataccaactggtaaaaaattacattactgctcttactgtggaaagactttccgctatagcgccaatttggtgaagcatcaaaggctacatacagaagagaagccttataaatgcgatgagtgcggtaaagcattttcccaaagctgcgaatttatcaaccataggcggatgcattctggggaaattccttacaggtgcgacgagtgcggcaaaactttcaccaggaggcctaatcttatgaaacaccaaagaatccacaccggggagaagccctacaagtgcggggagtgcggcaaacacttttcggcgtactcttctctgatttatcaccagcggatccatactggagagaagccatacaaatgtaacgattgtggaaaagctttctccgatggctctattttgattagacacagaaggactcatacgggggaaaaaccctttgagtgtaaggagtgcggcaaggggttcacacagtcttccaatctcatccagcatcagcgcatacacaccggagagaagccctataaatgtaatgagtgtgagaaggcttttatccagaaaacaaaactagttgagcatcagagatcacacacaggtgagaagccttatgagtgtaatgattgcggcaaagtatttagccagtccacacatctgattcaacatcaacggattcacactggcgagaagccatacaaatgttcggagtgtggaaaggctttccacaactcctcacgtctcattcatcaccagcggctgcaccatggcgaaaaaccctaccgctgttccgactgcaagaaggccttctcccagtccacatacctgattcagcatagacgcattcacacaggagagaagccctataaatgcagtgagtgcggtaaggctttccggcactcatcaaacatgtgtcagcatcagaggatccatctcagagaagacttctcaatgtag

SEQ ID NO: 141385 - DNA, 1620 bp, Artificial Sequence
  Description of Artificial Sequence: Synthetic coding sequence
atggccgccctgttcttgtcggctccaccacaagctgaagtcacctttgaggacgtcgcagtgtatctgtcccgcgaggaatgggggcgccttggtccggcacagagggggttgtacagagacgtcatgctggaaacctatggaaatctggtttctttaggggtaggccccgccgggcctaaaccaggcgtcatctctcaactggaaagaggggacgaaccttgggttcttgatgtgcaaggcacatcaggcaaggagcacctgcgcgttaattctccagccctcgggactcggactgagtacaaggagctgacctcacaggaaacctttggagaggaggatccacagggctccgagcctgtagaggcctgtgaccatatatctaaatccgagggaagtttggaaaagttggtcgagcagagaggtccacgcgcagtgaccctcactaatggtgagtcctcaagagaaagcggtgggaacctccgcctgctcagtcgccctgtgccagatcagcgaccccataagtgtgatatttgtgagcagagctttgagcagcggtcatatcttaacaatcacaaaagagtccaccgcagtaagaaaaccaatacagttcgaaacagcggcgagatcttcagcgctaacttagtagtgaaagaagaccaaaaaatccctactgggaaaaaactacattattgctcttactgcggtaagacgttccgctattccgccaatctggtaaaacaccagcgactccatactgaggaaaaaccttacaagtgcgacgagtgcgggaaagcattcagccagtcctgtgaattcattaatcaccggcgcatgcactccggggaaattccctatcggtgcgatgaatgcggcaagacctttacccgaaggcccaatctgatgaagcaccagagaattcacaccggtgagaagccttataagtgcggggaatgcggaaagcattttagcgcttactcgtctttgatttaccatcaaagaattcacactggagagaaaccgtacaagtgtaatgactgcggaaaggccttctcagatggctcgatactcatcaggcacaggagaacccataccggggagaagcccttcgagtgtaaggaatgtggaaaaggattcactcagtcttctaatctgattcagcaccaacggatccacacaggggagaaaccttacaagtgcaatgagtgtgagaaagctttcatacaaaagacgaagctcgttgaacaccagaggtcacatacaggcgaaaaaccatacgaatgcaacgactgcggaaaagtgttctcccagtcaactcatttgatccagcaccagcgcatccataccggagagaaaccttacaagtgtagtgaatgcggtaaggcctttcacaattctagtaggctcatccaccaccagaggcttcaccacggcgagaagccatatcgctgctctgactgcaagaaagccttttctcagtccacctatcttatccagcaccgacggatccacaccggagagaagccgtataaatgctcagaatgtgggaaagccttccgacattcatctaatatgtgtcaacatcaaagaatacatctgcgtgaggacttctcaatgtag

SEQ ID NO: 141386 - DNA, 1560 bp, Artificial Sequence
  Description of Artificial Sequence: Synthetic coding sequence
atgtacctgatccgcgaatcgcatgccagcgggtcatcttccgtaacctcaagttgctctctgccaagcgaatctccaacactccgccagtggcggccttgtagttgtctcccacacccccggcctggcgttatatcgcaactagagagaggtgacgagccatgggtgttggacgtacagggcacttcgggcaaagaacaccttcgcgtaaattctcctgctcttggaacccggactgagtataaagagctgaccagccaggaaaccttcggcgaagaggatccccagggctctgaaccagtggaagcatgtgatcatattagcaagtccgaggggtcactggagaaactggtcgagcaaagggggccaagagccgtgacattgacaaatggggaaagttctagagagtcaggggggaatttgcgccttttgagtaggccagtgcccgaccaacggccacacaagtgcgacatctgtgaacaatccttcgagcaacgctcatacttgaacaatcacaagcgagtgcaccgttccaagaagacgaataccgtccgtaacagcggggagattttcagtgcgaatctggtggtcaaggaggaccagaaaatcccaaccggcaaaaagctccactactgctcctattgtggaaagacattccgatattcagcaaacttggttaagcaccaacgtctgcataccgaggagaagccctacaagtgcgatgaatgtgggaaggcattctctcagtcctgtgaattcattaaccataggagaatgcatagcggggaaatcccctaccgatgtgatgaatgcggtaaaactttcacacggaggccaaatttgatgaagcaccagcggatccacaccggtgagaagccctacaaatgcggagagtgcggtaaacacttttctgcatattcttccctcatttatcatcagagaatccataccggggaaaagccatacaagtgcaatgattgcggaaaggctttctctgatggctctatccttatcagacacagacgaacacacaccggcgaaaaacccttcgaatgtaaagagtgtggtaagggcttcacccagagctccaacctaattcagcaccagcgtattcataccggcgagaagccatataaatgtaacgagtgtgaaaaagcttttattcaaaagactaaactggttgagcatcagcgcagccatactggcgaaaaaccctacgagtgcaacgactgtggcaaagtgttctcccagtccacccaccttattcagcaccaacgcattcataccggagaaaagccttataagtgctccgagtgcgggaaggcttttcataactcatccagactcatacaccaccagcgtctccaccatggcgagaagccatatcggtgctctgactgtaagaaggctttttctcagtccacatatctgattcagcatcgcaggatacacaccggggagaaaccatataagtgtagtgaatgtgggaaggcttttcgacactccagcaacatgtgccagcaccagcggatccatctccgggaggatttctctatgtag

SEQ ID NO: 141387 - DNA, 1584 bp, Artificial Sequence
  Description of Artificial Sequence: Synthetic coding sequence
atgaccgccgagctgagagaagccatggctcttgccccatgggggcccgtgaaggtaaagaaggaagaggaagaagaagaaaacttccccggtcaagcttctagtcagcaggtccactccgaaaacatcaaggtctgggccccagtacaaggattgcaaaccggtctggatggtagtgaggaggaggagaaaggccagaatattagttgggacatggctgtggttctgaaggcaactcaagaggctcctgcagccagtaccctgggcagctacagcctgccaggcactttagcgaaaagtgagattctagaaacccatggcaccatgaactttttgggcgccgaaacaaagaacctgcaacttctggttcccaagaccgaaatttgcgaagaagctgaaaaacccttgattatttccgaacgaattcagaaggcagatccccaggggcccgagttgggggaggcctgcgagaagggaaacatgttgaaaaggcagaggatcaaacgggaaaagaaggattttcgtcaagtgattgtgaatgattgtcatcttcctgaaagcttcaaagaagaggagaatcagaaatgtaagaagtcaggtggcaagtacagccttaattcgggggcagttaaaaaccccaagactcagctgggccagaagccctttacctgttcagtttgcggcaaaggcttctcacagtcagccaaccttgtcgttcatcagcggatacatacaggagaaaagccattcgagtgtcatgagtgcggcaaagcatttattcagtctgcgaaccttgtggtccatcaaagaatacataccggacagaaaccatacgtatgctctaaatgcggtaaagcctttacacagtcgagtaacctcacagtccatcagaagatacattcccttgaaaagactttcaagtgcaacgagtgtgaaaaggctttttcatattcgtcacagctggcccgtcatcaaaaagtccatattacggagaagtgttatgagtgtaacgagtgcggcaagacctttaccagatcgtccaacctcatcgtgcaccaaagaattcatacaggcgagaagccattcgcttgcaacgattgtggaaaggccttcactcagagcgccaatctcattgtacaccagaggtcccacaccggcgagaagccttatgagtgtaaagagtgtggcaaagcattttcctgcttttctcacctgattgtacaccaacgcatccacactgccgaaaaaccctatgattgctctgagtgtgggaaggcattctcccaactgtcttgtctcatcgttcaccaaaggatccattctggggatctcccttatgtttgtaatgagtgcgggaaggccttcacttgtagctcctatctgcttatccaccagcgcatccacaacggagagaaaccctatacctgcaacgaatgcgggaaggctttcaggcagcgatcctcccttaccgtgcaccagagaacccatactggagagaagccatatgaatgtgagaagtgtggagcagcttttatcagcaatagccatctgatgcgtcatcaccgcacgcatcttgtggagtag

SEQ ID NO: 141388 - DNA, 405 bp, Artificial Sequence
  Description of Artificial Sequence: Synthetic coding sequence
atgacagcagagctgagagaagcaatggcactcgccccgtggggccccgtcaaagtgaagaaggaggaggaggaagaagaaaactttcccggacaggcttcttcgcagcaggtccacagcgaaaatatcaaggtatgggcacctgtccagggcctgcaaactgggctggacgggtccgaggaggaagaaaaagggcagaacattagctgggatatggccgtcgtacttaaggcgacgcaagaggcacccgccgcatcgacactggggagctattccctacccgggacattagccaaaagcgagatcctggagacccacggcacgatgaacttcctgggcgccgagaccaaaaatctgcagctgctggtgccaaaaaccgagatctgcgaggaagccgagaaatag

SEQ ID NO: 141389 - DNA, 339 bp, Artificial Sequence
  Description of Artificial Sequence: Synthetic coding sequence
atgacagccgagctccgggaagcgatggccctggccccttggggcccggttaaagttaagaaggaggaagaggaagaggagaacttccccggccaggcttcctctcagcaagtccattctgagaatataaaagtgtgggctcccgtgcagggtctccagaccggcctggacggctcggaggaagaggaaaaagggcagaatatttcatgggacatggccgtggtgctgaaggcgacacaagaagcacccgccgcctcgaccttaggttcgtactccctgcccggtaccctagctaaaagcgagatcttagaaactcacggaactatgaattttttgtag

SEQ ID NO: 141390 - DNA, 1104 bp, Artificial Sequence
  Description of Artificial Sequence: Synthetic coding sequence
atgttaaagcgtcagcggatcaagcgcgaaaagaaggacttcaggcaggttattgtgaatgattgccacttaccggaaagtttcaaggaggaggagaaccagaaatgcaaaaagagcggaggtaagtattctctgaactctggggccgtcaaaaacccaaaaactcagttaggccagaaaccatttacttgttctgtttgtggaaaggggttttctcagtccgccaatctggttgtacatcagagaattcacaccggcgaaaagccgttcgagtgccacgaatgtggcaaggcgtttattcagtccgccaacctggtggtgcaccagaggatacacaccgggcaaaaaccctatgtgtgtagcaagtgcgggaaggcctttactcagagtagcaatctgactgtgcaccagaaaattcactcacttgagaaaaccttcaaatgcaacgagtgtgagaaagcctttagttattcaagccagctcgcaagacaccagaaagtgcatattaccgaaaagtgttacgaatgcaacgagtgtggcaaaacattcacacgaagctcaaatctcatcgtgcatcagcgcattcacactggagagaaaccttttgcctgtaacgattgcggcaaggcttttacacagtcggccaatctgatagtccaccagcgaagtcatacgggcgaaaagccatatgaatgtaaggagtgcggaaaggctttcagctgtttttcacaccttatcgtacaccagcgcattcatactgccgaaaaaccatatgattgcagcgagtgtggcaaggctttctcccagttgagctgtctgatcgtacatcagcgcatacacagtggcgatctgccctacgtttgcaacgaatgtggtaaagcctttacttgctcctcctacctcctaatacaccagaggatccataacggagaaaagccctacacgtgtaacgaatgtggcaaggcgttccggcaaagaagttcactgaccgttcaccaacggacccacacaggggaaaagccgtacgagtgcgaaaaatgtggtgccgcctttatatccaattcacaccttatgagacaccacaggacacacttggtggagtag

SEQ ID NO: 141391 - DNA, 981 bp, Artificial Sequence
  Description of Artificial Sequence: Synthetic coding sequence
atggatttaaccgctatctatgagtcactcctgtctttgtctcctgatgtgccagtaccatcagaccatggggggactgaatcttcacctggctggggcagttcggggccctggagtctctccccatccgacagttcgccaagtggcgttacctcacgcctcccagggcgaagcacctccctcgtggaagggaggtcatgcggatgggttcctccgccccctggttttgcgccgctagcaccaagactcggaccggaactgtctcccagtcccacctccccaacggccacctccacaaccccatctcggtataagaccgagctgtgtagaactttctccgagtcagggcggtgtaggtatggggctaaatgtcaattcgcgcatgggctgggcgaattgagacaagctaacaggcatcccaagtacaaaaccgaactgtgccacaagttctacctccagggcagatgcccatacgggtcccggtgtcacttcatccacaacccatcggaagatttagcggctcccggtcatccgcctgtacttcggcagagcatttccttctctggcttgccctccggaagaagaacctcgcctcccccgccgggactagcaggtccaagtctgagcagctcatcattctccccatcttcttcccctcccccaccaggggatctgccactttccccatctgctttttccgcagcccctggcacccctctagcccgaagagatccaacgcctgtttgttgcccttcttgtagacgggccacacccatttccgtttggggtccactgggtggactagtgcgaacccctagcgtccagtcgcttggttccgatccggatgaatatgctagtagtgggagcagccttggagggtcagacagtcctgtctttgaggccggagtgtttgcaccaccccaacctgtcgcggccccccgccgcctgcccattttcaaccggatttcagtgagtgagtag

SEQ ID NO: 141392 - DNA, 1017 bp, Artificial Sequence
  Description of Artificial Sequence: Synthetic coding sequence
atgacaacgaccctggtatccgccacaatcttcgatctatctgaggtgttgtgcaaagggaacaaaatgctgaactattccgccccttcagcaggcggttgtctgttggacagaaaagctgtagggactccggccggaggcggatttccgagacgacatagtgtaactcttcccagctcgaagtttcatcagaatcagttgctgtcatccctgaaaggcgagcctgcgcccgctctttcttcaagagatagccgctttcgcgaccgcagtttcagtgaaggaggagaacggctactgcccacccagaaacagcccggtggcgggcaggtaaattcgagccggtataagacagagctctgtcgaccctttgaagagaacggtgcctgtaagtacggagataagtgccagttcgctcacggcattcatgaactcaggagcctcactcgccaccccaagtataaaaccgagctttgtagaactttccacacaattggcttctgtccttacggaccacggtgtcatttcatccacaacgctgaggaacgccgcgccttggcaggggcaagggacctgagcgccgataggcccaggcttcagcatagcttttctttcgccgggtttccatccgccgccgctaccgcagcagccactggcctgttggactcgcccacctccatcacaccccccccaatactgagtgccgacgacctacttggctcacctactctgcccgacggtaccaataacccattcgccttctctagccaggaactcgcttctctgttcgcccccagcatgggactccctggcggagggagccccacaactttcctgtttcggcccatgtcagagtctccacatatgtttgacagtccaccttctccccaggatagcctctcagaccaagaaggatatctatcctcctcaagttctagccactccggcagcgattctcctactctcgacaactcccgacggctcccgatattttccagattgtcaattagcgatgattag

SEQ ID NO: 141393 - DNA, 501 bp, Artificial Sequence
  Description of Artificial Sequence: Synthetic coding sequence
atgaatacatatacgcgaagtgcatcgtttactccaaagacctttactttccctctggcccaaaatcgtactagtcatccaactacaacctctaagttaaagtacctgggccgcccttcacctagacgagatgccttgcaggccaatggcgagggccccgaagtcggccccggcaccgaggagcctgcccaccggcttccggttggctccggaagtgctggagaggccgcagcctccctgggaacagcgcgggttcggtctggccgtgcagagtgcacggccaaattagcaggagatggacacgcgcgcttagccagcgctttcctgcatagaagagctgcattacctccacccctgggcacatgccggcctaggctgggagagggcggttccgctcccgcactgggccccagcccccgacggggcagaagagtgagtgagggtcttcgcgactccctaccccctcttggcagcctgaccctgggcaaaagtccgaagtag

SEQ ID NO: 141394 - DNA, 966 bp, Artificial Sequence
  Description of Artificial Sequence: Synthetic coding sequence
atgaccacaaccttggtgtcagccactattttcgatttgtctgaggtgctgtgcaagggaaataaaatgctgaactattctgccccatcagcaggcggctgcctgctggatcgcaaagcagtagggaccccggccggtggtgggtttccacgtagacattctgttactcttccttcgtcaaaatttcaccagaaccagttgctatctagtttaaagggagaaccggctccagcactgtccagtcgcgacagccggtttagggacaggtccttctccgaaggtggggagcggcttctgcccacgcagaaacagccctttgaagagaatggtgcttgcaaatatggggacaaatgtcagtttgctcacggtatccacgagctgaggtctctcacacgacatccaaaatataagactgagctctgtcggacatttcataccatcggcttctgcccctacgggccaaggtgtcattttatccacaatgctgaagagcggagagcgcttgccggtgcgcgcgacttaagtgctgatcgtcctcggcttcagcactctttttctttcgccggatttccgtctgccgccgctaccgccgcagcaactggcttacttgacagccctactagtattacacccccacctatcctgtcggctgacgaccttctgggctctccaacactccctgatggcactaataatccttttgcattttccagccaagagctggcttcccttttcgccccttctatgggcctgccaggtggcggctcccctacaacgtttctcttccggccaatgagtgaatccccccacatgttcgattcccctcctagccctcaggacagtctgtcagaccaggaaggttacttgagttctagtagttcatcccatagcgggagcgactcacccacgcttgacaactctagaagactgccaatcttctcacgattgtccatcagtgacgattag

SEQ ID NO: 141395 - DNA, 1017 bp, Artificial Sequence
  Description of Artificial Sequence: Synthetic coding sequence
atgaccacgacgctggtgagcgcaaccatcttcgacctttctgaagtgttgtgtaaggggaataagatgctgaactatagtgccccctcagccggcggctgtcttttggatagaaaggccgtgggaacccctgctggcggtggattcccacgccggcacagtgtgactctaccaagttctaaattccaccagaaccagctccttagttctctcaagggagagccagcccctgccctctcctcacgtgattcgaggtttagggacaggagctttagtgaggggggcgagcggctgttgcccacacaaaagcagccaggaggcggccaggtgaacagtagtcgatacaagaccgagctatgtcgcccattcgaggaaaacggcgcttgcaaatatggggacaagtgtcagtttgcacacggcatccacgaactccggagcctgactaggcaccctaaatataagactgagttgtgtaggacatttcatacaattggattctgtccttacggtcccagatgccattttatccacaacgcggaggaacgacgcgcactcgccggggctcgggatctctcagcagatagaccgagacttcagcattccttctctttcgccggattcccttcggccgccgcaacagcggctgcaactggcctcctggacagccctacgtctataactccacctccaatcctctcagctgatgacctcctcggctctccaaccctgcctgatggaactaacaatccgttcgctttcagttcccaggagctggcctctctgtttgctcccagcatggggttgcctggcggcggctcaccaaccaccttccttttcaggcctatgtcagagtcaccccatatgtttgacagccctcccagcccgcaagattcactcagtgatcaggagggttatctcagcagttctagctccagtcattctggaagcgactctcctactctggacaactcccggcgcctgccaatatttagccgcctctctatttcggacgattag

SEQ ID NO: 141396 - DNA, 1485 bp, Artificial Sequence
  Description of Artificial Sequence: Synthetic coding sequence
atgtccactaccctcctctcagccttctacgacgtcgacttcttgtgtaaaacggagaaaagcctcgctaacttaaatctgaacaatatgctcgataaaaaggcagtgggcacaccagttgctgctgcgccttcaagtggcttcgccccgggttttctccggcgacactctgcaagtaatcttcacgcactcgcccatcccgccccaagtcccgggtcctgtagtcccaagtttccaggcgcagctaacggtagcagctgcgggtccgctgcagctggaggtccaacctcttacggcacacttaaggaaccctcaggcggagggggtactgccctactgaacaaagagaacaagtttcgcgataggagtttttccgagaacggcgatcggagccagcaccttctccatctccagcaacagcagaagggaggcggcggttctcagataaactcgactagatacaagaccgagttgtgtcgcccctttgaagagtcaggaacatgcaagtacggagaaaaatgccaattcgctcacggctttcatgagcttaggtccctgactaggcaccctaagtataaaacagaactctgtcggacatttcacaccattggcttctgcccatacggtccccggtgtcacttcattcataacgccgatgagcgtaggccagctccctccggaggggcatcgggggacctccgcgccttcggcactcgggacgctttacacctggggttcccaagggaacccaggccaaagctccaccactctctgagcttcagcgggttcccttcaggccatcaccaacctcccggagggctggagtcacccctcctcctcgatagcccgacatcaaggacacctccccctccttcttgcagttctgctagtagttgctcctctagtgcgtcgtcctgtagctccgcatccgcggctagtaccccctccggcgcacccacttgttgtgcctccgccgccgctgcagccgctgccgccttgctgtatggaactggtggggccgaggaccttcttgccccgggcgcaccatgtgctgcatgcagctccgcgtcttgtgctaacaacgcttttgctttcggcccagaattgtcctctctgattactcccctggcaattcaaactcataatttcgcagccgtggccgcagcggcttactatagatcacagcaacagcaacagcaacagggtttagctcccccagcccagccacctgccccacctagtgccacccttcctgccggcgccgcggccccgcccagtccccctttctctttccagctgccccgacggctgtcagactctccagtcttcgacgctcccccgtctcccccagatagcctgtccgaccgcgatagctatctctccggaagcctttcatccggatctctttcgggaagcgagtctccatctctggatcctggtaggcggcttcctatcttctccaggctaagcatcagtgacgactag

SEQ ID NO: 141397 - DNA, 651 bp, Artificial Sequence
  Description of Artificial Sequence: Synthetic coding sequence
atgagtgctcttggacagatcaccatcactgtttcccgctgctggaacaccgagagaaaccaaaccgacaagaacccttgcctccatggcgcttatctgcagttgcgggagacagtgaagaataagtcaactcacctgaaaaagcctctcatgaaacaggcacccccatggaaggaccaccttacattccagcctctgcacccagccgagcgaaaaacccaagtttggcggtggcagtccgggaacagcagtgatcttgaaaccacatctagtgcctcaccctggcccaccgggtccaacagggacgtagtactgaacactttggctgaatcttgctgcggactctcggagttaatcactgcccctccctacgctggcgtgagcatccagggtttttcccagatttgggtgcttttccctttctgtggcggcacattccaccacaacgagaaagacgttctcgggcttcaggacttcgagcgagagtcggtgtccacttcccagtcccggaatatttcgcttctcactctgggccagttgcagaattgcgttataggaaaactaacaattatcgatctcctgacagagcatcttcttggagtgaggcatggagtcatttgttttccttgggggctaccaagttcctcttag

SEQ ID NO: 141398 - DNA, 1224 bp, Artificial Sequence
  Description of Artificial Sequence: Synthetic coding sequence
atgcagcagaaggcattcgaagaatcacggtatccttggcaggaaagcttcgaaaatgtcgccgtatgcctccctttaagatgccctaggtgcggggatcacacaagattccgttctctgagttcattacgagctcatttggagttctcgcatagctatgaggagagaacattgctcacgaagtgctctctgtttcccagtttgaaagacaccgatctggtcacaagctctgaactgctgaagcccggaaagttacaaagcagtggaaacgtggtgaagcagaagcccagctatgttaacttgtactcgattagccacgaacactccaaagatcgcaagccttttgaagttgtggcggagcgaccggtgtcttatgtgcagacgtacactgctatggatctgcacgcggactccttagacggaacaagatcggggcctggactacccaccagcgataccaaggcaagtttcgaagcccatgtgagagaaaaatttaacaggatggtggaggcagtggataggacgattgaaaagcgcattgacaaattgaccaaagagttggcacaaaaaaccgccgaacttctggaagtgcgcgcagccttcgtgcaacttactcagaaaaagcaggaggtccaaaggagagaaagagccctcaacagacaggtggatgtggctgtggaaatgattgcagttctgcggcaacggttaaccgaaagtgaggaggagttgctgaggaaggaggaggaggtggtgacgtttaatcactttttggaggccgccgccgagaaagaagttcaaggaaaggctcgtttacaagattttatagagaacctgctccagcgggtggaactggccgagaagcaactagagtactatcaaagtcagcaggcctctgggtttgtccgtgacctttccggccacgttctcacggacatatcctctaaccggaaaccaaagtgcctcagtaggggtcatccccactccgtctgcaatcaccccgatctcaaggcgcatttccacccaaaggggcgcaaccatttgaagaaagctaaagacgaccgcgcctcaatgcagccagcaaaagccatccatgagcaggccgagagttcgagagacctttgtcgcccgccaaagaagggggaattgcttggcttcggacgaaagggcaatattaggccaaaaatggcaaagaagaaaccaacagctatcgtgaacatcatctag

SEQ ID NO: 141399 - DNA, 1002 bp, Artificial Sequence
  Description of Artificial Sequence: Synthetic coding sequence
atgcaacagaaggcctttgaagagtcacgctacccgtggcaggaaagtttcgagaatgttgctgtttgtctaccactgcgctgccctagatgtggggaccacacgagatttcggtctctaagctcgttgcgcgctcacttagaattctctcattcctacgaagaacgtactctgcttacgaagtgctctctgtttccctcactcaaggacaccgaccttgtcaccagtagtgagctgctcaagcccggaaagctgcagtcatctggtaacgtggtgaaacaaaagccgtcttacgtgaatttatattcaatctcacacgaacactcaaaggacagaaaaccattcgaggtagtggccgagcggcctgtttcttacgtgcagacgtacactgcaatggacttgcatgcagacagtcttgatggcacaagaagtggcccaggcctcccaacctctgataccaaagcaagctttgaggcccacgtgcgagaaaagttcaaccggatggtcgaggctgtagaccgtaccatcgaaaaacggattgataaactgacaaaggagcttgcacagaagacggccgagcttctggaagtaagagctgcgttcgtgcagctgacccagaaaaagcaagaggtgcagcggcgcgaaagggcacttaatcggcaggtcgacgtggccgtagaaatgatcgcagttctgaggcagaggttgactgaaagtgaggaagagctcctgcgaaaggaggaagaagtggtgactttcaatcatttcctagaggctgctgcagaaaaggaagtgcaggggaaggcccgcctgcaggattttatcgaaaatttgctgcagagagttgaactcgccgagaagcagttggagtattaccagtcccagcaagcgtccgggttcgtaagggatctaagtggtcatgtctcatggaaaggagccggagaggctcgcctggtttgtcagaatgacctcgagctggaggagtctgccattgtggaatag

SEQ ID NO: 141400 - DNA, 1389 bp, Artificial Sequence
  Description of Artificial Sequence: Synthetic coding sequence
atgcagcagaaagctttcgaagagtctcgatatccatggcaggaatccttcgaaaacgtggcggtttgtctgccgttaagatgtcctaggtgcggtgaccatacaaggtttaggtcccttagtagtctccgagcccacctcgagttttctcactcttacgaagagagaacgctgcttacgaaatgtagtctcttcccctcactaaaagatacagatctcgtgactagttcggaactgttaaaaccaggcaagctccaaagctccggcaatgtggtgaaacaaaaaccgagttacgtgaacctctattccatctcccacgaacactccaaggaccgtaagcctttcgaggtggtcgccgagcgtccagtttcttacgtgcaaacttatactgcaatggatctgcacgcagatagcttggatggaacccggagtggccctggcctgcccacaagcgacacaaaggccagtttcgaggctcacgtgagagagaagttcaaccgaatggttgaagctgtggacaggaccatcgaaaaacgcatcgataagttaacaaaagagcttgctcagaaaaccgcagaactgcttgaggtccgggctgccttcgtccaactgacacagaagaaacaggaagtgcagcggagagaacgtgccctcaatcgccaggtagatgtcgccgtggaaatgatcgcagttttgcgtcagagactgacagagtccgaagaggagctcctccggaaagaagaagaggtcgtgacttttaaccattttctggaggctgcagctgagaaggaggttcaggggaaagctaggctgcaggacttcattgaaaacttgctccagagagtagaattggccgagaaacagttggagtactaccagtcacaacaggcctccggctttgtgagggacctatccggccacgtttcttggaagggcgcaggggaggcaagactggtgtgtcaaaatgacctggaactggaaatcttcggacacatcaaccaccacctgtcaggattgaaagattctcactgcctggtgtttctgcaagcgccccctgtgccttggatcatcttagcatcctttctctggatcctcggaaacccatggacaagctccacggcgactgcgggattttcacagatctgggttctgttcccattctgtggaggaacattccatcataacgagaaagatgtgctcggactccaggacttcgagcgcgagtctgtttccactagtcagtcccgtaatatcagtctgctgacccttggacaactccagaattgcgtgattggtaagctaacaattatagacctgctgaccgagcacttactgggcgtgcgccacggtgttatctgcttcccgtggggactgcctagctcttcctag

SEQ ID NO: 141401 - DNA, 162 bp, Artificial Sequence
  Description of Artificial Sequence: Synthetic coding sequence
atgcagcagaaagcatttgaagaaagtcgatatccctggcaggaatcatttgaaaacgtcgccgtgtgtctaccattgagatgtcctagatgtggcgaccacacaagatttcgctccctgtcgagtctgcgtgcacacttggagttctcacacagctactag

SEQ ID NO: 141402 - DNA, 1893 bp, Artificial Sequence
  Description of Artificial Sequence: Synthetic coding sequence
atgagtgtctccagcggcgtgcaaatcttgactaagcccgaaactgtggataggcgacgaagcgccgagacaacaaaggaagccggccgccctctggagatggcggtgtcagagcccgaagcgagcgcagccgagtggaagcagcttgacccggcccagtcaaacctgtacaacgacgtaatgctagagaactactgtaatcaggcctctatggggtgtcaagctcccaagcccgatatgatcagcaaattggagaaaggcgaagcaccctggctgggaaaaggtaaaaggccatctcaggggtgcccttctaaaatcgctcgaccaaagcagaaagaaactgatggaaaggtgcagaaggatgacgaccaactcgagaacatacaaaaatcccagaacaagctgctgcgggaagtcgctgtaaaaaagaagacccaagctaagaaaaatggcagtgattgtggaagcctggggaagaagaataatctgcataaaaagcacgtccctagcaagaaaaggctgctaaaatttgaaagctgtggcaagattctgaagcagaacctggacttacctgatcacagcaggaactgcgtcaagcgcaagtctgatgcggctaaagagcacaagaagtcattcaatcattccctctcagatacaaggaaagggaagaagcaaaccggaaagaaacacgaaaagctgagttcacacagcagttccgacaaatgtaataagactgggaaaaagcacgataaactgtgttgccactcatcaagccatattaagcaggataagatccagactggcgaaaagcacgagaaaagcccaagtttgtctagttccactaaacacgagaaaccacaagcttgtgtgaaaccatatgaatgcaaccagtgtggcaaagtgttaagccataaacagggtctgatcgatcaccaaagagtccacaccggcgagaaaccgtatgagtgcaatgagtgcggaatcgcattctcacagaagtctcacctcgtggtacatcagcggacccataccggtgagaagccctacgagtgcatccagtgtggcaaagcacacggccataagcacgccctcacagaccatttgcggattcacactggtgaaaaaccttacgagtgcgctgaatgcggtaagacatttcggcatagttcaaacctgatacagcatgttagaagtcatactggcgaaaagccatacgagtgtaaggaatgcggaaaatcatttagatacaactcctcactgacggagcacgtccggacccatactggggagattccctatgagtgcaatgaatgtggaaaagccttcaaatattctagctccctgaccaaacatatgcgcatccatacaggcgagaagcctttcgagtgtaacgaatgtggtaaggccttcagtaagaagtcccacttgattatccatcagcggacacatacaaaggaaaagccctacaaatgcaatgaatgcggaaaggcctttgggcactccagctcactcacttatcacatgagaactcacacaggagagtcaccattcgagtgcaaccagtgcgggaaaggatttaagcagattgaaggtctaacgcaacatcaaagagtgcatacaggagagaaaccttatgagtgcaatgagtgcggaaaggcattttcccagaagagccatcttatcgtccaccaaaggacacacaccggtgaaaagccatacgagtgcaacgaatgtgaaaaggccttcaacgctaagtctcaattggtgattcaccagagatctcatactggcgaaaaaccgtacgagtgtaatgagtgcggcaaaaccttcaaacagaatgcttctctgactaagcacgtcaaaacccactctgaagataagtctcacgaatag

SEQ ID NO: 141403 - DNA, 1938 bp, Artificial Sequence
  Description of Artificial Sequence: Synthetic coding sequence
atgagcgtttcgtccggagtccagatactgactaagcctgaaactgtcgatcgcaggcgcagtgctgagactaccaaggaggcaggaaggccacttgagatggccgtcagtgaacccgaggcctctgccgccgtgtcggtgacttttaaacatgtgactatggccttcacccagaaagaatggaagcaactggatccagcgcaaagtaacctctataatgacgtgatgctcgagaactattgtaatcaggcaagtatgggctgtcaggcacctaaaccagacatgatctcaaagttggagaaaggagaagcaccttggcttgggaagggaaagcgacccagccagggttgcccctccaaaatcgcacggcctaaacaaaaagagaccgatggaaaagttcaaaaagatgatgaccagttggaaaacatccagaagagtcagaataagttactcagggaggtcgcagtgaaaaagaaaacacaagccaagaaaaatggtagtgattgtggttcactgggcaagaaaaataacctgcataaaaagcatgtacccagtaagaagagactgcttaaatttgagtcttgcggcaagattctcaaacaaaatctcgacctgcctgatcactcgaggaattgcgtgaagagaaagtccgatgctgccaaggaacataagaaatcatttaatcactccttgtcagacactaggaagggcaagaaacagacgggcaagaaacatgaaaagctttcttcccactctagttcggacaagtgcaacaagacggggaagaagcacgataagctgtgctgccactcaagcagccatattaagcaagataagatacaaaccggagaaaagcacgaaaagagcccttcactgtctagctcaacaaagcacgagaagccgcaggcgtgcgttaaaccctacgagtgcaaccaatgtggtaaggtcctgtcccataaacaggggctcattgatcatcagcgggttcacacaggagaaaaaccatatgaatgcaacgaatgcggtatcgcatttagtcaaaagtcacaccttgtggttcatcaacgaacccacacaggagagaaaccatacgagtgtatacagtgcggcaaggcacacgggcacaagcacgccctgactgatcacctgcggattcacaccggagaaaaaccatatgaatgtgcggaatgtggaaaaacgtttcgccacagcagcaatttgatccagcacgtgcgatcacacacaggcgaaaaaccctatgaatgtaaggagtgtgggaaatctttccgctataatagctccctcacagagcacgtgcgaactcacacaggagagataccatacgaatgcaatgaatgcggcaaggctttcaaatacagcagctctcttacaaaacacatgagaatacacactggcgagaaacccttcgagtgtaacgagtgtggaaaggccttctcaaaaaagtcccatttaatcattcaccagcgtactcacactaaggagaaaccatataagtgcaatgagtgcggaaaagctttcggacactcatcttctttgacataccacatgcggacgcatacaggcgaatccccctttgaatgtaaccagtgtggtaagggattcaagcagatcgagggcctgacccagcatcaacgtgtgcataccggcgaaaagccttatgaatgtaatgagtgtggcaaagccttttcccagaagtcgcacctgatcgttcaccagcggacccacaccggggagaagccgtacgagtgtaacgagtgtgagaaagctttcaatgccaaatctcagttggtgatccaccagaggtcacacaccggagaaaagccctatgaatgcaatgagtgcggcaaaaccttcaaacaaaacgcttccctgacaaagcatgtcaaaactcattctgaagacaagtcccacgagtag

SEQ ID NO: 141404 - DNA, 1896 bp, Artificial Sequence
  Description of Artificial Sequence: Synthetic coding sequence
atgtcagtgtcttccggggtgcagatcctcaccaaaccggagaccgtggatcgcagacgtagtgctgaaactaccaaggaggcgggtcgacctttggaaatggccgtgtccgaacctgaggcctccgccgctaaagaatggaaacagttagaccccgcacagagcaacctgtacaatgacgtgatgctcgaaaactactgcaatcaggcctctatgggatgccaggctcctaaacccgatatgatatcaaaattagagaagggagaagcgccgtggctgggcaaaggtaagcgcccctcccagggttgccctagtaaaattgccaggccaaagcagaaggagactgacggaaaggttcagaaagacgatgatcaactcgaaaatattcagaagagtcaaaacaaactgttgagggaggtcgccgttaagaagaaaacacaggctaagaagaacggatcagactgtggttccctgggaaaaaagaacaacctgcataagaagcacgtgccttctaaaaagaggttactcaagtttgaaagctgtggcaagattctgaagcagaatctggacctccctgaccattctagaaactgtgttaagaggaaatctgacgccgccaaggaacataagaaaagcttcaaccactccctttcagacacaagaaagggaaaaaaacagacaggaaaaaaacatgaaaaactgagctcccattcttcttccgacaagtgcaacaaaacagggaagaaacacgacaaactgtgttgccattcttcttcacacattaaacaagacaagatccagaccggggaaaaacacgagaagagccccagcctgtcgagctctacaaaacacgagaagcctcaagcctgtgtgaagccttacgaatgtaaccagtgcggcaaagtgctgagccataaacaaggcttaattgatcatcagcgcgtccacactggggaaaaaccatatgagtgcaatgaatgcgggatcgcattttcacagaaatcccacctggtagtgcatcagagaacacacaccggcgaaaagccctatgagtgtattcagtgcggcaaagcacacggccacaaacacgccctgacagaccatctccgtatccataccggagagaagccgtacgagtgcgctgaatgcggtaaaactttcagacactcatccaacttgatccaacacgtccggagtcacacaggcgaaaagccttacgaatgcaaggaatgcgggaaatccttcaggtataatagtagcctgacggaacacgtgcgaacccatacgggtgagatcccatatgaatgcaatgagtgtggtaaggccttcaagtactcttcatccctgaccaagcatatgaggatacataccggggagaagccttttgaatgcaacgagtgtggcaaggcgttctcaaagaagagccacctcatcatccaccagcggacccatactaaggagaaaccatataaatgtaatgaatgcgggaaagcattcggccacagctcttctcttacgtaccatatgcgtactcatacaggggagtccccctttgaatgcaaccagtgtggcaaaggattcaaacagatagaagggcttacccagcaccagagagtgcacactggtgaaaaaccttacgaatgcaacgagtgtggtaaggccttttcccagaagagccacctgatagtgcatcagaggacacataccggcgaaaaaccttatgagtgtaacgagtgtgaaaaggcgttcaatgcaaaatcacagctagttatacaccagaggagtcacactggagagaaaccttatgagtgtaacgagtgtggtaaaactttcaagcagaacgccagcctgaccaaacatgtgaaaactcatagtgaagataagtcacacgagtag

SEQ ID NO: 141405 - DNA, 1653 bp, Artificial Sequence
  Description of Artificial Sequence: Synthetic coding sequence
atgcctcttcaggggtccgtcagcttcaaggacgtgacagttgacttcacacaggaagaatggcagcagctggatcccgcgcagaaggcgctgtaccgcgatgtgatgctcgaaaactattgtcacttcgtgagcgtgggatttcatatggccaaacccgatatgataaggaagctcgagcaaggcgaggagctttggacccagcgcattttcccaagttacagttatctcgaggaagacgggaaaacagaagatgtgctggtgaaatttaaagagtatcaggaccgtcattcaagaccattaatcttcatcaatcacaagaagctgattaaggagcgcagtaatatctatgggaagacttttactttgggtaagaatcgtatttcgaagactatcctatgcgagtataagcccgacgggaaagtactcaaaaacatcagcgagttagtaattaggaacattagtccaataaaggaaaaatttggagattcgactggttgggagaagagcctcctgaacacaaagcacgaaaagatccacccggcagtgaacctgcacaaacaaaccgaaagggtcctcagcggaaaacaggagttgatacagcaccagaaggtgcaggctccggaacagccatttgaccataatgaatgcgagaaaagttttctgatgaaagggatgctgttcacacacacccgggcccataggggtgagaggactttcgagtacaacaaggacggaatcgcctttatagaaaaaagttctttatccgtgcacccatcaaatctcatggaaaagaaaccatcagcctacaataagtacggcaagtttctgtgcagaaagcccgttttcatcatgccccagagaccacagaccgaggaaaaacctttccattgtccctactgtggtaataatttcagacgcaagtcctacttaatagaacatcagagaatacacactggggaaaaaccttacgtatgcaatcagtgtggaaaagcatttcgtcagaagactgccctaaccctgcatgagaagacgcatatcgagggaaaacctttcatttgtatcgactgcggcaagtccttccgtcagaaagcaaccctgacacggcaccacaaaactcacacgggtgaaaaggcatacgagtgcccccagtgcgggtctgcattccggaaaaaaagctacctgattgatcatcagcgcacccacactggtgaaaaaccttatcagtgtaacgagtgtggcaaggcctttatccagaagactactttgaccgtccatcagcggacacacacaggggaaaagccttacatctgtaacgagtgtggcaaaagtttctgccaaaagacgacactgactttgcaccagcgaattcacactggtgagaagccatacatctgtaacgagtgtggaaaaagcttccggcagaaggccatccttacagtgcaccataggatccacaccggcgaaaagtcgaatggctgtccgcagtgtggaaaagctttcagtcgcaagtccaatttaatccggcatcaaaaaacccatacaggagagaagccctatgaatgtaaacagtgtggaaagttcttcagttgtaagagtaacttgatagtacatcagaagacccacaaagtggagaccactgggattcagtag

SEQ ID NO: 141406 - DNA, 1650 bp, Artificial Sequence
  Description of Artificial Sequence: Synthetic coding sequence
atgtctcagggctctgtgagctttaaagatgtaacagttgatttcacccaggaggagtggcagcagctggatcctgctcagaaagctctgtatagagacgttatgctggaaaactactgtcacttcgtatcagtgggttttcatatggcaaagccggatatgattaggaaacttgagcaaggcgaagagctgtggacacagcgaattttcccttcctattcctatttagaggaggacggaaagacagaggacgtcctagtgaaattcaaggaataccaggatcggcatagccgcccgctgatattcatcaatcacaaaaagctgatcaaagagcgcagcaatatttacggcaagactttcaccctgggcaagaatcgcattagtaagaccatcctgtgcgaatacaagccagacggcaaggtgctaaaaaacataagcgagcttgtcattcggaatatcagtcctatcaaggaaaagtttggggactccactggctgggagaaatcactgctcaatactaagcacgaaaaaattcatcctgccgtgaatctgcacaagcagaccgagagggtgttgagcggcaaacaagagctgattcagcaccagaaggtgcaggcccctgagcagccctttgaccacaacgaatgtgagaaatccttcctcatgaagggcatgctgttcacacataccagagctcataggggagaacgtacattcgagtacaacaaagacggaattgcttttatcgagaagtccagtttatcagtgcacccatccaacctgatggagaaaaaacccagcgcctacaacaaatatggaaagttcctgtgccgcaagcccgtgttcatcatgccacaacggccacagacagaagaaaagccatttcattgcccatattgcggaaataattttaggcgcaagagctaccttatagaacaccagcgtattcacaccggcgagaaaccgtacgtgtgcaatcagtgtgggaaagcctttcgccaaaaaacagcgttgacactgcatgaaaaaacacacatcgaaggaaaacccttcatatgcattgactgcggcaaaagtttcagacagaaggcgacgctaacccgccaccacaagacacatactggtgaaaaggcatatgaatgtccacagtgtggatccgccttcagaaaaaaatcctacttgatcgaccaccagaggacccacacaggagaaaagccttatcagtgcaatgagtgcggaaaggcattcattcagaagactacgttgacagtgcaccagaggactcacactggggagaaaccttatatctgcaatgaatgcggaaagagcttctgccaaaagacaacactgactctccaccagcgcattcatacaggtgaaaagccctacatctgtaacgaatgtggaaagtcttttagacaaaaggcgatcctaactgtgcaccatcgcattcatactggggagaaaagcaatgggtgtccacagtgcgggaaagccttttctaggaagtcaaaccttataagacatcagaaaacccacaccggggaaaagccatacgaatgcaaacagtgtggtaaattcttcagctgcaagagcaatctcattgtccaccagaagacccacaaagtagagactactgggatccaatag

SEQ ID NO: 141407 - DNA, 1503 bp, Artificial Sequence
  Description of Artificial Sequence: Synthetic coding sequence
atggaggaaagccattttaatagcaacccatatttttggccctcaatcccgactgtgagcggccagattgaaaacaccatgtttattaataagatgaaagaccagctgctgccagagaagggctgtggcctcgccccaccccattaccccaccctgttaacagtgcccgccagcgtgtcacttccaagcgggatttctatggacacagagtctaaaagcgaccagttaactccccactcccaggcctctgtaacccagaacatcaccgtggtccccgtccccagtaccgggttaatgaccgccggccccgggttagtgatcacaagtccctccggatccctggtgactactgctagctctgctcaaacttttcctatttcagcgcctatgatagtgagcgctctaccaccaggttcccaagccttacaggtcgtgcctgatcttagtaaaaaagtggcaagcactctcaccgaagaggggggcggaggtggaggcggaggaggaagcgttgctcccaaaccaccaaggggcagaaaaaaaaaaaggatgctggaaagcggtttgcccgaaatgaacgacccatacgtcctctcgcccgaagatgacgacgatcaccagaaagatggaaaaacatatagatgtcgcatgtgttctcttacgttttactccaaatcagagatgcaaatacacagcaagtctcatactgagactaagcctcacaagtgtccgcactgctcgaaaactttcgctaatagctcatacttggcacagcatattagaattcatagtggcgcaaaaccttattcttgcaatttctgtgagaaatcatttcggcagctgagccatctgcagcagcatactcgcatacacacaggcgatcgtccttacaagtgcgcccaccccgggtgcgagaaggccttcactcagcttagtaacctacaatcccatagaaggcagcacaataaagataagccgttcaaatgccataactgccaccgggcttataccgatgccgcatctctggaagtgcacttatctacccatactgttaagcacgcgaaagtttatacctgtacaatttgcagtcgagcctatacttccgaaacttatttaatgaagcatatgaggaagcacaaccctcccgacctgcaacagcaggtccaggcagccgccgccgccgccgccgtggcgcaggcccaggcccaagcccaggcacaggctcaggcgcaggcccaggcacaggcccaggctcaagccagccaagcctcacaacagcagcagcagcagcagcaacagcagcagcagcagcagcagcagcctccaccgcactttcagagtcctggagccgccccgcagggaggaggggggggcgacagcaaccctaaccccccaccccagtgcagtttcgatcttaccccttacaagacagcagagcaccacaaggatatctgtctgaccgtcaccacctctaccatacaggttgagcacttggcctcttcttag

SEQ ID NO: 141408 - DNA, 1734 bp, Artificial Sequence
  Description of Artificial Sequence: Synthetic coding sequence
atggaggagagccatttcaactccaacccttacttttggccttcgatccctaccgtttcgggtcaaattgagaatacaatgttcattaataagatgaaagaccagctcttgccagagaaggggtgcggtctggcaccgccccactatccaactctgttaacggtgccagcctccgtgtcacttccgtcaggaatttctatggacacagaatctaagtcggatcagcttaccccgcactcccaagccagtgtcacccagaatattacagtggtccctgtccctagcactggcctcatgacggccggggtgagctgctcgcagcgctggagaagggaggggtctcagagcagagggcccggcctggtcatcacctcaccctcgggctccctggtgacaaccgcatcgagtgctcagacctttcccattagcgcaccgatgatagtctctgccctgccccccggatcacaagccttacaagtggtccctgacctctcaaagaaagtggcctccacactaacggaggaaggtggaggcggtggtgggggcggaggttcagtcgctccaaagccaccaaggggcaggaaaaaaaagcggatgctcgaaagcggactccccgagatgaacgacccgtacgtgctgtcaccagaggatgatgatgatcaccagaaagatggcaaaacctaccgatgcaggatgtgtagcctgaccttttatagtaaaagtgaaatgcagatccacagtaagagccacactgagacgaagccgcacaagtgtccccattgttccaagacctttgcaaacagttcttacctggcccagcacatcaggatacactctggcgcgaagccatacagttgcaacttctgcgagaagtcgttccgacagctgagccacctgcaacaacacacaaggattcattccaaaatgcataccgagacaatcaaacctcacaagtgcccacattgcagcaagacctttgccaatacgtcatacctcgcacagcacttacggattcattccggggcaaaaccgtataattgttcttattgccagaaggccttccgccaattgagtcatctgcagcaacacacacgtatccacacaggggacagaccttacaagtgcgcgcaccccgggtgtgaaaaagctttcacacaactgtctaacctgcagagtcacagacggcagcacaataaggacaagccctttaagtgtcataactgccacagagcctacaccgacgctgccagtctcgaggtccatctcagcacccacaccgtcaaacatgccaaggtgtatacttgcactatctgttcacgggcatacaccagcgagacatatctcatgaaacacatgaggaagcacaacccgcccgaccttcaacaacaggtgcaggcagccgctgccgccgccgcagtcgcccaggcccaggcccaggcccaggcacaggcacaggctcaagcacaagcacaggcacaggcccaagcttcccaggcttcacagcagcagcaacagcagcagcaacagcagcagcagcaacagcagcaaccccccccgcacttccagtcgccaggtgctgccccccagggcggcgggggaggagattcgaatcctaaccccccaccacagtgttcctttgatctcaccccgtataagactgctgaacaccataaggacatctgccttaccgtgacgacctctacaattcaggtggaacatctcgcctcctcttag

SEQ ID NO: 141409 - DNA, 1551 bp, Artificial Sequence
  Description of Artificial Sequence: Synthetic coding sequence
atggaggaatctcacttcaatagcaatccatacttctggccctccatccctacagtgtcaggacagattgagaacaccatgtttataaacaagatgaaggaccagctgctgcctgaaaaagggtgcggcctggctcctccccattatcccacactgttgaccgttccggcctcagtttccctgccctcaggcatttcgatggacaccgaaagtaagtccgatcagctgacaccacattctcaggcatctgttacacaaaatattaccgtagtcccggtgccaagtacagggttgatgaccgcaggagtgtcatgttcgcaacggtggcgccgtgaaggttcccagagcagggggcccggcctggtgattacgtccccttctggctcgttagttacaactgcgtccagcgctcagacgttcccaatctctgccccaatgatagtgagtgcccttccaccagggagtcaggccttacaggtggttccagacctttccaaaaaggtagccagcaccttgaccgaagagggaggtgggggcggcggtggcggaggatcagtcgctcccaaaccgcccagaggcaggaagaagaaaaggatgctggaatccggactcccagagatgaatgacccatacgtgttgtcacccgaggacgatgacgaccaccagaaggacggcaagacttataggtgtcgtatgtgctcactaaccttctactccaaaagtgaaatgcagattcattctaaaagtcatactgagaccaaaccccacaaatgtccccattgctccaagactttcgcgaattcctcatacctggcccaacatatacggattcattctggtgccaaaccgtattcctgtaacttttgtgagaagagctttcgtcaactcagccacttgcagcagcacactaggatacacacaggagacaggccttacaaatgcgctcaccccggttgtgagaaggccttcacgcagctgtctaatctccaatctcacagacggcaacacaacaaagacaagccttttaaatgccacaactgtcaccgcgcttatacagacgctgcaagcttagaagtgcatctgtcaactcacaccgttaaacatgccaaagtgtacacctgcacgatctgcagccgcgcctacacaagtgagacatatttgatgaaacacatgcgtaaacacaaccccccggatcttcaacaacaggttcaggcagccgcggctgccgctgccgtggcacaggcccaagcccaggcccaggcccaggcccaggcccaggctcaggcccaagctcaggcccaggcctcccaggccagccaacagcagcagcaacagcagcagcagcaacaacagcaacagcagcagccacctccgcacttccaatcccccggcgcagcaccccagggcggcggggggggtgatagcaaccccaatccccccccacagtgctcatttgacctgacaccctataaaaccgccgaacatcacaaagatatctgcctgacggtgaccacgagtaccatccaagtcgagcatcttgccagttcctag

SEQ ID NO: 141410 - DNA, 1551 bp, Artificial Sequence
  Description of Artificial Sequence: Synthetic coding sequence
atggaagagtcgcactttaactcaaacccctatttctggcccagcatcccgaccgtgtcagggcaaatcgagaacacgatgtttataaataagatgaaggaccagttgcttccagagaagggatgtggtcttgccccaccacattaccctaccctcttgacagtgccggcaagtgtatctctcccatccggcatctcaatggatacggagagcaaatctgaccaactaacaccacatagccaggcctctgtcacccagaatattaccgtcgtgccagtcccatctactgggctaatgaccgctggcgtgagctgcagccagagatggagacgtgaaggctcccagagcaggggccctggcctagtgatcacgtctccatcaggatcgctggtgactacagcctcaagcgctcagacctttcctattagtgcccccatgatagtctctgccttgccgccaggatcacaggcgctacaggtagtgccggacttgagcaaaaaggttgctagtactctaaccgaagagggaggcggaggtggaggcgggggagggtctgtggcccctaagccccctaggggaaggaagaagaaaaggatgctggaatccggccttcctgaaatgaatgatccgtacgtgctgtcaccggaagatgacgatgaccatcagaaggacgggaagacgtatcgttgtcgaatgtgtagcctcacattctactctaagagcgaaatgcagatacactcaaagagccacactgaaactaaaccccacaagtgtcctcactgcagtaaaacgttcgctaattcttcctacctggcccagcatattaggatccatagcggcgcgaagccctattcttgcaatttttgcgagaagagctttcggcaactctcccatcttcagcagcataccaggatccacacgggggatagaccatacaagtgcgcacatcccggttgtgagaaggcctttacacagttaagtaacctgcagtctcatcgccgtcagcataataaggacaagccctttaagtgtcataattgtcaccgggcttacacagacgccgccagccttgaggtccacctgagtactcacacagtgaaacatgctaaggtctatacttgcactatctgttcgagagcatatacgagcgaaacttacctgatgaaacatatgagaaaacacaatccccccgatctgcagcaacaggtgcaggctgccgctgctgctgcagccgtggcgcaggcccaggcccaggcccaggctcaagcacaagcgcaggctcaggcacaggcacaagcccaagcttcgcaggccagccagcagcagcagcagcagcagcaacaacaacagcagcagcaacagcaaccgcctccccattttcagtcccctggcgcggctcctcagggtggaggcgggggcgacagtaatcctaaccctcctccccagtgcagcttcgacttgacaccctacaagaccgccgagcaccacaaggacatttgcctgaccgttaccacctctacaatccaggtagaacatttggcatctagctag

SEQ ID NO: 141411 - DNA, 1734 bp, Artificial Sequence
  Description of Artificial Sequence: Synthetic coding sequence
atggaagagtcccacttcaactccaatccctacttctggccgtccatccctaccgtatccgggcagatcgagaacacgatgtttattaacaagatgaaggaccagctcctccccgagaagggttgtggattagctcctcctcactatccgaccctactgacagtgccagccagtgtgagcctgccgagcggtatctccatggatacagaatccaagagtgaccagctgactccccatagccaggcatcagtgactcaaaatattactgtcgtccctgtgccttctacaggcttgatgactgcaggagtaagctgctctcagcgatggagacgggagggctcccagtctcgcggcccaggcctggtaattacctctcctagtggaagcttagtaacaaccgcaagcagtgcacagacctttccaattagtgctcctatgatcgtctccgccctgcctcccgggagccaggcactgcaagttgtgccagacctttctaaaaaggtggcttccaccctcaccgaggagggcggtggaggtggcggggggggtgggtccgtggccccaaagcccccaaggggacgtaaaaagaaaaggatgttggaatccggccttccggagatgaacgacccttacgtgctttcccctgaggatgacgacgaccatcagaaggatggaaaaacctatcggtgtcgcatgtgttctctaaccttctacagcaagtccgagatgcagatccacagcaagtcacataccgaaacgaaaccccataaatgcccacattgcagtaagactttcgccaactcctcctatcttgcacaacatattcgaatccactctggcgcaaagccatactcttgcaatttttgcgaaaagagcttcagacagctgtcccatctccagcagcacactcgtattcactctaagatgcacaccgaaacaatcaaacctcataaatgtccccactgctctaaaacatttgcaaatactagctacctcgctcagcatctccgaatccactctggagccaagccgtataactgcagttattgtcagaaagcatttcgccaactgtcgcacctgcaacagcatacacggatccacacaggcgaccggccttacaaatgtgcccatcctggctgtgaaaaggcctttacccagctctcaaatctacagtctcataggagacagcataacaaagacaaaccctttaagtgccacaattgccaccgcgcttacactgacgcagcctcgctggaagtgcatctgagcactcacaccgttaaacacgcgaaggtgtacacttgtaccatctgctcacgcgcctacactagcgaaacctacctgatgaagcatatgagaaaacataaccctcccgatctgcagcagcaagtacaggccgctgccgcagccgccgccgtggcccaggcacaggcccaggcccaggcacaggcacaggcccaggcgcaagcccaggcccaagcacaggcgagtcaggcatcccagcagcaacagcagcagcagcagcaacagcagcagcagcagcagcaacctccacctcacttccagtccccaggtgctgcgcctcagggcggggggggcggggactccaatcctaacccccccccccaatgtagcttcgatctgaccccctacaaaaccgcggaacatcacaaagatatttgcctcaccgtgaccacctcaactattcaagtggaacacctagcatcatcatag

SEQ ID NO: 141412 - DNA, 1008 bp, Artificial Sequence
  Description of Artificial Sequence: Synthetic coding sequence
atggaagaatctcatttcaactccaacccctatttctggccatccatccctacagtgagtggccaaatagaaaacaccatgttcattaataagatgaaggaccagttgttgcccgagaaggggtgtggattggccccaccccactacccaactctcctgacagttcccgccagcgtgtcactccccagtggaatatcaatggacacagagtctaagagtgatcagctaaccccacactcacaagcttcggtgactcagaacatcacggtggtgccagtgccatccactggcctgatgacagcaggtgtgtcttgctcacagcgatggcggcgggaaggcagccagtcccgggggcccggcttggttatcacctctccgagcgggagtctcgtcacaaccgcgagctcagcacagacatttcccataagcgcgcccatgatcgtttcggccctgcccccagggtcccaagctctgcaagtcgtacccgatctgtcaaagaaagtcgcatctactctcaccgaggaagggggaggcggcgggggaggtggcggttcagtagctcccaaacctccccggggcagaaaaaagaagagaatgttagagtctggtctgcctgaaatgaacgatccatatgttttgtctccagaagatgatgacgaccaccagaaagacggaaagacctacaggagtgaaggaaactgcggaacaggtaacgggcaatctctcggcctgatggattccgtgcctggctccactacaaacctcctgtgcgatcccgggtgtaggatgtgttctctcaccttctacagcaagagcgagatgcagattcattcaaagagccacacagaaactaaaccccataaatgtccacattgctcgaagacctttgccaatagtagctaccttgctcaacacattcgcattcatagcggggctaaaccatactcctgtaacttctgtgaaaagtcattccgacaactgtcacacctccaacagcacaccagatag

SEQ ID NO: 141413 - DNA, 834 bp, Artificial Sequence
  Description of Artificial Sequence: Synthetic coding sequence
atggaggaatcccacttcaattccaacccttacttttggccctcgatccctaccgtgtcgggccagatagagaatacaatgttcatcaataaaatgaaagaccagctgttacccgagaaaggctgcggattagcaccgccacactaccccacattgcttaccgttcctgcgtctgtgtcgctgcctagcggcatcagtatggacacggagagtaagtctgatcagcttaccccacactcacaggcttcagtaactcagaatataaccgtagtccctgtgccgagtacgggtctcatgactgccgggcccgggttggtcataacctccccctctgggtcactggtaaccaccgcctcttccgcccaaacatttccaattagtgccccaatgatcgtttctgccctgcccccagggtcgcaggcccttcaggtggttcccgacctctcaaagaaggtagcgtcgaccctgacagaagaaggagggggcggcggaggtgggggtggctcagtggctccaaaacccccacggggccggaaaaagaaacgtatgttggagtcggggctccccgaaatgaatgacccctatgtgttgtccccagaagacgacgacgaccatcagaaggacggcaagacataccgatgtaggatgtgtagcctgaccttctactcaaagtcagaaatgcaaatccacagtaagtctcacacagagacaaaaccgcataagtgtccacattgcagcaagactttcgctaactcatcttatctcgctcagcacattcgaatccattccggcgcaaagccttacagttgtaatttttgtgaaaaaagcttctag

SEQ ID NO: 141414 - DNA, 1386 bp, Artificial Sequence
  Description of Artificial Sequence: Synthetic coding sequence
atggaggagtcacacttcaactcaaacccttatttttggcccagcatccccacggtttccggtcagattgagaataccatgttcattaacaagatgaaggaccagctgctacctgaaaaaggctgtggactggccccaccccactaccctactctcctgactgtgcctgcctctgtcagcctgccatcagggatctccatggataccgagtccaaatcggatcagttaactccacatagccaagcatcagtgacacagaacattactgtggtaccagtgccatctacaggactgatgactgccgctctccaagtggttcccgacctatctaaaaaagtggcttcaaccctgaccgaggaaggtggcggaggcggcggaggtggcggctccgtggcgcctaaaccaccacgcggaagaaagaaaaagcgaatgctggagtctgggctccctgaaatgaacgatccctacgtgctgtcccctgaagacgacgacgaccaccaaaaggacgggaagacctacagatgtaggatgtgttccctgactttttacagcaaatcagagatgcaaatccattcaaagagtcacacggagactaagcctcataaatgcccccactgctcaaaaactttcgccaatagcagctatctggctcaacatatccggatacactctggagcaaaaccgtattcttgcaacttttgtgaaaaaagttttcgccagttgtcgcatctgcagcagcacaccaggatccacaccggggaccgaccttataagtgcgcccatcctggctgtgagaaggcattcacgcagctttccaacctacaatcccacagaagacagcacaacaaagacaaacctttcaagtgccacaactgccatcgcgcttacaccgacgccgcctctcttgaggtgcacttgtctacacacacagtgaagcacgccaaagtctacacctgcacaatttgctcacgggcctacacatcagaaacgtaccttatgaaacatatgcgtaagcataacccacccgacctccaacagcaggtgcaggccgccgctgcagctgccgcagttgctcaggcacaagcccaggcacaggcccaggcccaggcccaggcacaggctcaagcacaggcccaggcatctcaggcctcccagcagcaacagcagcaacaacagcagcagcagcagcagcagcagcagcccccacctcatttccagtcaccaggtgctgccccgcagggaggtggtggtggcgattcaaatccgaatcccccgccacagtgcagctttgacctgactccttacaaaacagctgaacatcacaaggacatctgcttaaccgtgaccacctccactattcaggtcgaacatctcgccagcagttag

SEQ ID NO: 141415 - DNA, 1161 bp, Artificial Sequence
  Description of Artificial Sequence: Synthetic coding sequence
atgatcctcgggtctctaagcagagccggaccacttccgcttctgcgccagcccccgattatgcagccacccctcgaccttaaacagattctaccatttccactcgaacctgcccctacgctgggcctgttcagcaactactccactatggatcccgttcagaaagccgtcctgtcccacaccttcggcggcccgctcctgaagacaaagcgtcccgttatctcatgcaatatctgccagatccgcttcaactcccaatcgcaagctgaagcgcactataagggtaaccgtcatgcacggcgcgtaaagggtatagaggctgctaagactcggggccgtgagcccggtgttagggaacccggcgaccccgcccctcctgggtccactcccacgaacggcgatggagtagccccccgtcccgtttcgatggaaaatgggttaggaccagcacccggatccccagaaaaacaacctggttccccttctcccccttctatccccgagaccggccaaggagttacaaagggagaaggtgggactcctgcgcccgcctcactgccgggcgggtccaaagaagaagaagagaaggctaaaagactgctgtactgcgccttgtgcaaagtagcagtgaacagcctgagccagctggaagcccataataagggtaccaagcacaaaaccatcctggaggctaggagcgggctcggcccaatcaaggcctatccgagacttggtcctccaactcctggtgagcccgaggccccagctcaagatcgcacatttcactgtgaaatatgcaacgtcaaggtcaacagtgaggtgcaattaaaacagcacataagtagccgacgacacagagacggagtagcgggaaagcccaaccccctgcttagtaggcataagaagagccgaggggcaggggagttagctggcaccctgactttctccaaggagttgccgaaatcattggcaggcggtttgctgccctctcctcttgccgtagccgctgtgatggcggctgccgctggcagcccgctttccttgaggcctgcaccagccgctccccttctgcagggtcccccaattactcacccccttctgcaccccgctcctgggccgatccggacagcccacggacctattctctttagcccgtactag

SEQ ID NO: 141416 - DNA, 918 bp, Artificial Sequence
  Description of Artificial Sequence: Synthetic coding sequence
atgatccttgggagtctgagcagagcaggtccactccctctcctccggcaaccaccgatcatgcaacccccccttgacttgaagcagatcctgccatttcccctcgagcccgccccgacactgggactgtttagcaactatagcaccatggatcccgtccagaaagccgttctgagccacactttcggaggaccccttctcaaaacaaagcggcccgtaatcagctgcaacatttgccagattaggtttaatagtcagtcacaagccgaagcccactacaagggcaatcggcatgcccggcgcgttaaggggatagaagccgcgaaaacccgtgggagggagcccggtgtgagggagcccggcgatcccgcccccccagggagtaccccaaccaatggtgacggcgtcgcacctcgaccaggcacaaaacataagacaatattggaagccagatccggcttaggcccaataaaggcctatccgcgcctgggacctcctaccccaggggagcctgaggctcccgcacaggatcgcacctttcattgcgaaatttgtaatgttaaagttaatagtgaagtgcagttgaaacaacatatctccagtcgccgacatcgtgacggcgtggcgggaaaacctaacccgctgttgtcaaggcacaagaaatcacgcggtgctggcgaattagccggcaccctgacattctccaaggagctgccgaagtccctagcaggcggacttttgccctcacccctggccgtcgccgccgtaatggccgccgccgccggaagcccactgagcctgaggccagcaccagctgcccccctcttgcaaggccctcctattacacatccgttgctccacccagcacctggcccaatccgcactgctcacggcccaatattgtttagtccatattag

SEQ ID NO: 141417 - DNA, 1101 bp, Artificial Sequence
  Description of Artificial Sequence: Synthetic coding sequence
atgcagccaccgttggacctaaagcagatcctgccattccctctcgaacctgcacctacgttaggcctgtttagtaattactctacgatggacccggtccagaaggccgtcttatcgcacaccttcggcgggcccctgctcaagaccaaaagaccagttatctcttgtaatatatgtcagattagattcaacagccagtctcaggccgaggcccattataagggtaaccggcacgctagacgggtaaaaggtatcgaggcagctaagacccgaggacgtgaacctggggttcgcgaaccaggcgaccccgccccacctggttccacccctaccaatggtgacggcgtggccccgcgcccagtatcgatggagaatggtttgggccctgcccctggctctcctgaaaagcagcccgggtctccatcccccccaagcataccagaaaccggccaaggagtaaccaaaggggagggaggcaccccagctcctgccagtctgcctggcggaagtaaagaagaagaagaaaaagcaaagagactgttgtattgtgccctctgcaaggtcgccgtgaattcactgtctcaattggaagcccacaacaaaggaaccaaacataaaaccatccttgaagctaggagcggcctagggccaatcaaggcctacccaaggcttggcccacccacacctggagagccagaggcccccgcccaggaccgcacatttcattgtgaaatctgcaatgtgaaagtcaattctgaagtgcaactgaaacaacacataagtagccggagacatcgggacggagtcgccgggaaacccaaccctttgctgtctcgccacaaaaaaagcagaggagctggtgagcttgctggtactctaacattctctaaggaactgccgaagagcctcgcaggtggtttgctgcccagtccactggcagtggctgcagttatggcggctgccgccggttcccccctgtcactgagaccagcccctgctgctccactcctgcaggggccccctattacgcaccccctgctgcacccagctcctgggccaattaggaccgctcatggtcccatcctgttctctccctattag

SEQ ID NO: 141418 - DNA, 699 bp, Artificial Sequence
  Description of Artificial Sequence: Synthetic coding sequence
atgcagccgcccctggatctaaaacagatattgcccttcccactcgaaccagcccccactctcggcttgttttcaaactatagcactatggaccctgttcagaaggccgtgttgtctcataccttcggaggcccgctgcttaagaccaaacggccggtgattagttgtaatatctgccagatacggttcaacagccagtctcaagctgaggctcattacaagggcaataggcacgcccgcagggtgaaaggaatcgaagcagctaagaccagggggagggaacctggcgtgcgcgagccgggggacccggcaccaccgggatctacgcctaccaatggggatggtgttgctcccaggcctgtttctatggagaatggcctcgggcccgccccaggatccccagaaaaacagcccggaagtccgagcccgccaagtattcccgagactggccagggtgtaacaaagggggaaggaggaacccccgccccagccagtctgcccggcgggtccaaggaggaggaggagaaagcaaagaggctgctgtattgcgccctgtgcaaggtggccgttaactcgctgtcacagctggaggcacataacaaaggcacaaaacataagaccattctggaggcccgaagcggcctgggcccaattaaggcttatcctaggcttggcccgcccacgcctggtgaaccctag

SEQ ID NO: 141419 - DNA, 1101 bp, Artificial Sequence
  Description of Artificial Sequence: Synthetic coding sequence
atgcagccaccactcgacctaaagcagattttgcccttcccgctggaacccgcaccaactctcgggttgttctctaactacagtaccatggaccccgtgcagaaggccgtattgagccacacatttggggggccattgcttaagaccaagaggccggtgatttcatgcaacatctgccaaatccgcttcaatagccagtcccaggccgaggcccactataaaggaaaccgccacgcccgaagggtgaaagggatcgaggctgccaaaaccagaggcagggaaccaggtgtgcgcgagcctggggaccctgcccctcccgggtcaacccctactaatggagatggcgtggcgcctagacccgtcagcatggaaaatggcctcgggcctgcaccgggaagccccgaaaagcagcccggttccccaagcccaccctctattcctgagacagggcaaggcgttaccaaaggggagggcggtacacccgcaccagcctcattacccggaggttccaaagaggaggaagaaaaggcaaagcggcttctttactgtgccttatgcaaggtggccgtcaacagtctatcccagctggaggcacacaacaaaggaaccaaacacaaaaccatcctggaggctaggtccgggctgggtccgattaaggcttaccctagacttggccccccgacccccggtgagcccgaagccccagcccaagatcgaacttttcactgcgaaatctgtaacgtgaaagtgaactctgaggtgcagcttaagcagcatatctcctctaggcggcatcgtgacggagttgccgggaagcccaatccattattgtctcggcataagaagtcccggggagccggcgagttggcaggtaccctcacattcagcaaagagctgccaaaatctttagctggtggactgttaccctcgcctcttgccgtcgccgcagtgatggctgctgccgctggtagccccctttccttgaggcccgcaccagccgcacctttactgcagggccctccaataacacatccactgctgcatcctgcccctgggccgataaggactgctcatggaccaatcctcttcagcccatactag

SEQ ID NO: 141420 - DNA, 498 bp, Artificial Sequence
  Description of Artificial Sequence: Synthetic coding sequence
atgcagccccccttggatcttaagcagatcttgccctttccattggagcccgcccccaccttggggctattctccaactactccaccatggacccagttcagaaggccgtgctctcacatactttcggcggccctctactaaaaaccaaacgcccagtcatcagctgcaacatctgtcagataagattcaattctcaaagccaagccgaggcacattacaaagggaacaggcatgcgagaagggtaaaagggatcgaggctgcgaagacaagaggccgcgagcctggtgtgagagaaccaggcgatccagcccctcccggatctactccaacgaatggagacggcgtggcaccccggccagtgtctatggagaatggactggggcccgcccctggttctcccgagaaacaaccaggttcgcccagccctccgagcatacctgagacaggccagggcgtcactaagggagaaggagggaccccggcacctgcaagctag

SEQ ID NO: 141421 - DNA, 438 bp, Artificial Sequence
  Description of Artificial Sequence: Synthetic coding sequence
atgcagcctcctctggatctgaagcagattctccccttccctcttgaaccagcccccaccctgggtcttttttcaaactacagtactatggacccagtgcagaaagcagtgttgtcccatacatttggcggacccctgctcaaaactaagagacctgtgattagctgcaacatttgtcagattcgatttaactctcagagccaggctgaggcccactacaaagggaatagacacgcccgccgggtcaaaggcattgaggccgcaaagactagaggacgcgagcccggagtcagggagcccggcgaccccgccccacccggctctacccctaccaatggggacggcgtggcacctagaccagttagcatggagaacggtcttggtccagctccggggtcgcccgagaagcaacccggcagcccgagccccccaagctag

SEQ ID NO: 141422 - DNA, 1101 bp, Artificial Sequence
  Description of Artificial Sequence: Synthetic coding sequence
atgcagcccccactcgatcttaaacagatcctacccttcccgctggagccagcaccaaccctcggcttgtttagcaattactctaccatggatcctgtccagaaagctgtgctcagccataccttcgggggcccattgttaaaaaccaagaggccagtgatctcttgtaacatctgccaaatacgtttcaattctcagagccaggccgaggctcactataaggggaaccgtcacgccagacgcgtgaagggaatcgaggccgccaaaactagaggcagagagcctggagtcagagaaccgggagacccagccccccctggttccacccccactaacggagatggcgttgccccccgccctgttagtatggagaatgggctcggacccgcccctggaagccccgagaaacagcccgggtccccttcaccaccctcaatcccagaaactggtcagggggtaaccaaaggtgaaggtggcacccccgccccagcctcactgcctggagggagcaaggaagaagaagagaaagcaaagcggctgttgtactgtgccctctgcaaggtagctgttaattcactgtcacagttagaggctcacaacaaagggacaaagcataagacaattctggaggctcggagcgggctgggcccgatcaaggcataccccagacttgggcctccaacaccgggcgagcccgaggccccagcccaagacaggacttttcattgtgagatctgcaacgtgaaagtgaactcggaggtccagctcaagcaacatatcagcagcagacgccatcgcgacggcgttgccggtaagcctaaccccctgttgagtagacacaaaaaaagcaggggagccggcgaacttgccggcacattgacctttagcaaagagctgcctaaatcactggccggaggcctgctgcctagccccctggctgtcgcagccgtcatggccgccgctgcgggctctccactgtcgcttcgcccagcaccagccgctccccttctgcaggggcctcccattacacatccgttgctgcacccagccccaggcccaatccggacagcgcatggacctattttgttctcaccgtactag

SEQ ID NO: 141423 - DNA, 858 bp, Artificial Sequence
  Description of Artificial Sequence: Synthetic coding sequence
atgcagccccccttggacctgaagcaaattctgccatttcctctggaaccagctccgacattgggccttttctcgaactacagtaccatggatcccgtgcagaaagccgttctctcacacactttcggcggaccactgctgaagaccaagagacccgtgatctcttgtaatatctgtcaaattcgattcaattctcagtcccaagcggaagctcattataaaggtaatcgtcacgccagacgtgtcaagggaattgaagccgcgaaaactcgaggccgggaacccggggtccgagagcctggggacccagccccccctggcagtactcccaccaacggcgatggagtcgccccgcggcccggaaccaagcacaagacgattttagaagcccgctctgggctggggccaattaaagcttatcctagactcggtccacctacccctggggagccagaagcaccagcccaggacagaacatttcattgcgagatttgcaatgttaaggtcaactccgaggttcagctgaagcagcatatctcatccaggcggcacagagatggggtcgctggtaagccaaatccgctacttagtcgtcacaagaagtcacggggtgctggagaattggctgggacgctcacgttcagcaaagaattaccaaagagcctcgccggcggcctacttccctctcccctcgcagtcgccgcagttatggccgccgccgcaggctcacctctctccctgcggcccgcccccgccgccccactccttcaggggccacctattactcatccactacttcatccagcccctgggcccatccgcactgcccacgggccaatactgttcagcccatattag

SEQ ID NO: 141424 - DNA, 1110 bp, Artificial Sequence
  Description of Artificial Sequence: Synthetic coding sequence
atgatgcaaccatctttggacattaaacccttcatgtcattccctgtcgattcatccagcgcagtgggactcttcccaaacttcaacacaatggacccggtacagaaagctgtcataaaccatacgttcggagtcagtatccctcctaaaaaaaagcaggtgatctcctgcaacgtgtgccagctgcggttcaactctgacagccaggcagaggcccattataaagggtccaaacatgccaaaaaggtgaaggcattagacgcgaccaaaaacaagcctaaaatggtgcctagcaaggattcggctaaagcaaatccttcttgcagcataactccaatcacaggaaacaacagtgataaaagtgaagataagggaaagctcaaagccagctccagctctcagccttctagttctgaatcagggtcctttctgttaaagagcgggactacacctctgccacctggagccgccaccagccctagcaagtccaccaatggagcgccaggcaccgttgttgaatccgaagaggaaaaagcaaagaagctgctgtattgtagcctctgcaaggtcgcggtgaacagtttatcccagctggaggcccacaacacagggtccaagcacaaaactatggtggaggccaggaatggggcgggacccattaagagctaccctcgcccggggtcgcgccttaagatgcagaacggaagcaagggctctgggctgcagaacaagacctttcactgcgaaatatgcgacgttcatgtgaattcagagattcagctcaaacagcacatcagcagcaggcggcataaggacagagttgcaggcaagcctctgaaacctaaatactcaccatacaacaaattacaacgctcacctagtatcctagctgccaagctagcctttcaaaaagacatgatgaaaccactggctccagccttcctctcttcgcctttggccgccgctgcggccgtttcatctgcactgagtctgccaccccgacctagtgcttcccttttccaagcgcccgccatcccccctgccctgctccggcccggacacggccccatccgggctactccagcttctatcctgttcgctccgtattag

SEQ ID NO: 141425 - DNA, 1188 bp, Artificial Sequence
  Description of Artificial Sequence: Synthetic coding sequence
atgtggtcaggcctcccttccagaggcagtacgtgccacacaacaacccttccggctctggtcagaacacccacactgatgatgcagcccagccttgatattaagcctttcatgtcgttccccgtcgactcctccagcgcagtgggactgtttcccaacttcaacaccatggatcctgtgcaaaaggccgtaattaaccacacattcggcgtgagcatacctcccaagaagaaacaagtaatctcctgtaacgtatgccagctgcgattcaactcagacagccaggctgaggcccattacaaaggtagcaaacatgccaagaaggtgaaagcactggacgccacgaaaaataaacctaagatggtcccaagtaaagactccgcaaaggctaatccatcttgctccattactcccatcactgggaacaattccgacaagtcagaggacaagggaaagttgaaagcctctagttcctcccaaccttcgagtagtgagtccggatcatttcttctgaagtccggaacaactcctttgcccccaggagccgctacgagcccatccaaatcaaccaacggcgcaccaggcaccgtagtcgagtctgaggaagaaaaggcgaagaagctgttatactgcagcctgtgcaaggtagcagtgaactcactgagccagctggaggctcacaatacagggagcaaacacaagacaatggtcgaagcacggaatggagcagggcctataaaatcgtatccacgaccaggctctagactcaagatgcaaaacggttctaaaggatccggcctgcaaaataagaccttccactgcgagatatgcgacgtgcacgttaactctgaaattcagctcaaacagcacatctctagccggcgtcataaggatagagtggcaggcaaacccttgaaacccaagtatagcccttataacaaactccagcgcagcccgtctattttggcagccaagctggccttccagaaggacatgatgaagcccttggcacccgcctttctgagtagccccctcgcggcggctgccgccgtgagttctgcacttagcctgccgcctagaccctctgcttccctttttcaagccccggctattccccctgccctcctgagaccaggtcacggccctattcgtgccacccccgcatctatcctgttcgcgccatattag

SEQ ID NO: 141426 - DNA, 1110 bp, Artificial Sequence
  Description of Artificial Sequence: Synthetic coding sequence
atgatgcagccgagtttggatataaagcctttcatgtcctttcctgttgacagctcaagtgcagtcggcctcttccctaattttaacaccatggaccccgtgcaaaaggccgttattaaccacacgtttggggtttccattccaccgaagaaaaaacaggtgatcagttgtaatgtgtgtcaacttcggttcaatagcgattcccaggcggaggcgcattacaagggatccaagcatgccaagaaggtcaaggccctggacgcaactaaaaacaaaccaaaaatggtgccgtcgaaagactcggccaaggctaatccctcctgcagtatcacccccatcacaggaaataatagtgataagtcagaggacaagggaaagctgaaggcctctagctctagccagcctagtagctctgagtcaggctccttccttctgaagtccggcacaaccccgttgccacctggcgccgccacctctccttctaagtccacaaatggcgcaccaggcactgtcgtagagagtgaagaggaaaaagcgaagaagcttttatactgttctctttgcaaggtggctgtcaactctctttcccagctcgaggctcataataccggcagcaaacacaaaacaatggtcgaggccagaaatggggcaggacccatcaagtcttaccccagaccaggctcgagactgaagatgcagaacggatccaagggctctggcctgcagaataaaactttccactgtgaaatttgcgacgtccatgttaactcggaaattcaactcaagcagcacatatcaagcaggcggcacaaagatagggtggctggcaagccacttaaaccgaaatatagtccttacaacaaactccagcgctcacccagcattctggccgccaagctggctttccagaaggacatgatgaaacccctggccccggcattcttatcaagtccgcttgcagccgcagctgctgtctcttcagcactgtcacttcctcccaggccttccgcctctctgtttcaagcccccgccatccccccagccctcctgcgaccgggacacgggcctattagagctacacccgcctcgattctcttcgcgccctattag

SEQ ID NO: 141427 - DNA, 1416 bp, Artificial Sequence
  Description of Artificial Sequence: Synthetic coding sequence
atgaacatggctaacttccttcgaggttttgaagaaaagggcattaaaaatgatcggcctgaggatcaactcagcaaagagaaaaaaaaaatccttttttcattttgcgaggtatgcaatattcaactgaactccgccgcccaggctcaggtccacagcaatggcaagtcccatagaaagcgcgtcaagcaattgagtgacggccagcctccccctcccgcacaagcatcaccttcttctaacagcagcactggatccacctgtcacaccaccacactgcctgcgttagtgcgcactcctaccctaatgatgcagccaagcctggatatcaaaccgtttatgagcttcccagtggactcctcgtccgccgtggggctcttcccaaacttcaacactatggacccagtgcagaaagccgttatcaatcacacctttggcgtgagcatcccacctaagaagaaacaggtcatcagctgcaacgtgtgtcaacttagattcaattctgacagtcaggccgaagctcattacaaggggtctaaacacgcaaagaaggtgaaggccttggacgctaccaagaataagcccaaaatggtcccaagcaaggattccgccaaagcaaatccctcgtgctcaattaccccaattactgggaacaacagcgacaaatcagaagacaaaggcaagctgaaggcctcctcctccagtcagcccagctcatccgagtccggatccttcctcctcaaaagcggtacaacccccctgccaccaggggccgcgacatccccctccaaatctaccaatggtgcaccgggaactgtcgtagaatctgaggaggagaaagccaaaaagctgctctactgctccttatgcaaagtggcagtgaatagtctttctcaactggaggcccataacaccgggagcaaacacaagaccatggtcgaggctcgcaatggggccggccccattaagtcctacccgcgtcccggctctcgactgaaaatgcagaatggatctaaaggttctggactgcaaaacaagacctttcattgtgaaatctgtgatgtccatgtgaactcagagattcagctgaagcaacatatctcgtcccggcgtcataaggacagagtggccggcaagccattgaagcctaagtacagtccctacaataaattgcagagaagccccagtatcttagcggctaaactggcatttcagaaagatatgatgaagcccctcgcccctgcctttctgtcatctcccctcgccgccgcagcggccgtgtctagcgctttgtctcttccgcctaggcccagcgcctccctgtttcaggcacctgctatccctcctgccttgcttaggcccggccacgggcccatcagggcgacgcctgccagcattctcttcgcaccctattag

SEQ ID NO: 141428 - DNA, 96 bp, Artificial Sequence
  Description of Artificial Sequence: Synthetic coding sequence
atgaatatggccaactttctgagagggtttgaagagaaggggatcaaaaatgaccggccagaagatcagctatctaaggagaagaagaagatttag

SEQ ID NO: 141429 - DNA, 417 bp, Artificial Sequence
  Description of Artificial Sequence: Synthetic coding sequence
atgttagggagtacctgtcataccacgaccctccctgcccttgtccggacaccaaccctcatgatgcagccctcactggatatcaagccttttatgagctttcctgtcgattcatcttctgcagtggggctgttccctaattttaataccaaaaggagaggcctgttcgagactaacaagttctgccagatggacccagtgcagaaggccgtgattaatcacaccttcggtgtgagcattcctcccaagaagaaacaggtcattagttgtaatgtctgccagttgaggtttaatagcgatagccaggccgaggcgcactataagggttcaaaacacgccaagaaggtcaaggccttggatgccactaagaataaacctaagatggtgcctagtaaggactcagccaaggcaaactag

SEQ ID NO: 141430 - DNA, 228 bp, Artificial Sequence
  Description of Artificial Sequence: Synthetic coding sequence
atgaacatggcaaactttctacgcggcttcgaggaaaaagggataaaaaacgacaggcctgaagatcagctttcaaaggagaagaaaaagatactgtttagcttctgtgaggtctgtaacattcagttaaacagcgctgcccaggcccaagtgcactcgaatgggaaaagccaccgcaagcgcgtcaagcaactctcagacggacagcccccacccccagctcagtag

SEQ ID NO: 141431 - DNA, 792 bp, Artificial Sequence
  Description of Artificial Sequence: Synthetic coding sequence
atgatgcaaccttccctagacatcaaacctttcatgagtttccccgtggattcatctagtgccgtcgggctgttccctaactttaacaccatggatccggtgcaaaaggctgtcattaaccacacttttggcgtctcaataccgcccaaaaagaaacaggtgattagctgcaatgtgtgtcagctgagattcaattccgattctcaggccgaggcccactataaaggctctaagcatgccaagaaggtgaaagcactggatgccaccaaaaacaaaccaaagatggtaccatccaaggactccgcaaaagccaacccctcttgttctattactccaatcactggtaataacagcgacaaatctgaggataaaggcaaactaaaagcatcctcctccagccaacccagttcatcagagtcgggctcctttcttctgaagagcgggaccacgccgttaccacctggtgcagcaaccagcccttccaagtccacaaatggagctcccggcaccgtcgtcgaaagcgaggaagagaaggccaagaaactgctctattgcagcctctgcaaagtcgccgtcaactccctctcccagctggaggctcacaacacgggctcgaagcacaagacaatggtagaggccaggaacggcgctggccccattaaatcttatcccaggccaggaagcaggctcaagatgcagaatggttcgaagggttctgggctgcagaacaagaccttccattgcgaaatttgtgatgtccacgtgaattccgagatccagttgaagcaatag

SEQ ID NO: 141432 - DNA, 1002 bp, Artificial Sequence
  Description of Artificial Sequence: Synthetic coding sequence
atgtcggctaaactcgggaagagtagttcacttctaactcagacgagcgaagagtgtaacggcatattgacggaaaaaatggaagaggaagaacagacatgtgaccctgatagcagcctgcattggtcaagttcatattccccagaaacattcaggcagcagtttcgacaattcggttatcaggactctcctggccctcatgaagctctgtccagactctgggagttatgccatctctggcttaggccggaggtgcacaccaaagaacagattctggagttgcttgtcctggagcagttcctggctatcctacctaaagagctgcaagcctgggttcaaaaacatcaccctgagaatggcgaggaaaccgtgacaatgcttgaggatgttgagcgcgaattggacggcccaaagcagattttcttcggcagaagaaaggatatgattgcggaaaagttagcaccctccgagattaccgaggaactgccatcttcccaactcatgccagtgaagaaacagttgcagggagctagctgggaacttcagtctcttagacctcatgacgaagatatcaagaccaccaacgtaaaatccgcatctcgccagaaaacatctctgggaatcgaactgcactgcaatgtgtctaatattctgcacatgaacggatcacaatcttcgacctacagggggacctacgaacaagacgggcgcttcgaaaagcggcagggtaatccaagctggaaaaagcagcagaaatgcgacgaatgcggaaaaatcttttctcagagcagcgccctgatcctgcaccagcgcatccacagtggaaaaaagccatatgcatgcgatgagtgtgccaaggcattctcccggtccgctattttgatccagcaccggaggacccacactgattctaagtacgaacacgctatcgctgaggcgcaaaaaaacatgtatttcaagacccgcctcaaatgtcccagaagcctgtccggtggtcgatag

SEQ ID NO: 141433 - DNA, 1008 bp, Artificial Sequence
  Description of Artificial Sequence: Synthetic coding sequence
atgtctgcaaaactcgggaagtcaagttcactgctcactcaaacttccgaagagtgcaacggaatactgacagaaaaaatggaggaggaggagcagacctgcgatccagatagtagtctgcactggtccagcagttattcaccggagacctttcgtcagcaattccgacagtttgggtatcaagattcaccaggtccacacgaagccctttctcgcctatgggagctgtgccatctctggctccgcccggaagtccatacaaaagagcagatactggaactgcttgtgctggaacagttcctggctatcctccccaaagaattgcaggcatgggtccagaagcatcaccccgagaacggcgaagagacggtgacgatgctggaggatgtggagcgcgagctcgatgggcccaaacaaattttctttgggcgaaggaaggatatgattgcggagaaattggccccctcagaaataactgaggaattgccgtcttcacagctgatgccagtcaaaaagcagttacagggagcaagctgggagctgcagagcttacgcccccacgatgaagatattaagacaacgaacgtcaagtcagcatccagacagaagacaagtctgggtatagagttgcattgtaatgtgagtaacatactgcacatgaacgggtctcaatcctccacgtacagaggcacctatgagcaagatggaaggttcgaaaagcgtcaaggaaatccttcctggaaaaagcagcaaaaatgtgatgagtgtggaaagattttttcccaatcttctgccctcatcttacaccagaggatccactcgggtaagaagccatacgcttgcgacgagtgtgcgaaggccttctctaggtctgccattctgatccagcaccgccgcacgcacaccggagagaagccgtacaagtgccatgattgcgggaaggcttttagtcagagttcaaacctgttcaggcaccgtaagaggcatatcaggaagaaagtgccatag

SEQ ID NO: 141434 - DNA, 828 bp, Artificial Sequence
  Description of Artificial Sequence: Synthetic coding sequence
atggctgtcgaaagcggcgttataagtactctcattccgcaagatccacccgaacaggaattaattttggtgaaggtggaggataatttttcatgggatgagaagttcaaacaaaatggctctacacagtcttgccaagagctgttcaggcagcagttcagaaagttttgttaccaggaaactcctggcccccgggaagccctatcaaggctgcaggaactctgttatcaatggctcatgcccgagttgcatacaaaggagcagatcctcgaactgctcgtcctggagcagttcctgagtatattgcctgaagagctgcaaatctgggtccagcaacacaatccagagtccggagaggaagcagtaaccttgctggaggatctggaaagggagttcgatgatcccggtcaacaggtccctgcatcaccacagggacctgctgtgccttggaaggaccttacttgcctgcgtgcatctcaggagtctacggatattcatctacagccactgaagacacagctgaaatcctggaagccatgcctttcccctaaatctgattgtgagaatagcgagacagccacaaaggaagggatctccgaagagaaatctcaggggctcccacaggagccgtcgttccgaggtatcaagctgtccagaccacctaaggcctcttcggctatacggtgggagtgtgtgtccccggggtcatttccgggggatatcatagccgccgaagccacgcatagtaccatttcttgcttcgccataaatactctgcctgccaccattctgccctcaaaaaacgtcaataggaaatacttctcctag

SEQ ID NO: 141435 - DNA, 1605 bp, Artificial Sequence
  Description of Artificial Sequence: Synthetic coding sequence
atggctgtcgagtccggagtcataagcaccctgatcccgcaggacccccccgaacaagagctgatcctggttaaggttgaggataactttagctgggacgagaaatttaagcaaaacggctcgacccagtcttgtcaggagctgttcaggcagcagttccgcaagttctgctaccaggaaacccccggaccacgagaggctctgtcaagactccaagaactgtgctaccagtggctgatgccagaacttcacacaaaagagcagatcttagaactcctggtcctcgagcaatttctcagcatcttgccagaagagcttcaaatttgggtgcaacaacataacccggaatccggagaggaggcggtcactctcttggaagacttagaacgcgagttcgatgatccagggcagcaggtccccgcatcacctcaggggcccgccgtcccctggaaggatcttacttgtctccgggccagccaggagtcaaccgatatccacttgcaaccactcaaaacccagcttaaatcctggaagccttgcctgtctcctaagagcgactgcgaaaactcggagaccgctacaaaagagggcataagtgaggagaaaagccaagggctgccgcaggagcccagtttcagggggatatctgagcacgagagtaacctcgtgtggaaacaaggctccgccacaggggagaagctgaggagcccctcccagggaggaagtttttcacaagtcatttttaccaataaaagtttgggaaagagagacctatatgatgaagccgagcgctgcctcatattgactacagacagcattatgtgccaaaaggtacctccagaggagagaccctatagatgtgatgtctgtggacatagcttcaagcaacactcaagcctgactcaacaccagaggattcataccggggaaaaaccctataagtgtaatcagtgtggcaaggctttctctctccgctcctacctcattatacatcaacgaattcattccggagagaaggcatatgagtgtagcgaatgtggtaaagcgtttaatcaatcttccgccctgatacggcacagaaagattcacaccggtgaaaaggcctgtaaatgcaatgaatgcggcaaagctttttcccaaagttcttatctgataatccatcagcgtatccatacaggcgagaaaccctacgaatgcaatgaatgcggaaaaacgttctcccaaagcagtaagctgatcagacaccagcggattcacaccggtgagagaccttacgaatgcaatgagtgcgggaaggcctttaggcagtcctccgaattaatcacccaccagcgcatccattccggagagaaaccttatgagtgctctgaatgcggcaaagccttctcactgtcctctaatctgatcagacaccagaggattcattcaggcgaagaaccataccagtgcaatgagtgcggtaaaacttttaagcggtcgagtgcacttgtgcagcaccagcggatccacagtggagacgaggcatacatctgtaacgagtgtgggaaagcctttcgacaccgtagcgttctgatgcggcaccagcgggtgcacacaattaagtag

SEQ ID NO: 141436 - DNA, 738 bp, Artificial Sequence
  Description of Artificial Sequence: Synthetic coding sequence
atggccgtggaatctggcgttatttccacgctgatccctcaagatcctccagagcaggagctgatacttgttaaagtggaggataacttttcttgggatgaaaaattcaaacaaaatggaagcacccaaagttgccaagagctctttcggcaacaatttcgtaagttctgctatcaggagactccgggccctagggaagctctctcgcgcctgcaggagctgtgttaccagtggctcatgcccgaactgcatactaaagagcaaatcctcgagctcctggtgctcgaacaatttctgagcatcctgcctgaggagctgcagatctgggtacagcagcataaccccgagtccggggaagaggcagtgacgttgctggaggatctcgagagagagttcgatgatccagggcagcaggtgccagcatctccacagggtcctgcggtgccatggaaggacctcacctgtctcagagcctcacaggaatccaccgatatccacctgcagccactcaaaacccagttaaagtcatggaaaccttgcctgtcacctaaatcagagttatccaggcctcccaaagcatccagtgccatccgctgggagtgtgtgagcccaggctcctttcctggagatatcatagcagccgaggctacccactccaccataagctgcttcgcgatcaataccctccctgctacaatcctcccctctaaaaacgtgaacagaaaatatttttcgtag

SEQ ID NO: 141437 - DNA, 2340 bp, Artificial Sequence
  Description of Artificial Sequence: Synthetic coding sequence
atggctgccaatggcgatagtcctccctggagccccgccctcgctgccgaagggagggggtcgtcatgcgaggccagcgtctcctttgaggatgtgacagtggatttctctaaggaggaatggcagcacttggaccccgctcagcgcagactgtactgggacgttactctagaaaattactctcacctcttgtctgtgggctatcagatcccaaaatccgaagcggcatttaaactggagcagggggagggtccctggatgctggaaggcgaagcaccccatcagagctgtagtggcgaggccatcggcaaaatgcagcagcagggcattccaggtggcatattcttccactgtgagcgatttgatcagccaattggagaggactcactttgtagcattttggaggaattgtggcaggacaatgaccaactggaacagcggcaggaaaaccagaataacctactctcgcacgtcaaggtgctcattaaagagcgaggatacgagcataaaaatatagagaaaattattcacgttactaccaagctggtgccttccatcaagcggctgcacaattgtgacacgatcctaaaacacactctcaattcccacaatcataaccggaacagcgcaacgaagaacctggggaaaatattcggcaacgggaacaactttccgcattctccctcgagcacaaagaacgaaaatgcaaagaccggtgcaaattcgtgtgaacacgaccactacgaaaagcacctgagccacaaacaggccccaacccatcaccagaaaatccaccccgaggagaagctctacgtctgtaccgagtgtgtaatgggctttactcaaaagtcgcatctttttgagcaccagcgcatccacgctggtgagaaaagtcgggaatgtgacaaatctaataaagtgttccctcagaaaccccaggtggacgtgcaccccagcgtgtacacaggtgaaaaaccttatctgtgtactcaatgcggcaaggtcttcacgctgaagtctaacctgatcacacatcagaaaattcataccggacagaaaccatacaagtgttcagaatgtggaaaggcattttttcagcgaagtgatctgttccgtcatcttcgcattcacaccggagaaaagccctatgagtgttccgagtgtggcaaaggattctctcaaaacagtgatctctctattcaccaaaagactcacacaggcgagaaacattacgagtgcaacgagtgcggcaaagcgttcacccgaaaatccgctctgcggatgcaccaacggatccatactggggaaaaaccctacgtgtgcgccgactgtggcaaggccttcattcagaagtcgcactttaacactcaccagaggattcacacaggagagaagccgtacgaatgttccgactgcggtaagtcctttacaaagaaaagccagttgcatgtgcaccagaggatccacacgggcgaaaagccatacatttgcaccgagtgtggaaaagtcttcacccaccgtactaacctcacaacccaccagaagacgcataccggcgagaagccttacatgtgcgctgagtgtggaaaagcgtttaccgaccaatccaacctgattaaacaccagaaaacgcataccggagaaaaaccctataagtgcaatggttgtggcaaggcgttcatctggaagagtcggctcaaaattcaccagaagtcccacattggcgaacgccattacgaatgtaaagactgcggaaaagcgttcatccagaagagcacgctaagcgtgcaccagcgaattcatacaggtgaaaaaccatacgtgtgccctgaatgtggcaaagccttcatccaaaaatcacactttatcgcacatcaccggattcacacgggagagaaaccctacgagtgctccgattgtggaaaatgtttcactaagaagtcccagctccgggtgcaccagaaaattcacaccggggagaaaccaaacatatgcgcggaatgcggcaaggcgtttactgacaggtcgaacctaattactcatcagaagattcatacgagggaaaaaccttacgaatgtggcgattgcggaaaaactttcacgtggaaaagcaggttgaatatccaccagaagtcacacaccggcgagcgccattacgagtgctctaaatgcggaaaagccttcatccaaaaggccactctgtccatgcatcagatcatacacaccggcaagaagccgtatgcatgtacagagtgtcagaaagcttttactgaccgctccaacttgataaaacatcaaaagatgcatagcggggagaaaaggtacaaagctagcgactag

SEQ ID NO: 141438 - DNA, 2340 bp, Artificial Sequence
  Description of Artificial Sequence: Synthetic coding sequence
atggctgctaatggggactcccccccatggagccccgctctggccgccgaagggcgcggttcctcttgtgaggcctcagtgtctttcgaagacgttactgtagatttctcgaaggaagaatggcagcaccttgacccagcccagcgacgactctactgggatgttaccctggagaattatagccacctcttatctgtgggctaccagattcccaaatcagaggccgccttcaaactcgagcagggtgaggggccctggatgctggaaggcgaagctcctcatcagtcttgcagtggagaagctatcgggaagatgcaacagcagggtatacccgggggaatcttcttccactgcgaaagattcgaccagcccataggggaagactcattgtgttccattctggaggaattgtggcaagacaatgaccagttagagcagaggcaggaaaaccaaaacaatcttctcagtcatgtgaaagtattaatcaaagagcgcggttacgaacataaaaacattgaaaagatcatccacgttacaaccaagctggtgcccagtataaagcggctgcacaattgcgataccatactgaagcacacactcaacagccacaaccacaaccgtaactccgccacgaagaatctgggtaagatctttggcaatgggaataacttcccccactcgcctagttccactaagaacgagaacgctaaaacaggtgccaactcctgcgagcacgatcactacgagaagcatctctcccacaagcaggctccaacacatcaccaaaagatccatcctgaagagaaactctatgtatgcaccgagtgcgtgatgggattcacccagaaatctcatctgtttgaacatcaaagaatccacgcgggagagaagtccagagagtgcgataagagcaacaaggtctttcctcagaagccacaggttgatgttcacccatccgtatatactggagagaaaccttacctttgtacacagtgtggaaaggtttttacgctgaagagcaacctcatcacccaccagaagatacacactggacagaagccctacaaatgcagtgagtgcgggaaggccttcttccagagaagcgacctctttagacatctgcgcatacataccggagaaaagccatacgaatgctcagagtgcggcaaggggtttagccagaatagcgacctgtccattcaccagaagacccacactggggagaaacactatgaatgcaacgagtgcggtaaggcattcactcggaaaagtgccctaaggatgcatcagagaatacatactggggagaaaccctatgtctgcgctgattgtggcaaggcattcattcaaaagtcccacttcaatactcatcagcgtatccacaccggagaaaaaccctatgagtgtagtgactgcgggaagagctttactaagaaaagccagctacatgtgcaccagagaatccatacaggcgaaaaaccctatatctgcaccgagtgtgggaaggtgttcacacacagaaccaacctgacgactcatcagaaaacacataccggggaaaaaccctatatgtgtgctgagtgtggtaaggcctttacagaccaatccaacctgataaagcatcagaaaactcacacaggagagaagccctataagtgcaatggctgcgggaaggccttcatctggaaatcacggctcaaaatccaccagaagtcccatataggggagcgccactacgagtgcaaggattgcggcaaggcattcatccagaagtccacactttctgtccaccagaggatacataccggagaaaaaccttatgtgtgtccggagtgtggaaaagcttttattcagaaatcacacttcattgcccatcaccgcatccacaccggtgagaaaccatatgagtgcagcgattgcgggaaatgcttcacgaaaaagtcacagctgagggtccaccaaaagattcacactggagagaaacccaatatttgcgccgaatgcggcaaggcgtttacggataggtcgaacctcatcactcaccagaaaatccacaccagagagaaaccctacgagtgcggcgattgcggaaagacatttacttggaagtctagattaaacatccatcaaaaatcgcacaccggggagagacattatgagtgctctaagtgtgggaaagcattcatacagaaagcaacactctctatgcatcagattattcacaccggaaagaaaccatacgcttgtacggagtgccagaaggccttcacggacagaagcaacttgatcaaacaccagaaaatgcattcaggcgaaaagagatataaagccagcgactag

SEQ ID NO: 141439 - DNA, 2370 bp, Artificial Sequence
  Description of Artificial Sequence: Synthetic coding sequence
atgggaactttgcctcacgggccgcgcccgtggctgcagcgggatgtggccgctcacgtgtctgcagatcatgctgccctgaattctatcgtgtctcttcaggcaagcgtgtcgttcgaggatgtaaccgtggatttttcaaaggaggagtggcagcacctggacccggctcagcgacgtctgtattgggatgtaactctggagaactactcacatctgctgagtgttggctaccaaattccaaagtcagaggccgcatttaagttagagcagggagaggggccatggatgctggagggcgaagctccccatcagagctgcagcggtgaagctatcgggaaaatgcagcaacaagggataccaggcgggattttcttccactgcgagaggttcgatcagccaatcggggaagactctctgtgttccatcttagaagaactgtggcaggacaatgatcagctcgagcaaaggcaggaaaatcagaacaatctgctatctcacgtgaaggtcctcataaaggagagaggttacgaacacaagaatattgaaaagataattcatgtaacaacaaagctcgtgccgtcaataaagcgcctccacaattgcgatacaatcctcaagcacacattgaactcccataaccacaatcgcaatagcgccactaaaaacttaggtaagatattcggcaatggcaacaactttcctcattcgccgtctagcacaaaaaacgaaaatgctaaaaccggagctaactcatgtgaacatgaccattacgaaaagcacctgtctcacaaacaagcccccacccaccatcaaaaaattcaccctgaggagaagctgtatgtgtgtaccgaatgcgtgatggggtttacacaaaaaagccacctgtttgagcaccaacggatccatgccggagaaaagagcagagagtgtgacaaatcaaacaaagtctttccccagaaaccacaggtagacgtccaccccagcgtctacaccggtgagaaaccctacctttgcacgcagtgtggcaaagtcttcacgctaaaaagtaacctgattacacaccaaaagattcacaccggccagaaaccatataagtgctccgagtgtggtaaggctttcttccagagaagcgaccttttccgccaccttcgcattcacaccggggaaaagccgtatgaatgtagtgagtgcggaaagggatttagtcagaactcagaccttagcattcaccagaaaacccacaccggggagaaacactacgagtgcaatgaatgtggcaaggcttttactcgcaagtcagcactgaggatgcatcagaggatccatacaggcgagaaaccttatgtgtgcgccgactgcggtaaggctttcatccagaagtcacacttcaatacccaccagagaatccacactggggagaaaccatatgagtgtagcgattgcgggaagtcctttaccaagaagtcccagcttcacgttcaccagaggattcacactggcgaaaagccatacatctgtactgagtgcggtaaggtgttcactcaccgcacaaacctgacaactcatcagaaaacacacacaggcgagaaaccatatatgtgtgctgaatgtgggaaggcctttacggaccagtctaacctgataaaacatcagaaaacgcacacaggtgaaaaaccttacaaatgcaacggttgtgggaaggctttcatttggaagagtcggcttaaaattcatcagaagtcccacattggggagagacactatgaatgcaaggattgcggcaaagccttcatccagaagagtactttatcagtacatcagcgcatccatacgggcgaaaagccctacgtttgcccagagtgtggaaaggcatttatccagaagtcacatttcattgcacaccacagaatccacactggcgagaagccctacgagtgctccgactgtggtaagtgcttcacaaagaaaagccagctgcgggtacaccagaaaatccacactggcgagaaaccaaatatttgtgccgagtgtggaaaggcctttaccgaccgctcgaatctcattacccatcagaaaatccatactcgcgagaaaccatacgagtgtggtgactgtggtaaaacatttacctggaagtctcgacttaatatccaccagaagtctcatacgggagaacgccattacgagtgctccaagtgtgggaaggcttttattcagaaggccaccctgtccatgcaccagataatacacaccgggaagaaaccatatgcatgcacagagtgtcaaaaagcgttcacagacaggtcaaacctcatcaagcaccagaagatgcattcaggcgagaagcggtataaagcatcagactag

SEQ ID NO: 141440 - DNA, 537 bp, Artificial Sequence
  Description of Artificial Sequence: Synthetic coding sequence
atgggtactcttccacatggtccacggccttggcttcagcgggatgtcgctgcgcacgtttcagctgatcacgcagccctaaatagtattgtttcgctgcaggctagcgtaagctttgaagatgtaacagtggactttagtaaagaggagtggcagcacctggaccctgcacagaggaggctctattgggatgtcacgctggagaattactctcacctcctcagcgtgggataccagattccaaagtccgaggccgcatttaaattggaacagggagagggcccctggatgctcgaaggcgaggctccgcaccagtcttgtagtggcgaggccattggcaagatgcagcagcagggtattcccgggggcattttctttcactgcgagagattcgaccaaccgattggagaggatagcttgtgctctatcctagaggagctttggcaggataacgaccagctggagcagagacaggagaaccagaacaacttgctctcacacgtaaaggtgctgatcaaggagcgggggtacgagtag

SEQ ID NO: 141441 - DNA, 3855 bp, Artificial Sequence
  Description of Artificial Sequence: Synthetic coding sequence
atgcacaagaagcgggtggaagaaggcgaggcatcggacttctcactggcctgggatagtagcgtgactgccgccgggggtctggaaggtgaacctgagtgtgatcagaaaacatccagggcccttgaagacaggaattctgttactagccaagaagaacggaacgaggacgatgaggacatggaagacgagtccatctatacatgcgaccactgccagcaggattttgagagtctcgccgacttaacagatcacagggcccaccggtgtcctggtgatggcgatgatgatccccagctgtcttgggtggcaagttccccatcaagcaaggacgtcgcttccccaacacagatgataggtgacggatgtgatctgggtctaggcgaggaggagggtggcaccgggcttccttatccctgccagttttgtgacaagagtttcatccggctatcatacctgaagcgccacgaacagattcattccgataagctaccgtttaagtgtacttattgctcacgactgttcaagcataagagaagccgtgaccgtcacatcaagcttcatacaggagacaagaaatatcattgccatgaatgcgaagcagcttttagccgctctgatcatttaaagatccacttaaagacccactctagctctaagccattcaaatgtaccgtgtgtaaacgcggattctcctccacttcctccctgcagagccatatgcaggctcacaaaaagaacaaagagcacctcgctaagtcagagaaggaagcaaagaaagatgactttatgtgcgactattgtgaagatacattctctcagaccgaagaactcgagaaacacgtcctgacaagacacccgcaactcagcgagaaggcagatctgcagtgcattcactgccctgaggtttttgtggatgagaatacgttactggctcatattcatcaagcacacgctaatcagaaacacaagtgccctatgtgtcccgaacagttctcttccgtggagggggtttactgccacctcgactctcatcgacaaccagacagcagcaaccatagcgtcagtcccgaccccgttctgggcagcgtggcgtctatgagcagtgcaacacccgattcaagtgccagcgtggagagaggctccacccccgattcaaccctgaagcccttgcgagggcagaagaaaatgcgcgatgacggccagggctggaccaaggtggtgtacagttgtccctattgttccaaaagggattttaattcccttgcagtgttggaaatccaccttaagactatccatgcagacaaaccacagcagagtcatacctgccagatctgcctggacagtatgccgaccctgtataatctgaatgagcatgtgaggaaattgcacaaaaaccacgcataccctgtgatgcagttcggaaacatttccgcttttcattgcaattattgtcccgaaatgttcgctgatattaactcactccaggagcatatcagagtctcacactgtggaccgaacgcaaacccctcagacggtaacaatgcattcttctgtaatcaatgctctatgggcttcttgactgagtctagcttgactgagcatatccagcaggctcactgctctgtaggctcagctaagctcgaatcccccgtggttcagcccactcagagttttatggaggtctactcgtgcccatactgtactaactcccccatattcggatctatcttgaagttaaccaagcatatcaaggagaatcataaaaatatccccctggcccacagtaagaaatcgaaggccgaacagtccccagtgtcctccgacgttgaagttagctcacctaaacggcagcggctcagcgcatccgcaaactccataagcaacggtgagtatccctgcaaccaatgcgacctaaaattctctaattttgagtcattccagacacacttaaaactccatctggagctgttgctccgaaagcaagcatgtccacagtgcaaggaagacttcgatagtcaggagagcttgctgcagcatttgacggtccattatatgaccacatcgacacactacgtctgtgaaagttgcgacaaacaattcagtagcgttgatgatctgcagaagcacttgttggacatgcacaccttcgtcctttatcattgcacactgtgccaggaagtttttgatagcaaggtgtccattcaggtacacctggccgtgaaacacagcaatgaaaaaaagatgtatcggtgtaccgcctgcaattgggatttccgtaaggaggccgacttgcaggtgcacgtaaagcacagccacttgggaaatccagctaaagcacataagtgcattttttgcggggagacctttagcacagaggtggagctgcagtgccacatcacgactcacagcaagaagtataactgcaaattctgcagcaaggccttccacgcgataattcttctggagaaacatttacgggaaaagcactgtgtattcgacgccgccactgaaaatggaaccgcgaacggtgtgcccccgatggcgacgaaaaaggccgaacctgctgatctgcagggcatgctgctgaagaatcctgaagcacctaactctcatgaggcttcagaggacgatgtggatgcctcggagcccatgtatggttgtgacatctgcggagctgcctacacaatggaggttttgctccagaaccatcgacttagagaccataacattaggccgggggaagacgatgggtcccgtaaaaaagccgagttcataaaaggcagtcataaatgtaacgtgtgtagcagaactttcttttccgaaaacggattgagagagcaccttcaaacacatcgcggacctgcgaagcactacatgtgcccaatttgtggtgagcgttttccaagtttattgacattgacggaacacaaagtcacccattcaaaatctctggacacaggaacctgcaggatttgcaagatgccactccaatccgaagaagagttcattgagcattgtcagatgcaccccgatctgcggaattccctcaccggcttccggtgtgttgtttgtatgcagaccgtcacctccacactagagctcaagatacacggtacgttccatatgcagaagctggcaggatcttctgctgcctcatcccctaatggccaggggcttcaaaaactctacaaatgtgcactttgcttgaaggagttcagatctaagcaggacctggttaagttggacgtgaacggactgccctacggcctgtgtgccgggtgcatggcccggagcgcaaacgggcaggtcggaggtctggcgcccccagagcccgccgacagaccatgtgccggcctcagatgcccagaatgtagcgttaagtttgagtctgccgaggacctcgagagccacatgcaggtggaccacagagatttgacccctgaaacatcaggccctcggaaaggcactcagacctcacctgtaccgaggaagaaaacctaccaatgcattaagtgtcagatgaccttcgagaatgaaagggaaattcagatacacgtggctaaccacatgatcgaggagggtatcaaccacgaatgtaaactgtgtaaccaaatgttcgattcaccggctaaactcctctgtcacttaatagagcattccttcgaaggcatggggggcacattcaaatgtcctgtctgttttacagtgtttgtgcaggctaataaattacagcagcacatatttgcggtgcacggccaagaggacaaaatttatgattgcagccaatgtcctcagaagttttttttccagacggagttacaaaaccacactatgtcacagcacgcccagtag

SEQ ID NO: 141442 - DNA, 3504 bp, Artificial Sequence
  Description of Artificial Sequence: Synthetic coding sequence
atgatcggtgatgggtgtgacctcggtcttggcgaggaggaagggggtactggactgccctatccttgccagttctgcgataagtcctttatccggctgtcgtacctaaagcggcacgaacagatacacagcgataagctgccttttaaatgtacttactgttcaaggctgttcaagcataaacggtccagggaccgccatataaaacttcatactggcgataaaaagtaccattgccacgaatgtgaagccgccttttctcggagcgaccatctgaaaatacacctgaaaacccatagcagctctaagcccttcaagtgcaccgtttgtaaacggggcttctcttctacctccagtctgcaaagccatatgcaggcccataaaaagaataaagagcacctggccaaaagcgaaaaagaagcgaagaaggatgactttatgtgcgattattgcgaagacacatttagccagactgaggagttggaaaaacacgtcctgactcgccaccctcagctttcagaaaaagccgacttgcagtgcatccattgcccagaagtgttcgtggacgaaaacactttgcttgcccacattcaccaggcgcatgcaaaccagaagcacaaatgccctatgtgtcccgagcaattctcaagcgttgagggcgtgtattgccacctggactcacaccgtcagcccgattctagcaaccactcagtgtcccccgatcctgtgctgggcagtgtcgcctcaatgtcatccgccactccagattcaagcgctagcgttgagcggggctcaacgccagactcaaccctgaaaccattgagagggcagaagaagatgcgggatgatggccagggctggacgaaagtcgtctattcttgtccttattgcagcaaaagagatttcaattccttggctgtgctcgaaattcatctcaagacaattcatgcagataagcctcagcagtcgcacacttgccagatttgcctggatagcatgcccacactgtacaatctgaatgaacacgtaagaaagctccataagaaccatgcatatccagtgatgcaatttgggaacatttccgcttttcattgtaactactgtcccgagatgttcgcagacataaacagtctgcaggaacatatcagagtgtctcattgcggccctaacgcaaatcctagcgatgggaacaacgcattcttctgtaaccagtgtagtatgggtttcctgacagaaagcagtttgaccgaacatattcagcaggcgcattgtagtgtgggatctgccaagttggagtcacccgtcgtccagccgacacagtcttttatggaggtctactcttgtccatactgtacaaattctcctatctttggatccattctcaagctgaccaaacatatcaaagagaatcacaagaatatccctctcgctcactcaaaaaaatcgaaagccgagcagtcaccagtgtctagcgatgttgaggtaagctctcccaagaggcagcgcttgtctgcgtccgctaattctattagtaatggagaatacccgtgtaaccagtgcgacttgaagtttagcaactttgaatcctttcagacccacctgaagctacacctggaattgctgttgagaaagcaagcatgtcctcagtgcaaggaggatttcgactcacaggagtccttgctgcaacacctgacagttcactacatgacaacttctacgcactatgtgtgcgagtcgtgtgacaagcagttctcatccgtcgatgacctacaaaaacacctcctcgacatgcacacattcgtgctctatcactgcacactttgtcaggaggtatttgactctaaggtgtctatccaggtgcatcttgcagtcaaacatagcaacgagaaaaagatgtatcgatgcaccgcgtgtaattgggactttcgtaaggaggctgatctccaggtgcacgttaagcatagccacctgggcaatccggctaaggcccataaatgtattttctgtggggaaaccttttctactgaagtggagctacagtgtcatatcactacccactcaaagaagtacaactgtaagttctgttcaaaagcgttccatgctatcatcctgctcgagaagcacctcagggagaaacactgtgtattcgacgcagcgacagagaatgggactgccaacggtgtacctccaatggcaacgaagaaggccgagccagcagatctgcaggggatgttgctgaaaaaccctgaagcccccaactctcacgaggcaagcgaagacgacgtcgacgctagcgaacccatgtacggctgtgatatctgcggcgcggcatacactatggaggttcttttacaaaatcaccgtcttcgtgaccataatattcggcctggggaggatgacggaagcaggaaaaaagcggagttcatcaaggggtcacacaaatgcaatgtgtgttcacgcacattcttttcagaaaacggtcttcgtgaacacctgcaaacccaccgtggacccgccaagcattacatgtgtcctatatgcggggagcgttttccatccctacttacactcaccgaacacaaagtcactcactccaaatcactggatacaggcacatgccgtatttgcaagatgcccctccagagtgaggaagagtttatagaacattgtcagatgcatcccgatctccgcaactcactaactgggttcagatgtgtggtgtgtatgcagactgtgaccagcacccttgagctaaaaatccacggcacgttccatatgcaaaaactggcagggtccagcgctgcgtcgtcacccaatggacaaggattgcaaaaactatacaagtgcgccctgtgcttgaaggaattccgcagtaaacaggatttggtcaaactagacgtgaatggcctaccgtatgggctgtgcgctggttgcatggctaggtcagctaatggccaggtcggcggacttgctccacccgagccggcagaccgaccctgtgccggactgagatgcccagagtgttccgtcaagtttgagagtgctgaggacctcgagagccacatgcaggtagaccaccgcgatttgacccccgaaacttccggtccacgaaaagggacccagacaagcccagtaccccggaagaagacataccagtgcattaaatgccagatgacctttgagaatgagcgcgaaattcagatccacgttgcgaaccacatgatcgaagagggtataaaccacgaatgtaaactgtgtaatcagatgttcgacagccccgcaaaattgctgtgccatctgatcgaacactccttcgaaggcatgggaggaacgtttaaatgtccggtttgctttaccgtgtttgtacaggccaacaaacttcagcaacacatctttgccgtgcacggtcaagaagataaaatctatgactgttcccagtgcccacagaagttttttttccaaactgagctccagaaccataccatgagccagcacgcacaatag

SEQ ID NO: 141443 - DNA, 3855 bp, Artificial Sequence
  Description of Artificial Sequence: Synthetic coding sequence
atgcacaaaaaacgggtggaagagggcgaagcttcagacttcagcctggcctgggattccagcgtgacggcagccgggggcttagagggggagcctgagtgtgatcaaaagacctcccgggccctggaggatcggaactctgtcacctcccaggaagagagaaatgaagatgacgaagacatggaggatgagtccatttacacatgtgatcattgccagcaagactttgaatcccttgcggacctgactgatcatcgcgcccacaggtgtccgggtgatggtgatgacgaccctcagctgtcttgggtggcttcttccccttcgagcaaagacgtggcctcgccgactcagatgataggggacggatgtgacctgggcctcggggaggaagaaggtgggaccggtctgccttacccttgccagttctgcgataaatctttcatcagactgagctatttgaaaagacacgagcagattcacagtgacaaactgcccttcaagtgcacttactgctcacggctctttaagcataagcgtagtcgtgacagacacatcaagcttcacacaggagataaaaagtatcattgtcatgagtgtgaggccgctttttctcgcagcgaccatctgaagatccacctcaaaacacacagtagttccaagccctttaaatgcactgtttgtaaaaggggcttctcctcaaccagcagccttcaatcacacatgcaggcccacaaaaagaataaggaacacctggccaagtcagagaaagaagcaaaaaaagacgacttcatgtgtgactattgtgaagacacattttcgcaaaccgaagagctggaaaagcacgtgctcaccaggcatcctcagctgagcgaaaaagccgatctgcaatgtattcattgccctgaggtgttcgtggacgagaacaccctgttggcccatattcaccaggctcacgccaatcagaaacacaagtgtcccatgtgtcctgagcaatttagttccgtagagggagtctattgtcaccttgacagccacagacagcccgactcatccaaccactctgtaagccctgatcccgtgcttgggagtgtagcctcaatgtcctccgccacgcctgatagctccgcgtcagtcgaacgtggttcaacacccgactccactctgaagccactccgtggtcagaagaagatgcgcgacgacggacagggttggactaaagttgtctactcatgcccttattgtagcaagcgtgattttaattcactcgccgtgctggagattcacctgaagaccattcatgccgataaaccacagcaaagccatacctgccagatctgccttgactcaatgcccacactgtacaacctgaacgagcacgtgagaaagctgcacaagaatcacgcatatcctgtaatgcagtttgggaacatttctgcgttccattgcaactattgtccagagatgtttgcagacatcaactccctgcaagaacacatacgcgtatcacattgcgggccgaacgccaaccccagtgacggcaataatgccttcttctgtaaccagtgcagcatggggttcctgactgaaagtagcctgactgagcacattcaacaggcacactgctcagttggctcagccaagctggagagccccgttgtgcaacctacccagtcctttatggaggtctatagctgcccttactgcacgaatagcccaattttcggcagcattctgaagctgacaaaacacatcaaagaaaatcacaaaaatatccccttggcccactcgaaaaaatccaaggccgagcaatcccccgtctcatcagacgtggaagtatctagtccgaagagacagcgactgtctgccagtgcaaactcaatttccaatggcgagtatccctgcaaccagtgcgacctcaaattttccaacttcgaaagcttccagacccatctcaagttacacctggaactcttgttacgcaaacaggcttgcccccagtgcaaggaagactttgactctcaagagtctctgcttcaacacctaacagttcactacatgactacttccacacattatgtgtgtgagtcatgtgataaacagttttcaagcgtcgatgacttacaaaagcacctgttggatatgcatacattcgtgctttaccattgtacgctatgccaggaggtattcgacagtaaagtcagcattcaggtgcacctggccgtaaagcacagcaatgagaaaaagatgtatcggtgcacagcctgtaattgggactttcgcaaagaagccgatctgcaggtacacgtgaagcattcccatttgggcaatcctgccaaggcacacaagtgcattttctgcggcgagaccttctcaacagaagtggagctccagtgccacatcacaacacatagtaaaaagtacaattgtaaattttgttcaaaggccttccacgctatcatcctgctcgagaaacatctcagagaaaagcactgcgtgtttgacgccgcgactgaaaacggaactgctaatggggtacctccaatggcaacaaagaaggctgagcccgctgacttacagggcatgttgctgaagaatcccgaggcccctaattcccatgaagcttcagaggacgacgtggacgctagcgagccaatgtatgggtgtgatatttgcggtgccgcttacactatggaggtgctgctacagaatcacagactgcgggaccacaatatccgccccggggaggatgacggcagccgtaagaaggccgaattcattaaagggtcccataagtgcaatgtgtgcagtcggaccttcttcagtgaaaatggtttgcgggagcatctccaaacacacaggggccccgcgaagcactacatgtgcccaatctgtggggaacggttccccagtctgcttaccctgactgagcacaaggtaactcacagtaagtctcttgataccggcacctgccgaatctgcaagatgcccctgcaatccgaggaggagttcattgagcattgtcagatgcatcctgaccttaggaatagtctgaccggcttccggtgcgtggtctgcatgcagaccgtgacaagtactctggagctgaaaatccatggcaccttccatatgcagaagctggctggctcatccgcagcctcatcccccaatggacagggacttcaaaaactatacaagtgtgcgctttgtctaaaggaattcagaagcaagcaagacttggtcaagctggacgtcaatgggctcccctatgggctatgcgctggatgcatggctagatctgcaaacgggcaggttggggggttagcacctcccgagcccgccgaccgtccttgcgcaggccttcggtgtccagagtgttcggtgaaattcgagtccgcggaagatctggaatctcatatgcaggtcgaccatcgggatcttacaccagagactagcggtccccgcaaaggtacgcagacatctcccgtgccccgtaaaaagacctatcagtgtatcaaatgccagatgactttcgaaaatgaaagggaaatccagatccacgtggccaatcacatgatcgaggagggaattaaccacgaatgcaagctgtgcaaccagatgttcgactcacccgcaaagctgctatgccacctgattgagcactcctttgagggaatgggtggaactttcaagtgtcccgtctgttttaccgtgtttgtgcaggccaacaaactgcagcaacacattttcgcagtgcacggacaggaggacaagatttatgactgctcgcaatgtcctcagaaattcttctttcagactgagctccaaaatcatacgatgtctcagcacgcccaatag

SEQ ID NO: 141444 - DNA, 2430 bp, Artificial Sequence
  Description of Artificial Sequence: Synthetic coding sequence
atgggtccccttacctttatggatgtggccatagaattttgcctcgaagagtggcagtgtctcgacatagctcagcagaacctgtaccgtaacgtgatgttggagaactaccgtaatctcgtgttcctgggcattgcggtgtccaaacctgacttgattacatgcctcgaacaggagaaggagccatgggaaccaatgcgccggcacgaaatggtcgccaaaccacctgtaatgtgcagccacttcacccaagacttctggcccgagcaacacatcaaagacccttttcagaaggccactcttagaagatacaagaattgtgagcataagaacgtgcacctgaaaaaggatcataaatctgtagacgagtgcaaagttcaccgaggcggctataatggctttaaccaatgcctccccgccacccaaagcaagatttttctgttcgacaagtgtgtgaaagcctttcacaagttcagcaactctaatcggcacaaaattagccatacagagaagaagctttttaagtgcaaggaatgcgggaagtccttttgtatgctcccacatctggcacagcataaaatcatccacactagggtgaacttctgcaagtgcgagaagtgtggcaaggccttcaactgtccttcgatcataacaaagcacaaaagaattaatactggcgaaaagccttacacttgtgaagagtgtggcaaggtgtttaactggagttctagactgacaacgcacaagaagaattacacccggtataagctatacaagtgtgaagaatgtggtaaagcgtttaataaatcctctattctaacaacgcataagataataagaacaggggaaaaattttataaatgtaaggagtgcgcgaaggcgtttaatcagagctctaacctaacagagcataagaagattcacccaggggagaaaccgtacaaatgcgaagagtgtgggaaggcctttaattggcctagcactttgaccaaacacaagcgcattcacacaggcgaaaagccttacacctgcgaggaatgcggaaaagccttcaaccagttctctaatctgactacccacaaaagaatccataccgccgagaagttttacaaatgcactgagtgcggcgaggctttttccaggtcatcaaacctaactaagcacaaaaagatacataccgagaagaaaccttacaagtgtgaggagtgcggcaaagcatttaagtggtcgtccaagctcaccgaacacaaattaacacataccggcgagaagccatacaagtgcgaggaatgcgggaaagcctttaattggccctcgaccttgactaagcacaaccggattcacaccggggagaagccatataaatgcgaggtctgcggaaaagcgtttaaccagttctccaatctaaccactcacaaacggattcatactgcagagaaaccttataaatgcgaagaatgtggaaaagcattttcccggtcctccaacctcacaaagcacaagaagatccacatcgagaagaagccttacaaatgcgaggagtgtgggaaggcattcaagtggtcctccaaactgaccgagcataagatcacccacactggagagaaaccatataagtgcgaagaatgcggcaaagcctttaatcatttcagcattctgacaaaacataagcgcatacacacaggggaaaagccttataagtgtgaggaatgcgggaaggcattcacccaatcaagcaatctgaccactcacaagaaaatacacaccggcgagaagttttacaaatgcgaagaatgtggaaaggcattcacacagtccagcaatctgactacacataagaaaatccataccggaggcaagccctacaagtgtgaggagtgtggcaaagccttcaatcagtttagcacactaaccaagcacaagattatacataccgaagaaaagccttacaagtgcgaagagtgcgggaaggcctttaaatggtcctccacccttaccaagcacaaaatcatacataccggtgagaagccctacaagtgcgaggaatgtggcaaagcctttaagctgtcctccacactgagcacgcacaagatcatacacacaggagagaagccatacaagtgtgagaaatgtggcaaggcattcaatcgctcttccaaccttatcgaacataagaagattcacacaggtgaacagccctataagtgcgaggagtgtggcaaggcatttaactattctagtcacctgaacacccataaaagaatacacacgaaggaacagccttataaatgtaaagagtgtggaaaggctttcaaccagtactctaatcttacaacccacaataaaattcataccggcgagaaattgtacaagccagaagacgtaactgttattctgaccactccccagaccttcagtaatataaagtag

SEQ ID NO: 141445 - DNA, 2427 bp, Artificial Sequence
  Description of Artificial Sequence: Synthetic coding sequence
ggcccgctgacctttatggatgtggcaatcgaattttgcctggaggagtggcaatgtcttgatattgcccagcagaacctgtataggaacgtgatgctcgaaaactacaggaacctggtattcctcgggatcgccgtgtctaagccagacctgattacctgtttggagcaggaaaaggagccatgggagcccatgcggcgacatgagatggttgctaagcccccggtcatgtgttcccatttcacgcaggacttctggcctgaacagcacattaaggatccatttcagaaggccaccttgaggaggtacaaaaactgcgaacacaaaaacgtacatctgaagaaggatcacaagtcagtcgatgagtgtaaagtccatcggggcggctataatggcttcaatcagtgcctccctgctactcaatctaaaatttttctgttcgacaaatgtgtgaaagcctttcataagttcagcaacagcaatcggcataagatcagccacaccgaaaaaaaactgtttaagtgtaaagagtgcgggaaatcattctgcatgctcccacacctcgcccagcacaaaattattcacacgcgagtaaatttctgcaaatgtgaaaagtgcgggaaagccttcaactgccctagtatcataactaaacataagcgtataaatactggcgaaaaaccctacacgtgtgaggagtgcggaaaggtctttaactggtcatctagactgaccactcacaaaaagaattatacacgctataagctctacaagtgtgaggagtgtggcaaggcatttaataaaagtagtatcttgaccacgcataagatcatcagaaccggagagaaattttacaagtgcaaagagtgcgctaaagcgtttaaccagtcgtccaatttgacagagcacaagaagatccatcccggagagaaaccttacaaatgtgaagaatgcggtaaagcattcaactggcccagtacactaacaaagcataagcggatccatactggggagaagccctacacgtgtgaggagtgtggcaaggcattcaaccagttctctaatctgacgacccataagcggatccacacggccgagaaattctataagtgtaccgagtgcggcgaggccttcagccgctccagcaatctgacaaagcataagaagatccacactgagaagaagccatacaagtgcgaggagtgcggcaaggccttcaagtggagttcaaaactgaccgaacacaagctgactcatactggagagaaaccctataagtgtgaggagtgtggtaaagctttcaattggccttccactctgaccaagcataatcgcatccacacaggagagaagccttacaaatgcgaagtgtgcgggaaggctttcaatcagttcagtaatcttaccacacataagcgcatacacactgctgaaaaaccctacaagtgcgaggagtgtgggaaggctttttccaggagttccaacctgaccaaacataagaagatccacatcgagaagaagccctacaagtgcgaggagtgtggaaaggccttcaagtggtccagcaagctgactgagcacaaaatcacacacaccggtgagaaaccatacaagtgcgaagaatgcggaaaggcttttaaccatttttcaatactcacaaaacacaagcggattcacaccggggaaaagccttataagtgcgaagagtgcggaaaagcatttacacagagttcgaacttgacaacccataaaaagatccacacaggtgagaaattttataagtgcgaggaatgtggtaaggcttttacccagagttcaaatttaacaactcataaaaagatacacacaggtggaaagccctataaatgtgaggagtgcgggaaagcattcaatcaattcagcacattgactaagcacaaaattattcacaccgaagaaaaaccctacaagtgtgaggagtgtggaaaggcctttaaatggtccagcaccctgactaagcacaaaatcattcacaccggtgaaaagccttataaatgcgaggagtgcggaaaagcatttaaactatctagcaccttatccacgcacaagatcatccacaccggggaaaagccttacaagtgtgaaaaatgcggaaaagcatttaatcgcagttctaacctgatcgagcacaaaaagatacataccggtgagcaaccttacaaatgcgaggagtgtggaaaagcatttaattattcaagtcacttaaatacacataaaaggatacataccaaagaacagccttacaaatgcaaggaatgcggtaaagcattcaaccagtacagtaacctgacgactcataataagattcacaccggtgagaaattgtataagcctgaagacgtgacggtgatcctgaccaccccccagaccttcagtaatattaaatag

SEQ ID NO: 141446 - DNA, 2412 bp, Artificial Sequence
  Description of Artificial Sequence: Synthetic coding sequence
atggatgtggccatcgagttctgcctggaggagtggcagtgtctggatatagctcaacagaacctttataggaacgtcatgttggaaaactaccggaacctggtgtttctcggcatagccgtgtcaaaaccggatctcatcacctgccttgaacaggagaaagagccatgggagccgatgcggagacacgaaatggtggccaagccccccgtaatgtgcagtcactttacccaagatttctggcctgagcagcatatcaaggatccatttcagaaagcaactttaaggcgttacaagaactgtgagcataagaacgttcacctgaagaaagaccataagagcgtcgatgaatgtaaagttcatcggggaggatataacggcttcaaccagtgtctgcctgccacccagagtaaaatctttttgttcgataagtgcgtgaaagccttccataagttctcaaatagtaataggcacaagatatctcatacggaaaagaaactgttcaagtgcaaagagtgtggcaaatcattttgcatgctgccccacctggcccagcataaaatcatccataccagagtcaatttctgtaaatgtgagaaatgcgggaaagcgtttaattgcccaagtatcatcacaaagcacaaacggatcaacactggagagaagccgtacacgtgtgaagagtgcggtaaggtttttaactggtccagccgcctaaccacgcacaaaaaaaactacactcggtataagctgtacaagtgtgaggaatgcggcaaggccttcaacaagagctccattctcaccacacataagatcatcagaaccggcgagaagttctataaatgcaaagagtgcgccaaagccttcaaccagagctccaatcttactgagcacaagaagatccatcctggggagaagccctacaagtgcgaggaatgcgggaaggctttcaattggccttcaacacttactaagcacaaaagaatacacacaggggaaaagccctacacatgcgaggagtgcgggaaggctttcaatcaattttccaatttgactacacacaagagaatccatactgcagagaagttctacaaatgcaccgaatgtggcgaagccttttcaagaagctctaacttgactaaacacaagaagatccacaccgaaaaaaagccctataagtgcgaagaatgcggcaaggcgttcaagtggtctagcaagctgactgagcataaactcacccacactggtgagaaaccatacaaatgtgaagagtgtggcaaagcctttaactggcctagtacccttactaagcacaaccgcattcacacaggcgagaagccttataaatgtgaggtgtgcggcaaggctttcaaccagttttccaacctgactacacataaacgcatccatacagccgaaaagccatataaatgcgaagagtgcgggaaagccttcagtagatcttccaacctgaccaaacataaaaaaatacacatcgagaagaagccttacaagtgtgaagagtgcgggaaagctttcaagtggtcttcgaaactgacagagcacaagataactcatactggagagaagccctacaagtgtgaggagtgtggcaaggctttcaaccactttagtatcctgaccaaacacaaaagaattcacaccggggagaaaccttacaagtgtgaggagtgcggcaaggccttcacacagtccagcaacctgacaacacataagaaaatccacactggggagaagttctacaagtgtgaggagtgcggcaaagccttcacccagtccagtaacctcactacgcataaaaaaatccatacaggcggcaaaccttacaaatgcgaggagtgcgggaaggcctttaaccaattcagtaccctcaccaagcacaagattatccatactgaggagaagccttataaatgcgaggagtgtgggaaagcgtttaaatggtcgagcactctgacgaagcacaagatcattcacacgggagagaaaccatataagtgcgaggagtgcggaaaagcattcaagctgtcttccaccctgagcactcacaagattatacacacaggagaaaagccttacaaatgcgagaagtgtgggaaggctttcaacagatcttcgaacctgattgaacataaaaaaatccatacaggcgagcagccttacaagtgtgaagagtgcggaaaggcttttaactacagcagtcacctgaacactcacaaacgcatccataccaaagaacagccctataagtgcaaagaatgcggcaaagcattcaaccagtactctaacctaacaacacataataaaatacatacaggtgagaaattgtataagcctgaagatgtgaccgtcattttgactacaccacagacattctccaatataaaatag

SEQ ID NO: 141447 - DNA, 1713 bp, Artificial Sequence
  Description of Artificial Sequence: Synthetic coding sequence
atggaaaacctgaagtccggcgtgtaccctctcaaggaggcaagtggctgtcccggcgccgaccgcaatctattagtctatagcttctacgagaagggcccgctgaccttccgcgatgtggcgatagagtttagtcttgaggagtggcaatgtttggacactgcccagcaagacctctaccggaaggtcatgcttgagaactacagaaatctcgtattccttgcaggtatcgctgtgagtaagcccgatctcatcacttgtttggaacaagggaaagaaccttggaatatgaagagacacgccatggtggatcaaccacctgtgacatacagtcacttcgcccaggatttatggcctgagcagggtatcaaggatagctttcaggaagtgattctccggcgttatggtaaatgtggacacgaagatctccagctgcggacagggtgcaaatcggttgacgagtgcaatctccacaaagaatgctacgatgagctcaaccaatgccttactacaacacagtccgagattttccaatatgataaatacgtgaacgtgttctataagtttagtaacccaaacatacagaagattagacacacagggaagaagccattcaagtgtaagaaatgtgataagagcttttgcatgctgctccatcttacccagcataagaggatccacattagagagaacagctatcaatgtgaagaatgtgggaaggtttttaattggttttctaccttgacaaggcaccggcgcatccatacaggggaaaaaccatataaatgtgaacagtgtggtaaagcgtttaagcagtcttccacactaacaacacataagatcatccacaccggggagaagccctaccgatgtgaggagtgcggcaagacttttaatagatcttcccacttgaccacccacaagcgtatccacaccggggagaagccatacaggtgcgaggaatgtggcagagctttcaatagaagcagccacttaacaacccacaagattattcacaccggagaaaaaccctataagtgcgaggagtgtggcaaggcttttaatcagagttcaaccctcactacacataaaattattcacgcgggggagaaaccctataagtgtgaggagtgtggcaaagccttctatagattcagctacttgactaaacataaaattatacacacaggcgaaaaattctacaaatgcgaggaatgtggcaagggatttaactggagctccaccctaacaaaacacaagcggattcacacaggcgagaaaccctacaagtgtgaacagtgtgggaaggctttcaacgaaagtagcaatcttactgcccacaaaatcattcacactggcgaaaagccgtataaatgcgaagaatgtggcaaggctttcaatcgatcgccgaaattgactgcacataaggtgattcactcgggggagaaaccttacaagtgcgaggagtgcggtaaggcgttcaaccagttctcaaacttaactaaacataagatcacacacatcggcgacacaagctacaaatatcttgaatgcgataaggctttttctcaatccagcacgttgactaagcacaaggtgatacataccggcgaaaagccatataattgcgaggagtacggcaaggcttttaatcagtcaagcaatctgatcgaacagtctaattcgtactggagggaaactttacagatgtag

SEQ ID NO: 141448 - DNA, 1413 bp, Artificial Sequence
  Description of Artificial Sequence: Synthetic coding sequence
atggcagctaccctcttaatggccgggtcccaagcccctgttacttttgaagacatggccatgtacctgacgcgcgaggagtggcgtccactggacgccgcacagcgcgatctgtaccgggacgtgatgcaggaaaattacggcaacgttgtgtccctcgatttcgagataagaagtgaaaacgaagttaatcccaagcaagaaatcagtgaagacgtgcaatttggcacaacatcagaacgacccgccgaaaacgcagaggagaacccggagagtgaagaagggtttgaaagtggagatagaagcgaaaggcagtggggcgacctgactgctgaagagtgggtgtcttatccccttcagcccgtcaccgatttgctggttcataaagaagtgcacaccggcattcgttaccatatatgttcacactgtggtaaggcttttagtcaaatctctgatctgaaccgtcatcagaagacccataccggagaccgaccctacaagtgctatgaatgcggcaaagggttttcaagaagttcccacctgatacagcatcagcgaacccacacaggtgagaggccttatgactgtaatgagtgcggaaaaagcttcggccgatctagccatctgattcagcaccaaaccatccacacaggcgagaagcctcacaaatgtaacgagtgtgggaagtctttctgccgcttgagccatttgatacaacatcagcggacacatagtggggaaaagccatacgaatgcgaggagtgtggtaaatccttctcaagatcgtcccacctggcacagcatcagagaacgcataccggcgaaaaaccttatgaatgcaacgagtgtggaagaggcttctcggaaaggtcagacctgattaagcattacagagtgcatacgggcgaacgtccttacaagtgtgatgaatgtggcaagaatttctctcagaattccgatctagtccggcaccgtcgggcccacacaggcgaaaagccgtaccactgcaatgaatgcggcgaaaacttctcccggattagtcatctagtgcagcaccagagaacacacacgggagaaaagccttacgaatgcaacgcttgtggtaagtcattttctcgttcctcacacctgataacccatcagaagattcatactggggaaaaaccatacgagtgtaacgaatgttggcggagttttggggagcggtctgacctgattaagcaccagcgcacccacaccggcgagaaaccttacgagtgtgttcagtgcggtaaaggctttacacagtcttctaacttaattactcaccagagagtgcacactggtgaaaaaccttatgagtgcacagaatgcgagaagagcttctccaggtctagtgccttaattaagcacaaaagagtgcacactgactag

SEQ ID NO: 141449 - DNA, 1413 bp, Artificial Sequence
  Description of Artificial Sequence: Synthetic coding sequence
atggccgcaaccctgcttatggcaggatctcaggctccagtgacattcgaggatatggctatgtacctgacccgagaggaatggcgtccacttgatgcggcacaaagggacctgtaccgcgacgtcatgcaggagaactacggcaatgtcgtgtcattggattttgagatcagatccgaaaacgaggttaatcccaagcaggaaatctcagaggatgttcaattcgggacaacttccgaacgccctgccgagaacgcggaggagaaccccgaatccgaagaaggtttcgagtctggggatcgctctgaacgtcaatggggcgatctcaccgctgaggaatgggtcagttatcctcttcagcccgtcacagacctcctagtgcacaaggaggtgcacactggcattaggtaccatatctgcagtcattgcgggaaggccttttcacagatatctgatctcaacaggcaccagaagacccacaccggggaccgtccttacaaatgctacgaatgcggaaagggtttctctcgcagttcacatctgattcagcatcaacgtacacacacgggggagcggccatacgattgtaacgaatgcgggaaaagtttcggcaggtcaagtcacctgatacagcatcagacaattcacacaggcgaaaagcctcataaatgtaacgagtgtggtaagagcttctgcaggctgagccacctgatccaacaccagcggacccatagcggcgagaaaccatacgagtgcgaggaatgcgggaagtccttctctaggtcctcccatctggcccaacaccaacggacccataccggagagaaaccgtacgaatgtaacgaatgtggaaggggcttcagcgagcgatcggacttaattaagcactaccgggtgcataccggggaaagaccatacaaatgcgatgaatgcggaaaaaatttttcacagaattccgatctcgttaggcatcggcgggctcataccggcgaaaagccataccattgcaatgagtgtggcgagaatttctccagaatttcacatttagtgcagcaccagaggacccacaccggtgaaaaaccttatgagtgtaacgcctgtgggaaatccttttcgcgcagcagccaccttattacccaccagaagatccacaccggggaaaagccctatgaatgtaatgagtgctggaggagtttcggtgagaggtctgacttgattaaacaccagagaacacatacaggcgagaaaccttatgagtgtgtgcaatgcgggaagggctttacacagagcagtaatctgatcactcatcaacgcgttcacacaggtgagaagccatacgaatgcactgaatgcgaaaagtcatttagccggtccagcgcattgatcaagcacaagcgggttcacaccgactag

SEQ ID NO: 141450 - DNA, 909 bp, Artificial Sequence
  Description of Artificial Sequence: Synthetic coding sequence
atggcggccactttgctcatggctgggagtcaagcaccagtgactttcgaagacatggccatgtacctcacacgggaggagtggagaccactcgatgcggcacaacgcgatctgtaccgagatgtgatgcaagaaaactatgggaacgtcgtctctctggactttgagatcaggtccgaaaacgaagtgaatcccaagcaggagatctccgaggacgtgcagtttggaaccacatctgagagacccgcagaaaacgcagaagagaatcccgagtcggaggaggggttcgaatcaggggataggtctgaacggcagtggggagacctcacagccgaggagtgggtgagctaccctctgcaacccgtgacagatttactggtgcacaaggaggtccacaccggcattcggtatcacatatgttcccattgcgggaaggcattctcccagatatcagacttaaaccgccatcagaaaacacatacaggggaccgcccatacaaatgctacgagtgcggcaaggggttttcacgcagctcacacctgatccagcaccagagaacccataccggggagcgtccatacgactgcaatgaatgtggtaaatcgttcggccggagcagtcatttgatccagcaccagacgatccatacaggcgaaaagccccacaagtgcaacgaatgcgggaaaagtttctgccggcttagccacctgatccagcatcaacggacacattcaggtgaaaaaccctacgagtgtgaggagtgtggaaaatcctttagtcggtcttcccacctggcacagcaccagcgcacacatacaggagagaaaccctacgagtgtaccgagtgtgagaaaagcttcagccgctcttccgctctgattaagcacaagcgcgtgcacactgattag

SEQ ID NO: 141451 - DNA, 1848 bp, Artificial Sequence
  Description of Artificial Sequence: Synthetic coding sequence
atggattcagtggcctttgaggatgtggcagtgaacttcactcacgaggagtgggccctgctggggcctagccagaagaatctgtaccgggacgtcatgagggaaaccatcagaaatctaaactgtattgggatgaagtgggaaaatcaaaacattgatgatcagcaccagaatctgcgaagaaatcctaggtgcgacgttgtggaacgcttcggtaaatctaaggatggatctcagtgcggagaaacgttgtcacagattagaaatagtatcgttaacaaaaatacacctgctagagtcgatgcctgcgggtcttcagttaacggggaggtgattatgggccactcatccctgaattgttatatcagagtcgacacagggcacaaacatagggagtgtcacgagtacgccgagaagtcctacacacacaagcaatgtgggaaaggattatcctacaggcattctttccagacttgtgaacgaccacacaccgggaagaagccctatgactgcaaggaatgcggcaaaactttctccagccccgggaacctgaggcgtcatatggtagtgaaggggggagatggcccctataaatgcgaactgtgtggaaaagcctttttttggccaagcctgctcagaatgcatgagagaacacatacaggggagaagccatatgagtgtaaacagtgcagtaaggccttccctgtctacagctcatatctgcgccacgaaaaaatccacacaggtgagaagccctacgaatgcaagcagtgtagcaaggcctttccagactattcctcatacctccgacatgagaggacacacacaggcgaaaaaccctacaagtgcaagcagtgtgggaaggctttctccgtctccgggtccctgcgagtccacgagaggatacatacaggcgaaaagccctatacgtgtaagcaatgcggcaaggcattttgtcacttgggatcatttcagcggcatatgataatgcactcaggagatggcccgcacaaatgcaaaatttgcggcaaaggcttcgatttcccaggcagtgctcggatccatgaaggcactcacacccttgagaagccctatgaatgtaagcagtgcggcaagttactctcacacaggtcctcgttcaggaggcacatgatggcccacacaggtgacggcccccacaaatgtacagtgtgcggcaaggccttcgactctccctctgtgttccagagacacgaacgcacgcacacaggggaaaaaccctacgagtgcaaacagtgcgggaaggcctttcgtacctcctccagtcttagaaaacacgagacaactcataccggagagcaaccctacaaatgtaaatgcggaaaggcctttagcgacttattctcatttcagtcacatgaaacgacccactctgaagaggagccttatgaatgcaaagagtgtggcaaggcattctcctcctttaagtacttttgccggcatgaaaggacacacagcgaggaaaagtcctacgagtgtcaaatttgcgggaaggcattttcaagatttagctaccttaagacccatgagcgtactcacaccgccgagaagccctacgaatgcaagcagtgccggaaagctttcttctggccctcgtttttattgaggcatgaacgcacccacactggagaacgcccttatgagtgtaaacactgcgggaaagccttcagcaggagctctttctgtcgcgagcacgaaagaacacacaccggggaaaagccgtatgagtgcaaagaatgtggtaaggctttctcttctctcagctcctttaatcgtcataaacggacccattggaaggacatcctttag

SEQ ID NO: 141452 - DNA, 1992 bp, Artificial Sequence
  Description of Artificial Sequence: Synthetic coding sequence
atggccctgtgctacggcaccttctggggataccccaagatgctggaggccgccaatcttatggaaggcctcgtggatattggtccctgggtgactttgcctagaggccaacctgaggtcctggagtggggcttacctaaagaccaggacagtgtggcttttgaggatgtggccgtgaacttcacccatgaggagtgggcattgctcgggccctcccagaaaaacttgtaccgggatgtgatgcgagagacgattcggaacctgaactgtatcgggatgaagtgggagaaccaaaacattgacgatcagcaccagaatctcaggaggaatcctcgatgtgacgttgtggagaggtttggtaagagtaaggatggttctcagtgcggggaaaccctcagtcagattcgaaatagtattgtgaacaagaatactcccgcccgggtggatgcgtgtgggagttcagtgaatggagaggtcattatggggcacagttctcttaattgctacattagagtggatactggtcacaaacatagggaatgccacgaatacgcagagaaatcttacacacacaaacagtgcggcaagggcctctcctacaggcactcctttcagacctgtgagcgacctcacacgggcaagaagccctatgactgcaaggaatgcggaaagacctttagtagccctgggaacttgcgccgccatatggttgtcaaggggggagacggcccatacaaatgcgaattgtgtgggaaggctttcttttggcctagtttgttgcgtatgcacgagcgaactcacactggagagaagccttacgagtgtaagcaatgcagcaaagcattcccagtatactcctcttatctccgccacgaaaagatacacaccggggagaagccttacgaatgcaaacagtgttctaaagcatttccggactattccagctacctgcgacacgagagaacgcacaccggggaaaagccgtataagtgcaaacagtgcgggaaagccttttcagtgtcaggttcgctgagagtgcacgagaggatccacactggagaaaaaccatatacttgcaagcagtgcggaaaagcgttttgtcacctcggaagcttccagcgccacatgatcatgcactctggcgatggtccacacaagtgtaagatctgcgggaaaggttttgatttccccggcagcgcacgaatacatgagggtacgcacacactcgaaaaaccttacgaatgtaagcaatgcggaaagctcttgtcccacagatccagtttccggcgccatatgatggcccataccggcgacgggcctcacaaatgtactgtgtgtggaaaggcctttgattcaccatcagtgtttcagaggcatgaacgaacccatactggggagaaaccttatgagtgtaagcagtgcggtaaagcctttcgaacaagtagttccttgagaaagcacgagactacacacactggcgagcagccttataagtgtaaatgtgggaaggccttctccgacctattcagctttcaatctcatgagaccacccacagcgaggaggagccatatgaatgcaaagaatgcgggaaagccttttcctcttttaaatatttctgtcgacacgagcgcactcattccgaagagaagagctacgaatgtcagatctgcggcaaagcgttcagccgcttcagttaccttaaaactcatgaacgaactcacactgctgaaaagccttatgagtgcaaacagtgccgtaaagcctttttttggccatctttccttctgcgccatgagcgtacccacacaggggagaggccatacgaatgcaagcactgcgggaaggctttttcaagatcatcattttgtcgggagcacgagcgtacgcacactggcgagaagccatatgagtgcaaggaatgtggcaaggcattcagctccctgtccagttttaaccgccataagaggacacactggaaagatatactctag

SEQ ID NO: 141453 - DNA, 1914 bp, Artificial Sequence
  Description of Artificial Sequence: Synthetic coding sequence
atggctctgtgctatggcaccttctggggctacccaaagatgctggaagctgcgaatctgatggagggactggtcgatatcgggccctgggtgacgttgcccagaggtcaaccagaagtgcttgagtggggcttaccaaaggatcaggacagcgttgcattcgaggacgtggctgtgaattttactcatgaggaatgggccctactgggccccagccagaagaatctgtacagggacgtgatgcgagaaaccatccgtaacctcaattgtatcgggatgaagtgggagaaccagaacattgacgaccagcaccagaacctaagaagaaatccccggtgtgacgtagtggagaggttcggcaagagtaaagacggctctcaatgtggggagactttgagtcagatcaggaactccatcgtcaacaagaacaccccagctcgcgtagacgcctgcggaagcagtgtgaacggcgaagtgataatggggcattcttctctaaactgctacattcgggtggacaccggccataagcacagggaatgtcatgaatatgctgaaaagagttatacccataagcaatgtgggaaaggactaagttatcgccacagttttcagacctgtgagagacctcacactggcaaaaagccttatgattgcaaagagtgtggtaagacattctcaagtcccgggaacctccgcaggcacatggtcgtgaagggaggcgacggcccttacaaatgcgaactgtgtggaaaggcgtttttctggccatccctcctgagaatgcacgagagaactcatacaggagaaaagccatacgaatgcaaacagtgttctaaagctttcccggtgtactctagctatctgcgacacgagaagattcacacgggagaaaaaccctacgagtgcaagcaatgttctaaggcctttccagactactcttcttatctgagacatgagcgcactcataccggggagaaaccttacaagtgtaagcagtgcggcaaagcatttagtgtgagcggctcgctgagggttcatgagagaatacacactggagagaagccctacacatgcaagcagtgcgggaaggcattttgtcacttggggtcttttcagcgtcacatgatcatgcactctggagatggcccacataaatgtaagatatgcggaaagggattcgattttcccggaagcgcccggatccacgagggcacccatactctggaaaagccctatgaatgtaaacagtgtggaaagctgctttcccacaggtctagctttcgtcggcacatgatggcccacacaggagacggcccacataagtgtaccgtgtgcggcaaggctttcgactccccctccgtgttccagcgccatgaaaggactcataccggggagaagccttatgaatgcaagcagtgtggcaaagccttccgcacctcgagctctctgcgcaagcatgagacaacacacacaggcgagcaaccttacaaatgcaagtgcggcaaggctttttcagatttgttctcattccagtctcacgagaccacacattcagaagaagaaccatacgagtgcaaagagtgcggtaaagcattctccagcttcaaatacttctgtcgccatgagcgtacccactccgaagagaaaagctacgagtgccagatctgcgggaaggccttctctcggttttcgtacttaaaaactcatgaaaggacgcatacagccgaaaagccgtatgagtgtaagcagtgccggaaagcgttcttttggccctcattcttattgaggcacgagcgtacacacacaggggagcgaccttatgagtgtaagcattgtggcaaggcattcagccggtctagtttttgtcgagaacacgaacggacacatacaggagagaagccctatgagtag

SEQ ID NO: 141454 - DNA, 1770 bp, Artificial Sequence
  Description of Artificial Sequence: Synthetic coding sequence
atggactctgtggcttttgaggatgtagcagtcaactttacacacgaagaatgggctctgctgggccctagccagaaaaatctctaccgggacgttatgcgcgagacaatcagaaacctaaactgcattgggatgaaatgggaaaatcaaaatattgacgaccaacaccagaacctccgccggaaccctcgatgcgacgtggtagaacgcttcggaaaaagcaaagatggatctcaatgcggagaaaccctgtcacagattcgaaatagcatcgtgaataagaacactcctgccagagtcgatgcttgcggctcttccgtgaatggagaagttataatgggacactccagtctcaactgttacatccgggtggacaccggccataagcacagagagtgtcacgagtatgccgagaagtcttacacacacaaacaatgcggaaaaggcctttcctaccggcactccttccagacttgtgagcgcccccacacaggcaaaaaaccatatgattgcaaagagtgtggtaagacgtttagttcccctggcaacctgaggaggcatatggtggtcaagggaggggacggcccatacaagtgtgaactttgcgggaaggctttcttttggccctctctgctccgcatgcatgaaaggacccatacaggggagaagccatatgaatgtaaacaatgctccaaggcctttcctgtttactcctcttaccttcgccacgagaagatccatactggggagaagccatacgagtgcaagcaatgcagcaaagcattccctgactatagtagctacctcagacatgagcgaacccataccggcgagaaaccgtataaatgcaagcagtgcggaaaagccttctctgtgtccggctctctaagggtacatgagaggatccacaccggggaaaagccctacacgtgcaagcagtgcggcaaagccttctgtcatttaggcagctttcagaggcacatgattatgcatagcggcgatggacctcataaatgtaagatttgcggaaagggctttgattttcctggcagcgcaagaatacatgaaggaacacataccttggagaaaccctatgagtgtaagcaatgcgggaaactgctgagccacagaagttcctttagacggcatatgatggcccacacaggagatggcccacacaaatgtacggtgtgtgggaaggctttcgatagcccctccgtttttcagcggcacgaacgcacccatactggagagaagccttacgagtgcaagcagtgcggcaaagcttttcggacaagcagttcccttcgtaaacacgagaccacccataccggagagcagccctataagtgtaagtgcggaaaggcattcagtgatctgttctcctttcagagtcacgagaccacccactccgaggaggaaccctacgagtgcaaagaatgtggcaaagcttttagttcctttaaatatttttgccggcacgaaaggacccatagcgaggagaagagctacgaatgccagatttgtggtaaagcgttctcccggttcagctacctgaagacacacgaacgcactcacactgcagaaaaaccttatgagtgcaagcaatgccggaaggccttcttctggcccagttttcttctccggcacgaaagaactcacactggtgaacggccctatgagtgtaagcattgtggcaaggcattcagccgatcgagtttttgtcgggagcatgaaaggacgcacacgggagaaaagccctatgagtag

SEQ ID NO: 141455 - DNA, 1623 bp, Artificial Sequence
  Description of Artificial Sequence: Synthetic coding sequence
atgggcatcgtagagaaggcctcttcatctagcgatagcgtcaccttcgaagatgtggccgtcaatttcacacaggaggaatggaccctgctcgatcctagtcagaagaaactctaccgggatgttatgtgggagacttttcgtaatctggccaccatcggcaccaagcagaaggaatggaatatagaggagcagtacaaaaatcaggggaggaatctccgcaaccacatggtcgagcgcctttgcgaatctaaagaggggtcacacgggggcgaaggttttagccagattgccaatctgtctctgaataaaaaaaccccgtccggagggaaactctgggagtcctccgtttgcgggaaagttctgtcacatcattcatccttgaatcgacacatacggtcctatactaggcacaagctctacaagtgtcaggaatacggcgagaagccctataaatgcaagaaatgcggtaagccattctcttaccttcagagcttcaagaagcacaagcgtacacatagcgcaggtatagtgtacaaatgcaaggcctgcggcaaagcgttctcgtgtcagcgctcatttcagattcacggcagaacacacaccggcgataaaccctttaaatgtaaggaatgtggcaaagcttttcggtatcaccagtctgcacagaagcacgagaaggcccatactggcgagaaaccatataagtgcaaggaatgtggcaagccatttatttaccggcatagcgctcgggcgcacgaacgaaatcacacagtgcagaaaaggtacgagtgcaagcaatgcgggaagacatacatttccagtgtcggattccaggcccatgaacgaacgcataccggggaaaaaccatatgagtgtaaaaagtgcgggaaagtgttcgtgtaccacaattctgctcaaaggcacgaaaagacacacaccggagaaaagccctataagtgcaaggagtgtgggaaagcctttagctaccattgtacggcccagaaacatgagcggaatcacactgcccaaaagcactatgagtgtaagttgtgtggtaagacttatttgtcccccctcgggtttcaagcccatgagtccacgcacactggagataagcctttcgagtgcaaaaaatgtggaaaggctttccgatattactattccgcgcagaggcatgagagaacacatactggagaaaagccctacaaatgcaaagagtgcggaaaggccttctattgttgcagctccgctcggcgtcatgagagaatgcataccgctaagaaacaatatgaatgtaaaaagtgtggcaagacgtatattaccctggcaggatttcagatccatgagagaactcacaccggagaaaaaccctacgaatgcaagcagtgtggcaaggccttctcttcgtccagctacatacatatccatgaaagaattcacacaggcgaaaagccgtatgagtgcaaggagtgtgggaagcctttcagcttcctgaccggctttcgcgtgcacatgagaatgcacacaggggagaaaccgtacaagtgtaaggattgtggcaacgcctttatttggagggccagcttgcaataccatgtgaagaaagtccatgccgagtag

SEQ ID NO: 141456 - DNA, 1848 bp, Artificial Sequence
  Description of Artificial Sequence: Synthetic coding sequence
atggactcagtggccttcgaggacgtggcggtgaatttcacgcacgaggagtgggccctcctcggtcccagccagaagaacttgtacagagatgttatgcgagaaacaatcagaaacctgaactgtatcgggatgaagtgggaaaaccaaaatattgacgatcagcatcagaatctgaggaggaacccaaggtgcgatgttgtggagcgctttggtaaaagcaaggatgggtcgcaatgcggggagacactgtcccagattaggaactctattgtcaacaaaaacacgcctgcgcgggttgatgcatgcggcagctcggttaatggcgaagtgattatggggcactcctctctgaactgctacatccgggtggacactggtcataaacatcgcgagtgtcatgaatatgccgagaaaagctacactcataagcaatgcggaaaggggctatcataccgacatagcttccaaacatgcgaaagaccacacactggaaagaaaccctacgattgtaaggagtgcggaaagacattcagttctcccggaaatctgaggcgccacatggttgtgaaagggggggatgggccttataaatgcgagttgtgcggtaaagcattcttctggcccagtttgcttaggatgcatgagcgaacacacactggtgaaaagccgtacgaatgcaagcagtgctctaaggcctttccagtgtactcctcctatctcagacatgagaaaattcataccggcgagaagccctatgagtgcaaacagtgctcaaaggcttttccagactattctagctacttgcgtcacgagaggacacataccggtgaaaaaccttacaaatgcaagcagtgcggcaaggcattttccgtttccgggagtcttcgggtgcatgaaagaatccacaccggggaaaaaccctacacctgtaaacaatgtggcaaggccttctgtcatctggggtcatttcagcgccacatgatcatgcacagcggagacggtccacataaatgtaaaatttgcgggaagggctttgattttccaggctccgcccggatccatgaaggtactcacacgctcgagaaaccatacgaatgtaaacagtgtggcaaactgttatcacatcgctcctcattccgcagacatatgatggctcatacgggggatggccctcacaaatgtacagtttgtggtaaagccttcgattcccctagtgtgttccaaagacacgagcggactcacacgggagaaaagccctatgagtgtaagcagtgcgggaaagctttccggactagctccagcttaaggaagcatgagacgacccatactggagaacaaccatataaatgtaagtgtgggaaggccttcagcgacttgttctctttccagtctcacgagacaacccactccgaggaagagccctacgagtgtaaagaatgtggcaaagcttttagctctttcaaatacttctgtcgtcatgaaaggactcattccgaagagaaaagctacgaatgtcaaatttgcggcaaggcgttttcccggttctcgtacctgaaaactcatgagcgaacacacaccgccgaaaaaccttacgagtgcaagcagtgtagaaaagcctttttctggccttcgtttttgctcaggcacgaaaggactcacacaggagaaaggccatacgagtgtaaacactgcgggaaagccttcagccggtcttctttctgccgggagcacgagcgcacccatacgggcgaaaagccctacgaatgcaaagaatgtgggaaggccttcagctcactctcgtccttcaatagacataagcgcacacactggaaggacatactgtag

SEQ ID NO: 141457 - DNA, 984 bp, Artificial Sequence
  Description of Artificial Sequence: Synthetic coding sequence
atggaagtggcggtccctgtgaaacaggaagcggagggtctagctcttgatagcccctggcacaggtttcgcaggttccacctgggcgatgctcctggccctcgcgaagctctcggcctcctgagggctttgtgcagggactggctacggccagaagtccataccaaagaacagatgctcgagttgctcgtactcgagcaatttctttctgcgctacccgccgacactcaggcttgggtttgttctagacagcctcagagcggggaggaggctgtggcgctgctggaggagctctgggggccagcagcctcccccgacgggagctctgctacccgagtgccccaagatgttacgcaggggcctggcgctactggaggaaaagaagactcaggaatgatcccgctggccggcaccgcaccaggagccgaaggcccggcaccgggggactcacaagccgtgaggccatataaacaggagccgagcagccccccactggcccctggcctgcccgctttcctcgcagccccgggcacgacctcttgcccggaatgcggcaaaaccagtctcaaacccgcccatttgctgagacacaggcaaagccacagcggggagaaaccgcacgcatgtcccgagtgcgggaaggccttccgccgcaaggagcatctgagaaggcatcgcgacacccaccccgggagcccaggaagtccagggcctgccctgcggcctctcccggcaagagagaagccacacgcttgctgtgaatgcggtaaaacattctattggcgggaacatctggtacgacaccgaaagacccatagcggcgcgagacccttcgcttgctgggagtgtggaaagggtttcggcagacgggagcacgtcctgcgtcaccagaggattcacgggcgggccgccgctagcgctcagggagcagtggcaccagggcccgacggcggcggtccatttcctccctggccacttggatag

SEQ ID NO: 141458 - DNA, 1557 bp, Artificial Sequence
  Description of Artificial Sequence: Synthetic coding sequence
atggctgtggctctggggtgcgctattcaggctagcctcaaccaaggcagcgtttttcaggagtacgacactgattgcgaagtctttcgacagcgcttcagacaatttcagtacagagaggcagcaggcccccatgaggccttcaacaagctgtgggagctatgttgccagtggcttaagcccaagatgaggagcaaagaacaaatcctggagctacttgttctcgagcagtttctgacaattttgcccacagagatcgagacgtgggtgcgcgagcactgtccagagaacagggaacgagtggtcagcctgattgaagaccttcagagggagttagaaataccggagcagcaggtggatatgcatgatatgttgctcgaggaactagccccagtaggcaccgcccacattcctcccactatgcacctcgaatctccagccctgcaggtgatgggccccgcacaggaggcccctgtcgcagaggcctggattccccaggcaggaccaccagagctcaactatggcgccacaggtgagtgtcagaatttccttgacccaggatatccattacccaagcttgacatgaatttcagccttgaaaacagagaagagccctgggtgaaagagcttcaggatagcaaggagatgaaacagttgctcgacagcaaaatcggttttgagatcggtatcgagaatgaggaagataccagtaaacaaaagaaaatggaaaccatgtaccctttcattgtgacgctggaaggtaatgcattacagggcccaatcctccagaaagactatgtgcagctagagaaccaatgggagacacccccagaggacctgcagacggatttagccaagttagttgatcagcaaaacccgacactcggggagacccccgagaactctaatctagaggaacccttgaaccctaagcctcataagaaaaaatcccccggtgagaagccacaccggtgcccacagtgcggaaagtgctttgccaggaagagtcagcttactgggcatcagagaattcattccggtgaagaaccacacaaatgcccagaatgcggcaagcggttcctgaggagcagcgacctgtatcgacaccaacgactgcacaccggggagagaccatatgagtgcactgtatgcaagaagcgtttcaccagacgctcccatctcattgggcaccagcgcactcattccgaagaagagacatataaatgtcttgagtgtggtaagagcttttgccacggatcaagcttgaaaagacacctcaagacccacactggagaaaaacctcatcggtgccacaattgcggcaagtccttttcacgcctgacagccctgacgctgcaccagcggacccataccgaggaacggccattcaaatgcaattactgtgggaagtcctttaggcaacggccgtccctggtgatccacctacgcattcacaccggagagaaaccgtacaagtgcacacactgcagcaaatccttccggcagcgagcgggccttatcatgcatcaggtcacacatttcagaggcctgatttag

SEQ ID NO: 141459 - DNA, 384 bp, Artificial Sequence
  Description of Artificial Sequence: Synthetic coding sequence
atggccgtcgctctaggctgtgccattcaggcttcgctaaaccagggcagcgtgttccaggaatatgacactgattgtgaggtatttcggcagcgtttccgccagtttcagtacagagaagcagcaggtccccatgaagccttcaataaactgtgggaactgtgctgtcaatggctcaaacccaagatgcggtcgaaggagcaaatccttgagttgctggtgctagagcagtttctgacaatcctgccaactgagattgaaacttgggtgagggagcactgtcccgagaacagagaaagagtggtgtcgctgatcgaggatcttcaaagggagctggaaattccggagcagcaaacctttgccgccgaatacagccattactag

SEQ ID NO: 141460 - DNA, 495 bp, Artificial Sequence
  Description of Artificial Sequence: Synthetic coding sequence
atggctgtggctctagggtgtgccatccaagcatcactgaatcaaggcagtgttttccaagagtacgataccgactgtgaggtttttaggcagagattcagacagtttcagtaccgagaggcagccggtccccatgaagccttcaacaagctgtgggagctttgttgtcagtggctgaaaccaaaaatgaggagcaaggagcagatcttggaactgctcgtgctcgagcagtttctcactattcttcccactgagattgagacctgggtcagagagcattgtccagaaaatcgagagcgggtggtgagtctgatagaggatctgcagcgcgaactcgagattcccgaacagcaggtgaggaaagaatgcggcatctttgttatcgggccaaaagaagtggcagaagctgctggcactaggccacacatctgtctgtatgtaatcccccaaccccaggatttctctcgggtgctgtttttattcctcttctgctag

SEQ ID NO: 141461 - DNA, 2049 bp, Artificial Sequence
  Description of Artificial Sequence: Synthetic coding sequence
atgaccaagagcaaggaagctgtgacgttcaaggatgtggctgttgtcttttctgaagaggaattacaacttctcgatctagctcaacgaaaactgtatagggacgtaatgctggagaactttcggaacgtagttagcgtggggcatcagagcacaccagacggactgcctcagctcgagagggaagagaagctgtggatgatgaagatggcgacacaacgcgataacagctctggggccaaaaatctcaaagaaatggagactctccaggaggtcggtctgcgctacttgccccacgaggaacttttttgttcacagatttggcagcagattacccgagagcttattaagtaccaggacagtgtcgtgaatatccagcgaactggctgtcagctagaaaagagagacgatctccattataaggacgaaggtttctccaatcagtccagtcacctccaggtgcaccgcgttcacacgggggagaaaccctataagggggagcattgcgtcaaaagtttttcctggagctcacatctgcagattaatcaacgggcgcacgccggagagaagccgtacaagtgtgaaaagtgcgataacgcattcagacgattctcatctctccaggcccaccagagagtccacagccgggctaagtcttacacaaacgatgcgtcctacagaagtttcagccagagatcccatttaccccaccatcaaagggttcctactggggaaaatccgtacaaatacgaagaatgcgggcgcaacgtgggcaaaagcagccactgtcaggcacccctcattgtccatacaggggaaaagccgtacaaatgcgaggaatgtggagtaggatttagtcaacgaagctacctgcaggttcatctgaaggtccacaccgggaagaagccctataagtgtgaggagtgtggaaagagcttctcatggagatccaggctgcaggcacatgagaggatccataccggcgagaagccctataagtgtaacgcttgtggcaagagttttagttactcctcacatctgaatatccactgccgcatccatacaggagagaaaccttacaaatgcgaagagtgtggcaagggattctctgtgggctctcatttgcaggcacatcagatatcgcacacgggcgaaaaaccgtataagtgcgaggagtgcgggaaaggtttctgccgggccagcaacctcttagaccaccagagagggcacacaggcgagaaaccttaccagtgtgacgcctgcgggaaaggttttagcaggagtagcgattttaatattcactttcgcgttcacacgggggagaagccctataagtgcgaagaatgtggtaagggattctcccaggccagcaatctgctggcgcatcaacgtggtcacacgggcgagaaaccttataagtgcggcacatgcgggaaagggttcagcaggtctagcgatctgaatgtccattgccgcatccacacaggagagaaaccatataagtgcgaaaggtgtggaaaggccttctcacagttttctagcttgcaggtgcaccagcgggtgcacaccggtgaaaagccatatcagtgcgcggaatgtggcaaaggattctccgtgggaagccagttgcaggcacaccaaagatgccataccggcgagaaaccatatcagtgtgaggagtgcgggaagggattctgtagagcatcaaactttctggcccaccgcggagtgcatacgggagaaaagccctatagatgtgacgtgtgcggcaaaaggttccgccagaggtcttatctgcaggcccaccagcgcgtgcatacaggggagagaccatacaaatgcgaggagtgtgggaaagtattctcctggagctcttacttgcaggcacaccagcgcgttcacaccggggaaaaaccctacaagtgcgaagagtgtggtaaaggctttagctggtcatctagcttaatcattcaccaacgcgttcatgcagatgacgaaggcgataaggatttccccagctccgaggactcacatcgaaagaccaggtag

SEQ ID NO: 141462 - DNA, 1617 bp, Artificial Sequence
  Description of Artificial Sequence: Synthetic coding sequence
atgaccaagtcaaaggaggcagtgactttcaaggacgtggccgtggtttttagtgaagaagagctgcagctcctagacctcgctcaaagaaaactttatcgcgacgtcatgctggagaatttcaggaacgtggtctcagttggtcaccaatcaacacccgacggtctgcctcagttggaaagggaggagaagctgtggatgatgaaaatggcaactcagcgagacaacagttcaggagctaaaaatctgaaggagatggaaaccctgcaggaggttggcttgcggtatcttccccacgaggaactcttttgttcccagatctggcagcagataactagagaactgattaagtaccaagactccgtggttaatattcagcggacggggtgccaattagaaaaaagggatgatctgcactataaggatgaggggtttagcaaccagagctcacacttgcaggtacatcgcgtgcacacaggcgagaagccttataaaggcgaacactgtgtgaaaagttttagctggagctctcacctgcagattaaccagagggctcatgctggggagaagccctacaagtgtgaaaagtgcgacaatgcttttcggcggttcagcagcctccaggctcaccaaagggttcactccagggctaaaagttacacaaacgatgccagttataggtccttttcccagagatcacatctgcctcaccatcagcgcgtgcccactggtgaaaatccctacaagtatgaagagtgtggtcgcaacgtaggaaagtcttcgcactgtcaggcaccattgatcgtgcatactggggagaaaccctataagtgtgaggagtgcggggtcggcttctcccagaggtcctacttgcaggtgcacctgaaagtccacacaggtaaaaagccttacaagtgcgaggagtgcgggaagagcttctcatggaggagtcgcctccaggcccacgaaaggatccacaccggtgagaagccatataaatgtaacgcatgcggcaagtccttttcctatagctcacatctcaacattcactgccgcatacacactggggaaaagccttacaagtgtgaagagtgcggaaagggcttctccgtggggtcccatttacaggcacaccaaatttcccataccggagagaagccctataaatgtgaggaatgtgggaagggtttctgtagagcttcaaacctgttggaccatcagcgcgggcacactggcgaaaagccttaccagtgcgatgcctgcggcaagggcttttctcgctcttctgacttcaatatacactttcgggtgcatacaggaaaaaaccccatcaacgtaaggagcgtggcccgggccagcgcccgtcctcagattttttggcctatcaaggaggccacactagaaaggaatcccaccaatgtggtccatgtcgggcgggctagtgtgggagctcagattcttatgtataccgtggaaagcacgcaggaacggaaccctataaacgcaaggggggtggtcaggccgtcagtgtccagccccgcgtttcggtgcatccgcgaatttacactggagaggaatcacattagcgtacagagtgtgggtagggcctcagtatag

SEQ ID NO: 141463 - DNA, 1689 bp, Artificial Sequence
  Description of Artificial Sequence: Synthetic coding sequence
atggccgccgcgtggatggctccagctcaagagtccgtcacgtttgaggatgtggccgtcacattcacccaagaagaatggggccaactcgatgtcacacaaagggccctgtatgtagaggtgatgcttgagacatgcgggctgcttgtagcacttggggattccaccaagcctgagactgtagagccaattccatcacatttagcattgcccgaggaagtgtccttacaggagcagcttgcccagggggtccctcgctacagctatctcgggcaagccatggatcaggacggacccagtgaaatgcaggagtattttttgcgccccggaactgatccccaatctgagaagcttcacggtaaaatgtcattagagcatgagggactcgcaaccgcagacggcatctgctctatgatgatccagaaccaggtgtctcctgaggacgcactctacggctttgactcgtacggccctgttaccgattcacttatccacgagggcgaaaatagctacaaattcgaagagatgttcaatgagaattgcttcttagtgcaacacgagcagattctgccccgggttaagccctatgattgtccagagtgtggcaaagccttcggcaaaagtaagcacctgctgcagcaccacatcattcacaccggagagaaaccatataaatgtctcgaatgtggcaaggactttaataggagaagtcacttaaccaggcatcagaggacacacaatggagataaaccgtttgtgtgctccgagtgcggacgaacatttaatagaggctctcacttgacaaggcaccagcgcgtccactccggtgaaaaacccttcgtgtgtaacgagtgcgggaaagccttcacttatcgctctaatttcgtgctgcataataaaagccacaacgaaaagaagcctttcgcgtgctctgaatgcggcaagggtttttatgaaagcaccgcgctgatacaacatttcatcatccacactggcgagaggcctttcaagtgcctggaatgtggaaaagctttcaactgccgatctcacctcaaacagcacgagagaatccatacgggggagaagccattcgtgtgcagccagtgcggaaaagccttcactcactactcaacttatgtactacatgagcgcgctcataccggcgagaagcccttcgaatgtaaggaatgtggaaaggcgttttccatcagaaaggatctgatacggcacttcaacatccacacaggcgaaaaaccgtatgagtgcttgcagtgcgggaaagccttcacgaggatgtccggcctcactagacaccagtggatccatactggggaaaagccttatgtgtgcatacagtgtggcaaggccttttgtcggacaaccaatcttattcgccatttctcgatccataccggcgaaaagccatacgaatgcgtggagtgtggcaaagcttttaatcggagatcccctttgacacgccatcaacgaatccataccgcggagaagagccacgagccgatccaatccgggaacgtcagctgcgagtcaaccgacctgattcagcactctattatccacactgaaagctcacccgtctctgcggttaatatggagacaccctccattgccgctcatagcagttcgctggatataaacggcttcatcgtggaggagaccctccctctttag

SEQ ID NO: 141464 - DNA, 1566 bp, Artificial Sequence
  Description of Artificial Sequence: Synthetic coding sequence
atgcttgagacctgtggccttctggttgcactgggggacagtacaaaacctgagacggtagagccaataccttcccacctggctctgcctgaggaggtgagcctgcaggagcaattggcacaaggggtgccacggtattcatacctaggacaggccatggaccaggacggaccatcagaaatgcaggaatatttcctgcggcccgggacagatcctcaatccgagaagttgcatggcaagatgtcactagaacacgaggggcttgccactgccgatggcatctgtagcatgatgattcagaaccaggtgagcccagaggacgctctttacggctttgattcatacgggcctgtaacggactccctgatccatgaaggggaaaacagctataaattcgaggagatgttcaacgaaaactgcttccttgttcagcatgagcagattttacctcgcgtgaaaccttatgactgccccgagtgtggcaaagcttttggcaaaagtaaacacctcctgcagcatcacattattcataccggcgaaaaaccttataagtgtctggaatgtgggaaagattttaaccgcaggagccatctcacacggcaccagcggacacataacggcgacaaaccttttgtctgctccgaatgcggcagaaccttcaatagaggctcacatctcactaggcaccaaagggttcactccggagagaagccattcgtatgtaacgaatgcggaaaggcctttacttaccgttcaaatttcgtcttgcacaacaagtcacacaatgagaaaaagccctttgcctgtagcgaatgtggtaagggattctacgaatccacagccttaattcagcactttattatccataccggggagcggccattcaagtgcctggagtgtggaaaggccttcaattgcaggtcccatttgaagcagcacgagcggattcatacgggcgaaaaaccttttgtttgctcacagtgtgggaaggcattcactcattatagtacctatgtgctccatgagagagcccatacaggagaaaagccattcgaatgcaaggagtgcggcaaggccttctctatccgaaaagatcttattaggcattttaacatccacaccggggagaaaccctacgagtgtctgcagtgcgggaaagcttttacacgcatgtctgggctgaccaggcatcagtggattcacacgggcgagaaaccttatgtgtgcatccagtgcgggaaagcattctgtcgtactacaaatttgattcgtcattttagcatccatactggcgaaaaaccctacgaatgcgttgagtgtggtaaagcctttaacaggcggagcccactgacccgtcaccagaggattcacacagcggagaagtctcacgaaccaattcagtctggcaacgtctcctgcgagagtacagatctcatccaacactcaatcatccacacagagagcagccctgtgagcgccgttaatatggagactccgtctatagctgcacacagttcctctcttgatattaacggatttattgtggaagagactctcccgctgtag

SEQ ID NO: 141465 - DNA, 1623 bp, Artificial Sequence
  Description of Artificial Sequence: Synthetic coding sequence
atggcacatgagctggtgatgtttagggacgtggcgattgacgtctctcaagaggagtgggagtgccttaaccctgcccagcggaatctctacaaagaggttatgttggaaaactacagcaacctggtaagcctgggactttcagtctccaagcccgctgttatctctagtcttgagcaagggaaagagccatggatggtggttcgagaagagactgggcggtggtgtccagacttggcctcaagggacgagcctcagaagctctctcccaagcgggacatttatgagaccgagctcagccagtgggtaaatatggaagagtttaaatcacacagtcctgagaggtccatattcagcgccatttgggaaggcaattgtcacttcgagcagcatcagggccaagaagaaggctacttccgtcaactgatgattaaccacgagaatatgcctatcttctcccagcacacactgctcacgcaggaattttacgacagggagaagatatccgagtgtaaaaagtgccggaagatcttctcttatcacctcttcttttcgcaccacaagcggacccattccaaggagctcagtgaatgcaaagagtgtaccgaaattgtgaacacgccttgtctgttcaaacagcaaaccattcaaaacggcgataagtgtaatgagtgtaaggaatgttggaaggctttcgtccattgttctcaattgaagcacttgagaattcataatggagaaaaacgatacgagtgcaatgagtgcggtaaggcctttaattacggaagtgagctgaccctgcatcaacgcatacacacgggagaaaaaccatatgagtgcaaggaatgtgggaaggccttccggcaacgctcacagttgacacagcatcagcgcctccataccggggagaagccctacgaatgcaaacagtgcggtaaggcttttatccgagggtttcagctgacagagcacctcagattgcatactggcgagaagccctacgagtgtaaggagtgcggtaagacctttcggcaccggagccacctaaccattcatcagagaatccataccggagagaagccctacgagtgccgcgagtgtggtaaggccttttcctaccatagttcgtttagccatcatcagaaaatccattcggggaagaagccttatgaatgtcatgagtgcgggaaggcattttgtgatggactgcagcttaccttacatcagagaatccatacgggagagaaaccatatgagtgcaaggaatgcggaaaaacttttcgacagtgctctcatctaaaacgacaccagcggatccataccggtgagaagcctcatgagtgtatgatttgcggtaaggctttccgattacactctcacctcatccagcatcagcgcatccacacgggcgagaaaccatacgaatgcaaggagtgcgggaaagccttttcctaccactcctctttcagtcaccatcagcggattcactcgggcaagaaaccctatcaatgtggaaaagcttttaaccaccggttacagttgaatctgcatcagactctgcacacaggagagaagcctgttcggttcccgttactgccaccacacccttccttggccagctag

SEQ ID NO: 141466 - DNA, 741 bp, Artificial Sequence
  Description of Artificial Sequence: Synthetic coding sequence
atggtcgtacgggaagaaaccggtcgatggtgccctggaacttggaagacatggggcttccacaacaactttctcgacaataatgaagccacagatatcaacgcagatctggcctcacgggatgaaccacaaaaactatcaccgaagagagatatttatgaaacagagctgagccagtgggtcaatatggaggaatttaaatcgcatagccccgaaaggtcgatctttagtgccatctgggagggcaactgccactttgaacaacaccagggccaggaagaggggtactttcgtcagcttatgatcaaccacgaaaacatgcccattttttcccagcatacattgctcacccaggagttctacgatagggagaaaatcagcgaatgcaagaagtgtaggaagattttctcatatcacctgttcttttctcaccacaagtgttcccaccttaaaaggcatcagcgaatccatacgggcgagaaaccccacgagtgcatgatttgtggaaaggcctttagacttcattcccacctcatccagcatcagagaatccatacaggggagaagccatatgagtgtaaagaatgtgggaaagccttttcatatcattcatcattctcacaccaccagaggattcactccgggaaaaagccttaccagtgtggaaaggcttttaaccatcgtcttcagctaaacttgcaccaaaccctgcatacgggcgagaaaccagttaggttttag

SEQ ID NO: 141467 - DNA, 1692 bp, Artificial Sequence
  Description of Artificial Sequence: Synthetic coding sequence
atggcccatgaacttgtgatgtttagggacgtcgccattgatgtctctcaggaagaatgggaatgtttaaatccggctcagagaaatttgtacaaggaggtgatgctcgaaaactactcaaatttggttagtctcgggctgtcagtcagcaagccagccgtaatttcatcactggagcagggcaaggaaccttggatggtggtaagagaggaaacggggcgctggtgccccggaacctggaaaacatgggggttccataacaatttcctggacaataacgaagcgacagatattaatgcggatctagctagccgggatgagccccagaagcttagtcctaagagggacatttacgagaccgagctttctcaatgggtgaacatggaagagtttaaaagccactcaccagagcgaagcatcttcagcgccatctgggagggaaactgtcacttcgagcagcatcagggacaggaggagggatattttcggcagctgatgattaatcacgagaatatgcctatcttctctcagcacacgttactgacccaggaattttatgaccgggagaagatcagcgaatgcaaaaagtgtcgtaaaatctttagctaccacctgtttttctctcatcataagcgcactcactctaaggagttaagcgaatgtaaagagtgtaccgaaatagtgaacacaccttgccttttcaaacagcagaccatacagaatggagataagtgcaacgagtgcaaagaatgctggaaggcttttgtacactgttcccagcttaaacatctaagaatccacaatggtgaaaaacgatacgaatgcaatgaatgcgggaaggcatttaactacggatccgaacttaccctgcaccaaagaatccacaccggggagaagccttatgagtgtaaggaatgtggtaaagctttccggcaacggtcccagctgacacagcatcagagacttcatacaggcgaaaaaccgtatgaatgcaaacaatgcggcaaagcgtttatccggggcttccagctgacggaacatctccgcctgcacacaggagagaaaccctatgaatgcaaggagtgcggaaagacatttcggcatagatctcatctcacaatccaccagagaattcacacaggagagaaaccttatgaatgtcgggagtgtggcaaggcctttagctaccactccagcttcagtcatcatcaaaaaatccatagcggtaaaaagccctatgagtgtcacgaatgtggtaaggccttttgcgatggtcttcaactaaccctccaccaacgcatccacactggtgaaaagccctatgagtgtaaggaatgcggcaagacatttagacagtgcagtcatttgaagcgccaccagcgaatacatacaggagagaagccacatgagtgtatgatctgtggcaaggcgttccggctgcattctcatctgattcagcatcaacggattcatactggggagaaaccatatgaatgtaaggagtgtggcaaagctttcagctatcattcttctttctcccaccaccaaaggattcatagcggcaaaaagccctaccagtgtggcaaggcgttcaaccacaggctccagttgaacctccaccaaacgctgcatactggggaaaagccagttcggttccccctgttgcctccacatccgtcactcgcctcatag

SEQ ID NO: 141468 - DNA, 777 bp, Artificial Sequence
  Description of Artificial Sequence: Synthetic coding sequence
gaaaagaggtacgagtgcaacgagtgcgggaaggcatttaactatgggtccgagctgacattacatcaacggattcatactggggaaaagccatatgaatgtaaggagtgcggaaaggcattccgtcagcgcagccagctaacccagcaccagcgtctgcacactggcgaaaagccatacgaatgtaaacagtgcggaaaggcgttcattagaggttttcagctgacggagcacctgcgcctacacaccggcgagaaaccttatgaatgcaaggaatgcggcaaaacattccgccaccggtcacacctgacaatacatcagcgcatccacacaggggagaaaccatatgagtgtcgagagtgtggaaaagctttcagctatcactctagcttcagccaccaccagaaaattcactctgggaaaaagccatacgagtgtcatgaatgtggcaaagccttttgcgatggccttcagctgaccctccaccagagaattcacactggggaaaaaccatacgaatgtaaagagtgcggtaagacattccgtcaatgctcacatctgaaaagacatcagaggattcacaccggggaaaagccccatgaatgcatgatctgtggtaaggccttccggctccactctcaccttatccaacatcagcgtatccataccggtgaaaaaccctacgaatgcaaagaatgcggaaaggctttttcttatcacagcagcttctctcatcaccagcggattcactccgacgccaccactgctatttcctag

SEQ ID NO: 141469 - DNA, 1311 bp, Artificial Sequence
  Description of Artificial Sequence: Synthetic coding sequence
atggaagagttcaaaagccattccccagagcggtccatcttctccgccatctgggaaggcaactgtcactttgagcagcatcagggccaggaggaaggatacttcaggcagctgatgataaaccatgagaatatgccgattttctctcagcatacactgctgactcaggaattctatgaccgcgagaagatcagtgaatgcaagaaatgtcggaaaatcttctcttaccatttattcttttctcaccataaacgcacccattccaaagaactgagtgagtgcaaggaatgtacagaaattgttaacaccccatgcttattcaaacagcagactattcaaaacggagataagtgcaacgagtgcaaggagtgctggaaagccttcgtccactgttcccagctgaagcacctccggatccacaatggcgaaaagagatatgagtgtaatgagtgcgggaaggcatttaactatggatccgagctaacactgcaccaacgcatccacactggagagaaaccttatgagtgcaaggaatgcggcaaagcattccggcagcgctctcaacttacccagcaccagaggcttcacactggagagaaaccctatgaatgcaaacagtgcggtaaggccttcattaggggatttcagctcacagagcatctgaggttacacacaggagagaagccctacgagtgcaaggagtgcggaaaaacttttcggcacagatctcacctgaccatccaccagcggatccataccggcgaaaaaccgtacgaatgccgggaatgtggcaaggctttcagttaccatagctccttttcccatcaccaaaagattcacagcggcaaaaaaccttacgagtgtcacgaatgcggaaaagctttttgtgacggcctccaacttactctgcatcaacggatccacacaggggagaagccttacgagtgcaaagaatgtggcaagaccttccgccagtgcagccatttgaagcggcaccaaagaatccatacgggggaaaaacctcacgaatgcatgatttgcggcaaggctttcagactccattctcacttaatccagcaccagcgtattcacacgggtgaaaaaccctacgaatgcaaagagtgtggcaaagccttctcctaccacagtagctttagtcatcatcagaggattcattctggtaagaagccttatcaatgtggaaaagcctttaaccaccggctgcagcttaacctccatcagaccctacacactggtgaaaagcctgtgcgattcccactactgcctcctcaccccagccttgccagctag

SEQ ID NO: 141470 - DNA, 1692 bp, Artificial Sequence
  Description of Artificial Sequence: Synthetic coding sequence
atggctcacgagctggtgatgtttcgcgatgtggccattgacgtttcacaggaggagtgggagtgtctcaatccggcccagaggaatttatataaagaggtaatgctggaaaattactctaacctagtatccctgggactgtccgtaagtaaaccagccgtgatctcttcgttagagcagggcaaagagccatggatggtcgtgcgggaggagacggggaggtggtgccccgggacatggaagacttggggattccataataacttcctggataataacgaggcgacggacatcaatgcagacctggcttcacgggacgagccccagaagctctcaccaaaaagggatatttacgagacagaactgtcccaatgggtgaacatggaagaatttaagtcacactcaccagaacgctcaatcttttccgcaatctgggaaggcaactgccattttgagcagcaccaaggacaggaggaaggatattttcgccagttgatgatcaatcacgagaacatgcctatcttcagccagcacaccttgctgacccaggagttctatgacagggagaagatttcggagtgcaaaaaatgcagaaagatattctcttaccatctgtttttctctcatcataagcgaacccactccaaagagctgagcgaatgtaaggagtgtaccgagatcgttaacaccccatgtctgtttaaacagcaaaccattcagaacggagataaatgtaatgagtgcaaggaatgttggaaggccttcgtacactgctcgcaattgaagcatttacggattcacaatggcgaaaagaggtacgagtgcaatgagtgcggcaaggcctttaattatggctccgaactgacgctgcaccagcgtattcacaccggtgagaagccctacgagtgtaaggagtgcgggaaggccttcaggcagcggtcacagctgacccagcatcagagactacacactggggagaagccatacgagtgcaaacagtgcggcaaagcttttatccgggggttccagctaaccgaacacctgcggctgcacactggcgagaaaccctacgagtgcaaagagtgtggaaaaacctttaggcatcgatcacatctgacaattcaccagcggatccacaccggagaaaaaccctacgagtgtagggaatgcgggaaggcattctcataccatagctccttctcacaccaccagaaaatccacagcggtaagaagccgtatgagtgtcatgaatgtggcaaagccttctgcgatgggctacagttgactcttcatcagaggattcataccggcgagaaaccctacgagtgtaaagagtgtgggaagacttttcgccagtgctcccacctgaagcgacaccagaggatccacacaggcgagaagccacatgaatgtatgatatgtggcaaggcattcagactacacagccacctaatccagcatcaacggatccacactggcgaaaagccctatgaatgtaaagaatgcggtaaggcgttctcgtatcacagcagcttttcccatcaccagagaatccattcaggtaaaaagccctatcaatgtggtaaggccttcaatcatcgcctgcaattaaatttgcatcagacccttcacaccggagagaagccagtgcgattcccccttttgccacctcacccgtcattggcatcttag

SEQ ID NO: 141471 - DNA, 1788 bp, Artificial Sequence
  Description of Artificial Sequence: Synthetic coding sequence
atgcgggagacactggaagccttaagtagcctgggctttagtgtaggtcaacccgagatggctccacagtctgaaccccgagaaggttcccacaatgctcaggagcaaatgagcagctctcgcgaagagagggcccttggcgtctgctcaggacacgaggccccaacgccagaagagggcgcacataccgagcaagcagaagctccgtgcagaggccaggcctgctctgcccagaaagctcaacctgtgggcacctgtccaggagaggaatggatgattcgcaaagtgaaagttgaagacgaggaccaagaagctgaggaggaagtggagtggccccaacatctgtcactcttaccctcgccttttcccgcccctgatctgggccatttagcagcagcttataagctggagccaggggcccctggggcactgtccggactagctctctcaggctggggcccaatgcctgagaagccctatggatgtggcgagtgcgagagacggttccgtgaccagcttaccctgagactgcaccagaggttgcaccgcggggagggtccctgtgcatgcccagactgcggcagatcattcacccagagagctcacatgctgctacatcagcggtcccataggggtgagcggccgttcccgtgcagcgaatgcgacaaacgatttagcaaaaaggcacacctgacacggcacctgagaactcacacaggagagagaccctacccgtgtgcagagtgcggcaagcgattttcccaaaagattcatctgggctcgcaccagaagacccatacaggagagcgaccttttccatgcacagaatgtgagaagcggtttcgcaagaagactcatctcattaggcatcagcgtatacacactggtgaacgcccataccaatgtgcgcagtgcgctcgctcttttacacataagcagcacttggtgcgtcaccaacgagtccatcagactgccggacctgcccgacctagcccagatagctccgcatctccacacagcacagctccctcgcccacgccttcctttcccggtcctaagccgttcgcctgctccgattgcgggctgtcattcggttggaaaaagaacctagctacgcatcaatgtttgcatcgcagcgaaggaaggcccttcggctgtgacgaatgcgcactcggcgctacagtggacgcccccgcagctaagcccttggcaagcgccccgggcggccctggatgtggtccgggttccgaccctgtcgttcctcagagagccccctccggtgagagatcattcttttgcccggactgcggaagaggtttctcccacgggcaacatctagctcggcatccacgcgtgcataccggggaaagacctttcgcctgcacccagtgcgataggaggttcggttcccgcccaaacctggttgctcacagcagggcccacagcggggctaggcctttcgcatgtgcacagtgtggcaggaggttttcacggaagtcccatttaggacgtcaccaggccgtccacactggctcaaggccccatgcctgtgctgtatgcgctcgatcgttttcttccaagactaacctggtcagacatcaggcaattcataccgggtctagaccatttagttgccctcagtgcggaaaaagtttcagtcgcaagacacatctagtaaggcatcaattgattcacggggaggccgcgcacgccgctcctgacgctgcactggccgcgccggcatggtcagcgccccctgaagtggcaccccctccactgtttttctag

SEQ ID NO: 141472 - DNA, 11778 bp, Artificial Sequence
  Description of Artificial Sequence: Synthetic coding sequence
atgccgggcgagagaccaagaggggcgccacctcccaccatgactggggacctacagccgcgacaggtggcaagctcacctggacaccctagccagcctccactggaagacaatacgcccgctacacgcaccacaaaaggtgcccgggaagctggtggccaagcacaagccatggaactcccagaagcccagcctagacaggctagggacggcgagctgaagcccccttctctgcgcggtcaagcaccatcttctacacctggaaaacggggttcccctcaaaccccccccggccggagtccactgcaagcgccttctcggctcgccggtcgggcagaaggatcgccccctcagcggtatatccttgggatcgcaagctcccgaaccaagcctaccttagacgaaacacctgagaatccccagctggaagcagcccaacttcctgaggtagacaccccacagggacctgggaccggagctccactgcggcctgggttgccaaggacggaagcccagcctgccgctgaggagctgggattccataggtgcttccaggaaccaccctctagtttcacctccacaaattatacgagcccaagtgctactcctcgcccacctgcaccaggtccaccccagagcagggggacctctcccctgcagccagggtcttaccctgaataccaggcctcgggtgccgacagctggccgcccgctgccgagaactcgtttccgggagcgaactttggcgtgccacccgccgagccagaaccaatccccaagggctcccgccctggaggatcacccagaggcgtgagcttccagtttcccttccccgcactccacggggcaagcacaaagccttttccggccgacgtggccggccacgcatttacgaatggtccgctcgtattcgccttccatcaaccacagggcgcctggccagaagaggccgttggaaccggtcccgcctaccccctgccaacacaaccagcaccctcaccccttccatgttatcagggtcagcctgggggcctcaatcgccattccgacctgagcggtgccctaagctcccctggggctgcccatagcgctccaagaccgtttagcgattctctgcataagtcccttaccaagattctcccagagaggcccccctctgcacaggatggcttgggctccacccgcggccctccttccagcctaccccagagacactttcccggccaggcgtacagggcatcgggagttgatacctcccccggacccccagatactgagctcgcggctcccggaccccccccggcccgcctccctcagctttgggaccccacagcggcaccctaccccaccccccctggcggaccactggctgccactcgcagcatgtttttcaatgggcagccaagccctggccagaggctgtgcctcccccagagcgctccactgccgtggccacaggtgttgccgacagcgcgaccctcaccacacggcatggaaatgctcagccggctgcctttcccggccggcggcccagagtggcaggggggctctcaaggagctttgggcacggccggaaagactcctgggccacgtgaaaaactaccagccgtccgaagttctcaaggagggtcgccggccctattcacatacaacgggatgaccgatccgggagcccagccactgttttttggggtcgcccagcctcaggtatcgccccatggcactccaagtctcccccctcctcgggtggttggtgcaagccccagtgagtcccctcttccctctcctgcaaccaataccgctgggagcacatgtagctcattatcccccatgtcctccagccccgccaacccctcctccgaggaaagccaattgccaggaccattggggccaagcgcatttttccacccccctacccaccctcaagaaacgggatccccgttcccgagtcccgagcctcctcactccctgcctactcactaccagccagagcccgctaaagctttcccattccccgccgacgggctcggggctgaaggggcctttcagtgcctcgaggaaaccccgttcccgcacgaagggccagaggttggcaggggcggacttcagggatttccacgtgcacccccaccataccccactcatcacttctctctgagcagcgcctccctcgaccagctggacgtcctgctgacttgccgccagtgcgaccgaaactattctagcctggccgcgttcttggcccatcgtcagttctgtggactattgctagctagagctaaggacggtcatcagagatcccccgggcccccagggctcccctctcctccagcagccccacgggtgcccgcagatgcacacgcagggctgctgagccacgcaaagacttttctcctagccggggacgcccaggcagaaggaaaggatgatcctttgcgcaccggcttcctgccctcacttgcagcgacaccgtttcctctgcctgccagcgacttagacatggaggacgatgcaaagcttgatagcctcatcacggaggccctcaatggtatggaatatcagtcagataaccccgaaattgactcctccttcatcgatgtatttgcagacgaggaaccatccggccctagaggacctagcagcggacatcccctgaaatcaaaggcaggcgtaacaccagagagtaaggcacctcctccgctgccagctgccacgcccgaccctcagacaccacggcctggcgatagaggttgtcctgcaagggggcggccaaaaaccaggtcccttggactggcccctacggaggccgacgctccttcccagggcaggcaacagcgaaggggcaaacaattaaaattatttagaaaggacctcgacagtggtggggcagctgagggatccggttccggtggtggcggccgggcctccggactgcgtccacggcgcaatgatggcctgggcgaacgacccccccctagaccaagacgacctcggacccaggctcccgggtctcgggccgaccccgctccgcgggtgccccgagccgcagctctgcctgaggagacaagatcctcaaggaggcgccggctgccaccaaggaaagatccgcgcaagcgcaaggccagaggcggggcctgggggaaggagctgattctgaaaattgtacagcagaagaaccgtctgcgggaatacgattttgctagtgaatccgaggaagacgaacagcccccacctaggggtccgggctttcgcggaagaagaggcaggggagaaaagagaaaagaagtagagctgacacagggtcctcgggaggatgagccacagaaaccccgcaaagcggctcgtcaggaagcgggaggagacggagcacctgccaatcctgaagagcccggtggcagtaggccaggcccaggaaggtctcctcaagctcgcggtccatcccgatcactcgagaccggggctgccgcgagagagggcggacccaagtgcgctgatagaccttctgtcgcacctaaggatcctctgcaagtccccacgaacacagagacatccgaggaaacccgcccgtcattagacttccctcaggaagccaaggaacctgagacagcagaggagtcggctcccgatagcactgaatttacagaagccctcagaagtcccccggccgcctgtgctggggagatgggggccagccctggcttactgatacctgagcagcctccaccaagccggcacgatactgggacccctaagccctctggctcattggctaatactgctcctcatggaagctctcccactccgggcgtgggtagcctcttgggcggacctggaggcacccaagcaccagtatctcataatagtaaggatccccccgcgcggcagccgggggaatttctggccccagtcgcaaatcctagtagtactgcatgtccaaaacccagcgtactgtcctctaagattagttcctttggttgcgatcccgccggatttaatagggatcctctgggcgtacccgtcgcgaaaaagggcccccagccctactcgtcaccccactcggaattatttctcggcccaaaggatttagccggttgtttcttagaggagctgcatccaaagccgtccgctagggacgccccaccggctagctcctcatgcttatgccaggatggggaagacgcagggagtttggagccacagctgccacgatcaccccctgggacggcagagactgagcccgggcgggccgcgtcaccacctacactggaatcttccagcctgttccccgacctcccggtggacaggtttgacccacctttatacgggagcctttctgctaacagagacagtggcctaccattcgcatgtgccgacccccctcagaaaacggtcccgtctgaccccccctacccctcgtttcttttgctagaggaggtaagtcctatgttgccaagtcactttcccgacctgtcaggaggaaaggtgctgtccaaaacatgtcctcccgaacgcaccgtagtgccgggcgctgcgcccagtcttcccgggaagggttccgggtgcagtgtagctctgatgtcacacctctctgaggatgaattggagatacagaagctcgtcactgaactggaatcccaactgcagagatccaaggatactagaggagctcctcgggaattagccgaggccgaatcagtaggtagggtggaactcggtaccggcacagaacctccctctcaacggcgtacatgccaggccactgttccgcacgaggacacattctctgcggccgacctcaccagagtgggcgagtcaacggcacaccgggagggggccgagagcgctgttgcgacagtcgaggctgtgcagggcagaccgggcggcacctggccctgtccagcctctttccatcccgggcatgccgctcttctgccttgtgcccaggaagacctggtttctggcgccccgttctcgcctcgcggagccaattttcatttccaacctgtgcagaaggcaggcgccagtaaaacagggctgtgccaagcagagggagacagcagacctcctcaggacgtctgcctcccagagccctccaagcaaccaggacctcaactggacgcgggtagcctcgctaaatgtagtcctgatcaagagctgtcgttccctaagaataaggaagccgcctccagtcaggaaagcgaggacagcctgcgcttgctcccctgcgaacagcgcggaggttttctaccagaacccgggacggctgaccagcctcaccgcggggcaccggcgccagaagccttcgggtcaccagcagtgcacttagccccagacctcgctttccagggagacggtgcccccccgctagacgctacctggccttttggcgcatccccctcgcacgccgctcaggggcatagcgcaggccgtgcaggcggacatctgcaccccactgccggaaggcccgggttcgagggtaacgagttcgcacccgcaggagccagcagtctgaccgccccacgggggagggaggcgtggttggtgcctgtgcctagcccggcatgtgtaagcaacactcatcctagcaggaggagtcaggacccagcactgtcaccgcctatccgacagctgcaattgccgggtcccggagtcgcaaagagtaaggacggaattctgggactgcaggagctgaccccggctgcccagtcccccccgcgagtgaacccatcaggattggaagggggcacagtagagggcggcaaggtcgcctgcgggccagcccaaggctctcccgggggtgtacaagtgacgacgcttcctgcagtcgcagggcatcagctcggactagaggctgacggccattgggggctgctgggtcaggcagagaagacccagggacagggcaccgcgaaccaactgcaacctgagaatggcgtgtcaccaggtgggacggataaccatgcctctgtgaatgcatctccaaagaccgctctaacaggaccaactgagggggctgtcctgctcgagaaatgcaagggctctagggctgccatgagcctacaagaggaggctgaacctaccccatctcctccaagtcccaacagagaatccctcgcgctggcgcttactgccgcgcactctcgatcaggctctgaaggaaggacacctgagcgcgctagctcacccggcctgaataagccactcctcgccacaggggacagccctgccccaagcgtcggagaccttgctgcatgcgccccgtctcccacctctgcggctcatatgccgtgctctctcggccctttaccacgagaagacccgctgacctcgcctagcagggcccagggaggccttggcggccaactccccgcttctccaagctgtagggatcctccagggcctcagcagctgttggcatgttccccagcttgggcccccttagaggaagcagacggggtgcaggctacaacagacaccggtgccgaagattctcccgtggccccaccctcactgaccactagcccatgcgatccaaaagaggctctcgcaggatgccttttacagggagaagggagccccctcgaagaccccagctcctggccacccggctctgtgagcgctgtgacctgtacccattctggggacacgccaaaagattccacccttcgcattccagaggattcacggaaagaaaagctgtgggaaagtcctgggcgcgctacatcaccacccctggctggcgccgtaagcccgtccgtcgccgtgcgcgcgacaggtctatcgtccacaccaactggtgatgaagcccaggcaggcaggggtttgcccggtcccgacccacagagcagaggggcaccaccgcacacgaatccagatagaatgccccgcggtcattctagttacagcccttcaaacacggcacgattagggcacagagagggccaggcagtaactgctgtgccaactgagccgcctacactgcaaggtgccggcccggacagccctgcctgcctagagggcgaaatgggtactagctccaaggagcctgaagatccaggaactcccgagacgggcagaagcggtgcaaccaaaatgcctagggtcacttgcccgtctactggactggggttggggcgcacaactgctccctcttcaacagcctcggactttcagtccgattccccccagtcacatagaaatgcttcacaccagacgccccagggcgaccctctcggtccccaggacttaaaacagaggtctagaggttataaaaagaagccagcctccaccgaaaatggccagtggaaagggcaggctccccacggtccggtgacctgtgaggtatgcgcagcaagtttccgttccggaccagggctaagtcgccataaggcaagaaagcacagacctcacccaggtgcgccagccgagcccagtccagctgcactacccgcacagcaacccttggaaccgctggcgcagaaatgccagccgcctagaaaaaaaagccatcgggtgtcaggtaaggaaagacctaatcactcccggggcgacccatcccatgttacccagcccccccccgcacaggggtcaaaggaggtgctgagggcgcccggctcccctcattctcagcagctgcatcccccaagcccaacagaacatgaagtggacgtaaagactcctgcttctaaacctagaccagatcaggcccgggaggacgaactgcatcctaaacaggcagaaaaaagagagggccgccgctggcggcgtgaacccactgtagactcccctagtcattcggagggaaaaagcaataaaaaacgaggcaagctcagggggaggcggttgcgcgaggaaagcatcctgcccgtctccgcagacgtgataagtgatggcaggggatctagaccgtcaccagctatggctagctatgccgcgtcacccagccattgtctgagtgtggagggcgggcctgaggccgacggggaacagcctcctagacttgccactcttggccctggagtgatggagggcgcggcagagacagatcaggaggccctgtgcgctggcgaaaccggggcacagaagccacccggggatcggatgttatgcccaggccgcatggatggtgctgcattgggcgagcagcccaccggacaaaaaggcgcttccgccagaggcttttggggaccaagagagacgaaagcactcggggtctgcaaggagtccggcagcgaacccgcagaggattcttctcgtgcccacagcagaagcgaagagggtgtgtgggaagagaataccccccccctgggtcccctggggttccccgaaacctctagtagtcctgccgactcaacgaccagttcttgcctgcagggtctgcctgataatcccgacactcagggaggggtgcaaggtcccgaagggccaacacccgacgcttcagggagctctgcaaaggatccaccttcactgttcgacgacgaggtttcattctcccagcttttccctcccggtgggaggctgacacgcaagagaaacccccacgtttacggtaagcgctgcgaaaagcctgtgttaccgctgccaactcagccatcattcgaggagggcggagacccaacattaggtcccgcgcggctgcccacggacctctccgacagctccagcttgtgcctgtgtcatgaagacccttgggaggatgaggaccccgccggtcttcctgaatcatttctactggacgggttcttaaatagtcgagttcccggaattgacccttgggcccccggtctgtcactttgggccttggagcccagccgggaggcaggggcggaaaagcttcctagccattgcccagaggacgatagacccgaggccatcccagagttgcacatggttcccgccgcttggcggggtctagaaatgcctgcccctgcggacgacagttcgtctagtctcggagacgtgtctccagagccaccttctctggagagagagaggtgtgatggaggactgcccggcaacactcacctgctgccactccgggccactgacttcgaggtgttgtcgactaagttcgagatgcaagatctctgtttcctgggcccattcgaggatccagtgggattgccgggcccatccttcctcgattttgagggcaccgcgtccagtcagggcccccagtccaggaggacagaagaggcagccggggcggggagggcgcagggacgcggccggccggcgaaggggcgtagggcatcgtacaaatgcaaagtttgcttccagagatttcggagcctgggcgagcttgacttgcataaactggcacacactccagctccccctccaacttgctacatgtgtgtggaaagacgcttcggcagcagagagctactgcggggccacctgcaggaaagacatgcgcaaagcaaggccggaccatgggcttgcggtatgtgtctcaaagaggtggcggatgtctggatgtataacgagcatctgagagagcacgccgtgagatttgcacgccgaggccaggctagacgaagcctgggcgatctacctgggggactcgagggctcatctgccgtagcccacctgttgaacagtattacagaacccgcgcctaagcaccacaggggaaaacgctcagccggaaaagctgcgggatccccaggtgatccctggggtcaagagggcgaggcgaaaaaggattcccccggggaaagagccaaaccaagagccagaagtactccgtccaaccctgacggagctgcaacccccgactctgcctctgcgactgcacttgcagacgcgggatctcccggaccaccgcggaccacgcctagtcctagtccagacccatgggcaggaggtgaacctcttcttcaggcaactcccgttcacgaagcttgtaaagatccttcaagagactgccaccattgcggaaagaggttccctaagcctttcaaactccagcggcatctcgcagtacactcaccacaaagagtgtacctttgccctcgctgcccacgtgtataccctgaacatggagaactactcgctcatctgggcggagctcatggtctgttagagcggcctgagctgcagcacacccccttgtacgcatgcgaactgtgtgccaccgtgatgaggattatcaaaaaaagcttcgcatgcagttcatgcaactacaccttcgctaagaaagagcagtttgaccggcacatgaataaacacctaagagggggtcgccaaccattcgcattcagaggagtacggcgtcctggagcacctggtcagaaagcccgagccttggagggaactctccccagtaagcgccgtcgagtcgccatgcctggcagcgcaccggggcctggtgaggacaggcccccccctcgagggtcatccccaatactgagcgagggcagtctcccagccctgctgcatttatgctctgaagttgctccctctacaaccaagggttggccagagacactagaacggcctgtggaccctgttacgcaccctataagaggatgtgaactaccaagtaaccaccaagagtgccctccccccagcctgagtccgttcccggctgcgctagcagacggtaggggcgactgtgccttggacggagccctggaaagaccagagaacgaagcatcccctggcagccctggcccgctcctgcagcaggctcttcccctcggcgcctccttgccccgcccaggagctagaggacaagatgccgagggcaagcgggcccctctggtgttttcaggcaagagaagggccccaggcgcacgaggtcggtgcgcgcctgatcatttccaggaagaccacctcctgcagaaggagaaagaggtgtcaagcagccacatggtgtctgaaggaggtcccagagggactttccacaaggggtccgccactaagcccgcggggtgtcagagcagcagtaaggatcgctcagctgccagcaccccttccaaggccctgaagttcccggtccatcccaggaaagccgtggggagcctggcccctggcgagctggccagggggaccgagaacggcatgaagccagcaacccctaaggcaaaaccaggcccctcctctcaaggatccggcagtccgcgcccggggactaaaactggcggcggcagtcagccccagccagccagcggtcagcttcagtcagaaaccgctaccacacccgctaagccatcctttccatccaggagcccggcccccgagcgcctgcctgcaagggctcaggctaaatcctgtactaagggtccccgggaggctggggaacaggggccgcatggcagtctcgggcctaaggagaagggtgagtcgtctaccaagcggaaaaaagggcaggttcccggcccagctaggtccgagtctgtcggttcctttggccgcgcccccagcgcaccagacaagccacctcgcacaccgcggaagcaggcgactccttcacgggtccttcccacaaaacctaagcctaacagtcagaacaaaccaaggccccccccctctgagcagaggaaagccgagccgggccatacacagagaaaggaccgactcggaaaagctttcccgcagggccggccattgcttaggccacctaagagagggacggccgttcacggagccgagcctgctgaaccccacactcatcgcaccgccgaggcacagtccgatttattgtcccagctgttcgggcagcgcctgacgggtttcaagatccccctcaaaaaggacgcttctgaatag

SEQ ID NO: 141473 - DNA, 1479 bp, Artificial Sequence
  Description of Artificial Sequence: Synthetic coding sequence
atgctttgtgacgagaaagcccagaagaggaggaagcggaaggcgaaagagtccggaatggctctcccacagggccatctcacttttagagacgtggccattgagttttcccaggccgaatggaaatgtcttgacccagctcagcgtgccttatacaaggacgtgatgctggaaaattacaggaatctcgtgagtcttggctcgtcctatgctctgggcagtaacgccgaagataagcctatcaaaaagcaactcggtgtctcttttcacttacatctgagcgagctggagctgtttcctgacgagagagtcattaacggctgcaatcaggtggagaatttcatcaaccattcctcctcagtatcttgcctgcaggaaatgtcttcctcagtgaaaaccccaatctttaaccgaaatgattttgatgactcctccttcctaccccaggagcaaaaagtgcaccttcgagagaagccatacgaatgtaacgagcatagcaaggtgttccgggtttcgagttcccttaccaagcaccaggttatccacacggtcgagaaaccctacaaatgcaactcttgtggaaaggtgttctctcggaactcacacctggcggagcattgtaggattcacaccggggagaaaccctataagtgtaatgtgtgcggtaaagtgttctcgtataattctaattttgcaagacaccagagaatccatacccgcgagaagccatacgaatgtaatgagtgtggcaaggtgtttagtaacaattcctatctggcgcgacaccagcgcatccatgctgaagagaagccatataagtgcaacgagtgcggcaagggtttttctcataagtcctccttagctaaccactggagaatctatacaggagaaaagccatacaaatgtgacgaatgcgggaaagcgttttaccgaatcgctctattagtgcgccaccagaagattcacaccggagaaaaaccttataagtgcaatgaatgcggaaaggtgtttatacagaactctcacctggcgcagcactggagaatccacaccggggagaaaccctacaagtgcaatgagtgcggaaaggtgttcaatcagctcagcaatttggctcgacatcgacggatccataccggcgagaaaccttacaagtgcaatgagtgtggcaaagccttctcagagtatagtggactcagcgctcatttggtgatccatactggggagaagccttacaagtgtagcgagtgtggcaaagctttcaggcataaactgagcctcacaaatcaccagcggatccacactggcgaacgcccatacaaatgcaacgagtgcggaaaagtattcaatcgcatcgcccacctggccaggcatcgaaagattcacaccggtgaaaaaccgtataaatgcaacgaatgcggcaaagcattttcccgcatcagttatctagcgcagcactggacgatccacatgggctag

SEQ ID NO: 141474 - DNA, 1377 bp, Artificial Sequence
  Description of Artificial Sequence: Synthetic coding sequence
atgctggaacagcgccgcgaaccctggtccggggaatctgaagttaagattgctaagaacagcgacgggagggaatgtataaagggcgtcaatactggtagcagctatgcgttagggtctaacgcagaagacaagcccatcaaaaaacagttaggggtctcttttcacttgcacctgagcgagttggaactgttccccgatgagcgcgtcattaacggctgtaatcaagtcgagaattttataaaccattccagcagtgtttcctgtctgcaggaaatgtcatcatccgtcaaaaccccgattttcaatcgcaatgattttgacgactcttcctttttacctcaggagcagaaagtgcatctccgcgaaaagccctatgaatgcaacgagcatagcaaagttttcagggtttccagctctctgaccaaacaccaggtcatacatactgtcgagaagccctataaatgcaattcctgcggaaaggtgttcagccggaacagccacctggccgagcactgccgtatccacacgggggagaaaccttacaaatgtaatgtgtgcgggaaggtattcagctacaattctaatttcgccagacaccagagaatacacactcgggagaagccctacgaatgcaacgaatgcggaaaagtcttctctaacaacagctaccttgctcggcatcagcgtattcatgcggaggaaaagccatataagtgtaatgagtgcggcaaaggtttcagccataagtctagcctagcaaaccactggcggatctacacaggagaaaagccctacaaatgcgacgaatgcggaaaagcgttctacaggatcgccctcttagtgagacaccagaagatccataccggggagaagccatacaagtgcaacgagtgtgggaaggttttcatccagaactctcacctggcccagcattggcgtattcataccggcgaaaagccctataagtgcaatgaatgtggcaaagttttcaaccagctgtctaacctggcccggcaccgaagaattcacaccggagagaaaccctataaatgtaacgagtgtgggaaagccttttcagaatactccgggctctccgcccacctggttatccataccggggagaagccttataagtgctccgagtgtgggaaagccttccgccataagctgagcctcaccaatcaccagagaatccatacaggggaaagaccttataagtgtaacgagtgcggcaaagtattcaatcgaatcgctcacctggcccgccatcgcaagatccatacaggcgagaagccatataagtgcaacgagtgcgggaaggctttcagtagaatatcttacctggctcaacactggacaatccatatggggtag

SEQ ID NO: 141475 - DNA, 537 bp, Artificial Sequence
  Description of Artificial Sequence: Synthetic coding sequence
ttcccccagaccaggaaaagaattgcgtggtcagaggggcacgctgccgcgcggctgacatccaaggagagttgctgcgagaaggcccagaagaggaggaaaagaaaagctaaagagagcggaatggcgttaccacagggacacttaacgttccgggacgttgcaatcgagtttagtcaagccgaatggaaatgcctcgaccccgcacaaagagctctgtacaaagatgtcatgttagagaattacaggaacctagtgtctctcggcattagcttgcctgatttaaatatcaactccatgttggaacagagaagggagccttggagcggtgagagtgaggtaaaaatagccaagaactcagacggtagggaatgtatcaagggagtcaatacaggatcaagctatgcactgggctcaaacgctgaagataaaccaattaaaaaacagctgggcgtcagtttccatctccacctttctgagcttgagctgttcccagacgaacgcgtgattaatgggtgcaaccaggtggagaattag

SEQ ID NO: 141476 - DNA, 1608 bp, Artificial Sequence
  Description of Artificial Sequence: Synthetic coding sequence
atgctgtgcgatgaaaaggcacagaagcgcagaaagcgcaaggccaaggaaagcggtatggctcttcctcaggggcatctgacctttcgggacgtggctatcgagttttctcaggctgaatggaagtgtcttgacccagcacagcgagccctgtataaggacgtcatgctggagaattacaggaacctggtctctctaggaataagtttacctgatcttaacatcaatagtatgcttgagcagagaagagaaccatggtcgggtgagtcagaagtgaaaatcgccaagaacagtgacgggcgagagtgtatcaaaggtgtaaacactggaagctcttacgccctggggtctaatgctgaggataaaccaataaagaagcagttgggggtgtcatttcacctccacctgagtgagctggagctgttccctgatgaacgtgttatcaacggctgtaatcaggtggaaaatttcattaaccatagtagctcagtgtcgtgcctgcaggagatgtctagcagcgtcaagaccccaatcttcaacaggaatgactttgacgactcaagttttctgccccaggagcagaaggtccaccttagggagaaaccctacgaatgtaacgaacactcaaaagtctttcgggttagctcatcgctgacaaagcaccaagttatccatacggttgaaaaaccttataaatgcaactcttgcgggaaagtttttagcagaaatagccatcttgctgagcactgcagaatccatactggagagaagccctataaatgcaacgtgtgcggcaaggtcttctcatacaattcaaactttgcccggcatcaaagaatacatacacgtgaaaagccatacgagtgtaatgagtgtggaaaggttttctccaataatagctatctggcccgtcatcagcgtattcacgccgaggaaaaaccttataaatgcaatgagtgtggaaagggctttagtcataagtcgagcctcgccaatcactggcggatttatacgggtgagaaaccatataagtgtgacgagtgcggaaaggccttctaccgaattgccctgctcgttcggcaccagaagattcacaccggtgagaagccctataaatgtaatgagtgtggtaaagtgtttattcagaacagtcacttggctcaacattggaggatccacacaggcgaaaagccctacaagtgtaacgaatgcggcaaagtgtttaaccagctgagcaacctcgcacgtcacaggcggattcacactggtgagaaaccctataagtgtaacgagtgcggtaaagcgtttagcgagtatagtggattgagtgctcacctggtgatccacacaggtgagaagccctacaaatgctctgagtgtggaaaagcattcaggcataagctttcgctgactaatcaccaacgcattcacactggagagcgcccgtacaagtgtaatgagtgcggcaaggttttcaaccggattgcacaccttgcccgccatagaaagatacatactggcgagaaaccatacaagtgtaatgagtgcggaaaggcttttagccgtatctcctaccttgcgcagcactggactattcatatggggtag

SEQ ID NO: 141477 - DNA, 1608 bp, Artificial Sequence
  Description of Artificial Sequence: Synthetic coding sequence
atgctctgcgatgagaaggcccagaagaggcgaaagcggaaggctaaagagtcaggcatggccctcccacagggacaccttacctttcgagacgtggccatagaattttcacaggccgagtggaagtgcctggacccagcccaaagagctctgtataaagacgtcatgctggagaactaccgcaacctggtctcacttggaatctctctgcccgatttaaatattaatagcatgctggagcagcgccgagaaccatggtctggtgaaagtgaggtgaagatcgccaaaaattctgatggaagggagtgcatcaaaggcgtgaacaccggatcatcttacgcactcgggtctaatgccgaagacaaacccattaaaaaacagctcggcgtgtcattccatcttcatctgagcgagctggagctgtttcctgatgagcgggtgatcaatgggtgcaaccaagtggagaattttattaatcactcgtctagcgtgtcctgtctgcaggagatgagctccagtgtgaagactcccatttttaatcgcaatgatttcgatgacagcagcttccttccccaagagcaaaaagtgcatcttcgggaaaagccttacgaatgcaacgagcactctaaggtcttccgggtctcgtcaagccttaccaagcatcaggtgatacacactgtggaaaagccatacaaatgtaactcatgcgggaaggtattttcccgcaactcacatctggccgagcactgccgcattcatactggcgagaagccatacaagtgtaatgtgtgcggaaaggtgttttcctataactccaactttgcacggcatcaacggatccacacacgggaaaagccctacgaatgcaacgaatgcggcaaggttttctccaataattcgtatctcgcacgccaccaacgcattcacgccgaagaaaaaccttacaagtgtaatgagtgtggcaagggattctctcacaagtctagtctggccaatcactggagaatttacacaggggagaagccttataagtgcgacgagtgtggaaaggctttctatcggatcgcccttcttgttcgccaccagaaaatccacacaggggagaaaccttacaaatgcaatgagtgtggcaaggtgtttatccagaactctcatcttgcacagcactggaggatccacacaggggagaaaccttacaaatgcaacgagtgtggaaaggtatttaatcagttaagcaatctggctcgccacaggcgcatacacaccggcgagaaaccttataagtgcaatgaatgcgggaaggccttctccgaatattccggcctgagcgcccacctggtcattcatactggggaaaaaccctataagtgctcagagtgtggcaaggcctttcgccacaagttaagcctgacaaatcaccagcggatccatactggggaacgaccctacaaatgcaatgaatgcggaaaggtcttcaatagaatcgcccacctcgctcgacatcgtaaaatacacactggagagaagccctacaagtgcaacgaatgcgggaaagctttttctcggatctcctatcttgcccagcactggaccattcatatgggctag

SEQ ID NO: 141478 - DNA, 1764 bp, Artificial Sequence
  Description of Artificial Sequence: Synthetic coding sequence
atgcctacagccctatgcccgcgagtgctggcccctaaggaatctgaagagccacgaaaaatgagatctcccccgggggagaacccgagcccacaaggggagttaccttccccagaatcatcacgacgtctgttccgtaggttccgataccaagaagctgctggcccccgggaggctctgcagaggctgtgggacctgtgcggaggctggttgcgcccggagagacacacaaaagaacagatcctggagttgctagttctcgagcagttccttgccatcctgccgagggaaatccagtcctgggtgcgtgctcaggaacccgagagtggagagcaggcggtcgcagcagtggaggccctagagagagagcccggacgcccctggcagtggctgaagcactgcgaagaccctgtggtgatagacgacggtgattctcccctcgatcaagagcaagaacagctgccagtcgagccacactcagacttagctaagaaccaagacgctcagcctatcacactggcacaatgtttagggcttccgagccggcccccttcccagcttagcggagaccccgttctccaggatgcattccttctgcaagaagagaacgtgagggatacacagcaggtgaccaccctgcagctgccgccctccagagtttccccattcaaagacatgattctgtgcttttcagaggaggattggtcccttctggaccccgcacagaccggattctacggggaatttataatcggagaggactacggggtgtccatgccacccaacgatttagcagcacaacctgatctgtctcaaggtgaagaaaatgaaccccgcgttcctgagttgcaggatttgcaggggaaggaggttccccaggtatcctacctggatagcccttctctgcaacctttccaagtagaagaacgaagaaagcgagaagagctccaggttcccgagtttcaggcatgtccacagactgtggtcccacaaaatacataccctgccgggggaaaccccagatccctggagaactcccttgacgaggaggttaccatcgagatcgtgcttagctcttctggagatgaggactcacaacatggaccatattgcactgaggagttgggttccccgacagagaagcagcggtccctcccagctagccatcgctcttccaccgaggccgggggcgaggtacagacctcaaaaaaatcctacgtgtgcccaaattgcggaaagattttcagatggcgtgtgaatttcattagacacctccgaagtcgaagagagcaagagaaaccgcatgaatgttccgtgtgtggcgagctgttttccgactccgaggacctggacggtcacctggagagtcacgaggctcagaaaccttaccggtgtggagcctgcggaaagagtttccggcttaacagccaccttctgtctcaccgcagaattcatttgcagcccgacaggcttcaacccgtggagaagcgtgagcaagctgcatctgaggatgccgacaagggccctaaggagccccttgaaaatggaaaggccaagttgtcatttcagtgttgtgaatgtggcaaagcatttcaacggcacgaccatctggctaggcaccgtagtcactttcatttaaaagataaggcccggccatttcagtgtcgatactgtgttaagagctttactcaaaactacgacttactgcgccacgagaggctgcatatgaagcgccgcagtaaacaagctctgaattcttactag

SEQ ID NO: 141479 - DNA, 1872 bp, Artificial Sequence
  Description of Artificial Sequence: Synthetic coding sequence
atgcctacagccctgtgtccccgcgtgttagctcctaaagaatcggaagaaccacgcaagatgcgaagcccacctggtgagaatccgtcaccgcagggggaacttccctcaccagaatccagtcgcaggctttttaggcgattccgttaccaagaagctgccgggcctcgggaggcgttgcaacgactgtgggatctttgtggtggctggctgcgcccagagcggcacactaaagagcagatattggagctcttggtgctggaacagtttctggccatactcccaagggaaattcagtcctgggtccgcgcacaagagccagagagtggcgagcaggcggtcgccgccgtcgaggctttagagcgggagccaggaaggccctggcagtggctgaaacattgtgaggacccagtagtaattgatgacggggacagtccgctggatcaagagcaggaacagctcccggtggagccccacagcgacctggctaagaatcaggatgcccagccaataacactcgcacagtgcctcggcctgccgtctcgccctccaagtcagctgtccggggatccagttctccaagatgcattcctgttgcaggaggagaatgtccgcgacacccagcaggtgacgacactgcaactgcctccacgcattttccaatttaataatcaccggagcaatgggtacatcctggaaatgctcggttccggcggcaaaaaagctcagattatctcagtgctgtcccagatctacgtgtcacgcgtgagtccttttaaggatatgatcctgtgcttttcagaagaagactggtctctgctcgatcccgctcagaccggcttttacggcgagttcatcattggtgaggactacggggttagcatgccacctaatgatctggctgctcaaccggacctatcacaaggtgaggagaacgagcctcgtgttcctgagctgcaggacctgcagggtaaagaggtgccccaagttagctacctggactcacccagtctgcagccttttcaggtggaagaacggcggaaacgcgaagagctgcaggtcccagaatttcaggcatgcccgcagacggtagttccgcagaacacatatccagcaggaggaaacccccgatcactggagaactcccttgacgaggaagtaactatcgagattgtactttcctcatccggcgatgaggacagccagcacggtccatactgcactgaagaactcggatcccctaccgagaaacaacgcagcttaccagcaagccaccgcagctccacagaggcaggcggggaggtgcagacaagtaagaagtcctatgtatgtccaaattgtggaaaaatttttcgttggcgcgtgaacttcattcggcacttacgctcacgtagggaacaggagaaaccccacgaatgttctgtctgcggagaactattttctgattccgaggacctcgatgggcatctcgagagccacgaggcgcagaagccgtatcggtgtggagcatgcggcaagagtttcagactcaactcccacctccttagccaccgccgcatccacctgcagcctgatcgactccagcccgtggaaaagcgagaacaggctgcgtctgaggatgcggacaaaggccctaaagagcctctggagaatgggaaagcaaagctgtcctttcagtgttgtgagtgcggtaaggccttccagaggcacgaccacctcgcccgccacagatcccacttccatctcaaggataaggctaggccttttcagtgccgctactgtgtgaagtcgttcactcaaaactatgatctcctgagacacgagaggctccacatgaaacggaggtcaaaacaggcactcaatagctactag

SEQ ID NO: 141480 - DNA, 1830 bp, Artificial Sequence
  Description of Artificial Sequence: Synthetic coding sequence
atgtcaaccgccccgagtttatccgccctgcgtagcagcaaacattcgggcggaggcggcgggggcgggggcggcggtggagctgatccagcatggacttcagccctgagtgggaatagcagtgggcccgggcccggatcttctccggcgggctcaaccaagccttttgtgcacgccgtcccaccgagcgaccctctgcgccaggccaatcggctcccaataaaggttttaaaaatgcttaccgcccggaccggacatatccttcacccggagtatttgcagcccttaccaagcaccccagttagccctattgagcttgacgccaaaaaatctccccttgcgttactggcccagacttgttctcagatcgggaagcctgaccctagtccatctagcaaactgagtagcgtcgcatctaatggaggcggtgccgggggggctgggggaggcgctgccggcgataaggacactaaaagtgggcccttgaagctcagcgatattggggtagaggacaagtcaagtttcaaaccgtattccaagccgggaagcgacaaaaaggagcccggcgggggtgggggcggcggcggagggggtggggggggcggcgggggtgtgagtagtgaaaagtcaggatttcgagttccctcagccacatgccagccttttacgccccggactggatctccatcttcaagcgcttctgccgaaggaggccccaccggcttggcccatggccgcatcagctgcggaggtggtatcaacgtcgatgtaaaccagcatccagatgggggccccgggggtaaagccttaggctcggattgcggagggagcagtgggtctagcagtgggtcgggtccttcagcacctacgtcatcaagcgtgcttggctcaggactcgtagcgccagtgagcccttacaagcccggtcagaccgtatttcctcttcctcccgcagggatgacctaccccggctctctcgccggggcatacgccggctatcccccccagtttctcccccacggagtggcactggatcctactaagcccgggtcattggtcggcgcacagctggcagctgccgctgccggctccctgggctgctcaaaaccggctggaagctccccattagccggcgccagcccaccgtctgtcatgaccgcctcactgtgcagagacccctattgtttgtcatatcattgtgctagtcatttggccggagccgccgctgctagcgcaagttgcgcccacgaccctgccgccgctgcagctgcactgaagtctggctaccccctggtgtacccaacgcacccattgcatggagtgcatagttcactgaccgccgccgcggccgctggagcgacgccccccagccttgcaggccacccactttatccttacgggtttatgcttccaaatgacccgctgccgcacatctgcaattgggtttcagccaatggaccatgcgacaaaaggtttgcaactagtgaagagctcctctcacacctgagaacccatacagcctttcccgggactgataaacttctgagtggctacccttcaagtagctcactggccagtgcagctgcggctgccatggcttgccatatgcatatccctacaagcggtgcacctgggagcccgggtaccctggctctgcgctctcctcaccatgccctgggtctgtccagccgttaccacccctacagtaaatcccccttgccaacccctggagcccctgtcccggtgccagcagctacggggccctactactctccctatgcactgtatggacagaggctcaccacggcctctgccctggggtaccaatag

SEQ ID NO: 141481 - DNA, 1941 bp, Artificial Sequence
  Description of Artificial Sequence: Synthetic coding sequence
atgtcaacagccccctctctcagtgcactgcggagcagcaagcatagcggcggaggtggaggcggcgggggtggcggcggtgccgatcccgcctggacttccgcactctctggcaacagctccggccccggtccggggtctagccctgccggctctaccaaacctttcgtgcatgccgtgccgccatccgatccgctgcgccaggctaatcgactgccaatcaaagtgctgaagatgctgacggcaaggactggccacattcttcacccggaatacttgcaacccctcccgtctacacccgtaagccccatcgagttggatgcaaagaaatcacccctggccctgcttgcgcagacctgttcccagattggtaagcccgacccttccccatccagtaaactttcctccgtggccagcaacggcggcggcgcggggggggctgggggaggggcggctggagataaggatacaaaatcggggcctctgaaactgtccgacattggagtcgaagataagtctagtttcaaaccatactccaagccgggatccgataaaaaagagcccggcgggggcgggggcgggggaggaggcggaggcggtggtggcggaggtgtgagctctgaaaagagcggcttcagggttcctagtgccacatgccagccctttactcctcggaccggctccccatccagttccgcaagcgcatgttcgccagggggtatgctgtcatccgccggtggcgctcccgaaggcaaagacgacaagaaggacacagatgtcggcggtggaggcaagggtacaggcggtgcctccgcagaggggggccctaccggactggcacatggaagaatttcttgtggggggggtataaatgtggacgtgaaccaacaccccgacggaggccctggcggaaaagcccttggctctgactgtggagggtcctcagggtcctccagtgggtctgggcctagtgctcctacatcatcatctgtgctgggttccggtcttgtcgcacctgtctccccttacaaacctggacagacagttttccccctgccacccgccggaatgacttaccctggatcgctcgccggagcctatgctggataccccccccagttcctcccccatggcgttgctctcgatcctactaagcccggtagtctcgtcggtgcgcagctggccgcggccgccgctggttccttgggttgctctaagcctgcgggctcttcacccctggccggcgctagcccacccagcgtgatgacggcctccctttgtagggacccgtattgcttaagttaccactgcgcaagtcacttagccggtgcggctgccgcctctgccagctgtgcccacgaccctgcagccgccgcggcagccctgaagtccggataccccttggtgtaccccacacacccattgcatggagtacactcctcacttacagcagccgccgccgcgggagctaccccgccctcattagcagggcaccctctgtatccttacggattcatgcttcccaatgaccccttaccccacatatgcaactgggtgtcggctaatggcccttgtgacaagcgattcgccacatccgaagaactgttatcccacctccggacacacactgcattccctggtacagacaagctgctctcgggatacccctccagttcctctctcgctagcgcagccgccgcagccatggcttgtcacatgcacataccgacatcaggggcacccggttccccaggaactctggcccttagatccccacaccatgccctaggactctcatccagatatcacccatactcaaagtcccccctaccaacccccggagcgcccgtcccagtccctgctgctactggcccgtattattctccatatgcgctctatggacagcggttgaccaccgcctccgctctgggatatcagtag

SEQ ID NO: 141482 - DNA, 1941 bp, Artificial Sequence
  Description of Artificial Sequence: Synthetic coding sequence
atgagcacagccccgtctctctccgctcttcggtccagtaaacatagcggtggcggcggcggcggggggggcggcggaggcgccgacccagcctggaccagcgccctgtctggcaactcatcggggcctggacctggttcctctccggcaggaagtaccaagccattcgtgcacgcagtgcccccatccgaccccctcagacaggctaatcggctcccgattaaagttcttaagatgctcactgccagaacgggccacatcctccatcctgaatacctccaacctttgccatctacacctgtatcacctatcgagctggacgccaaaaagtctcctttagcgctgttggctcaaacgtgcagtcagatcggtaagcccgacccgagccctagctcaaaactgagttcggtggcatccaacgggggcggtgctggaggggctggcggtggggccgcaggtgacaaagacacaaaaagcggccctctgaaactctccgatatcggcgttgaagataagtcctctttcaagccgtacagcaaacctggatccgataagaaggaacccggcggcggcggtgggggggggggcggcggcggaggcgggggtggcggcgtgtcttccgagaagtccggatttagagtgccctccgctacatgccagcctttcacaccaagaactggtagcccctcaagcagcgcttctgcctgtagccccggtggaatgctctctagcgcgggtggcgcccccgaaggtaaggacgataagaaagatactgacgttggcggtggtggcaaaggtaccggcggcgcaagcgctgaaggtggccctacaggccttgctcatggcaggatctcctgtggggggggcattaatgtggatgtaaaccagcacccagatggtggccctggaggcaaggcacttggatcagactgtggtggcagctctggatcgagtagcgggtcaggcccaagcgctccaacttctagcagcgtacttgggagcggtctcgtggctcctgtctcaccatacaaaccagggcaaactgtattccccctccccccagcaggcatgacatacccaggctccctcgccggagcctatgctggctacccccctcagtttcttccccatggggttgctctcgaccccacaaaacctggcagcctggtcggggcgcaactcgcagccgcggccgctggctcactaggttgtagcaaacctgctggatcctcaccgctggctggtgctagtcccccctccgttatgaccgcttcactttgcagagatccttattgcctatcttaccattgtgcgagccacctggccggtgctgcagctgcttcagcttcctgtgcccacgatcctgccgctgcggcagctgccctgaagtccgggtaccccttagtttacccaactcaccccctccatggtgtccactccagtctaaccgcagccgccgctgccggggctacgccaccgagcttagccggtcatcctctttacccctacgggttcatgctacccaacgatcctttgccacacatttgcaattgggtgtctgcgaacggtccctgcgataagcgatttgctacatcagaagagctgctttcacacctgcggacccataccgcattcccaggaaccgacaaactgctgtcagggtacccgagcagcagcagcctcgcttccgcagccgctgccgctatggcgtgccatatgcacatccctacgtcgggcgcacctggatctccaggaacattagctttacgatccccgcaccatgcgctgggcctgagctccaggtaccacccctactctaagtccccattaccaactcctggcgctcctgtgcccgtccctgctgctacagggccctactattctccttatgccctgtacggccagagactgactacggcatcagccctgggctatcagtag

SEQ ID NO: 141483 - DNA, 1626 bp, Artificial Sequence
  Description of Artificial Sequence: Synthetic coding sequence
atgcctcggagaaagcagtcacaccctcaacctgttaaatgcgagggagtcaaggtcgatacagaggacagtctggatgaagggcctggagctctggtactcgaaagtgatctgttactgggtcaagatctggaatttgaagaggaagaggaggaggaagagggggatggtaatagcgaccaattgatggggttcgagcgggactccgagggagacagtctcggggctagacccggtctgccttacggactcagtgatgacgaatccggaggcggcagggcgctgtcggctgagtccgaggtagaggagccagcccgcgggccaggagaggcacgcggagaacgccctggacccgcatgccagctgtgtggaggcccgaccggcgagggtccttgttgtggtgctggtggccctggcggcggccctttgctgcctccccgccttctctacagttgccgcctatgtaccttcgtaagccattacagtagccatttaaaaagacatatgcagacccatagtggcgaaaagccgtttaggtgcggaagatgtccgtacgctagcgctcagctggtgaacctgacccgccatacgcggacacacaccggtgagaaaccttacaggtgccctcactgtccatttgcctgctcatcactgggaaacttaaggcgccaccaacggacgcatgcgggccccccaacaccaccatgccccacttgcgggttccggtgttgcacgccacggcctgctcggcccccctctcccacagaacaggagggtgcggttcccagacgaccagaggatgctctgcttctccccgacctcagcctccacgttccccccggcggcgcgtcgtttctcccagattgcggccaactgcggggcgagggcgaaggattgtgtggtactggctctgaaccattacctgaactgctctttccttggacatgtagaggatgtggacaagagctggaggaaggagaggggagtaggctgggagcggcaatgtgcggacgctgcatgagaggcgaagctggaggcggcgcatctggcgggccccagggcccttctgacaaaggcttcgcatgttctctgtgcccatttgcgactcattatccaaatcacctagcccggcacatgaaaactcactcgggcgaaaagccgtttcgttgtgcaagatgtccgtatgcatctgctcatctggataacctgaagagacatcagcgggttcataccggggaaaagccctataagtgcccgctctgtccgtacgcttgtggcaatctggctaacctcaagcgccacggtcgaattcattctggagataaacctttccgttgctccttgtgcaactatagttgtaaccagagcatgaatctcaaacgtcatatgctgagacataccggcgagaaaccttttcgatgcgcaacatgcgcatacaccactggccattgggataactacaagaggcaccaaaaggtgcacggacacgggggagctggcggaccagggctgtccgccagtgagggctgggcccctccccacagccctccatcagttcttagtagtagggggcctcctgccctcgggactgccggcagccgtgccgttcatacagatagctcctag

SEQ ID NO: 141484 - DNA, 1440 bp, Artificial Sequence
  Description of Artificial Sequence: Synthetic coding sequence
atggggttcgagcgggattctgaaggcgactcactgggcgcccgaccagggctaccttacgggctgtctgacgacgagtccggtggcggtagggccctgagtgccgagtctgaggtagaggagcccgcccgaggcccaggcgaggcaaggggcgagcgacctggacccgcctgtcagctgtgcggtggaccaactggagaaggcccttgttgtggcgccggcgggcctggtggtggaccactgttgccacctcgcctgctgtacagctgtagactttgcacattcgtctctcactactcatcgcatctaaagcgccacatgcagacacattctggtgagaagcctttccgatgtggccgctgtccatacgctagcgcccagctggtgaatctaacacggcacacacgaacacataccggggaaaagccctaccgatgtccacactgtccatttgcctgctcatcacttggcaatctgcgacgtcaccagcgtactcacgctggcccacccactcctccatgccccacctgtggattccggtgctgtaccccacgccctgcccggccaccatctcctactgaacaggagggcgctgtacctcgcaggcccgaagacgccttgttactgcctgatcttagcctgcacgtcccacccggcggtgcttcgtttctgcccgactgcggccagttacgcggggagggagaagggctatgcggtactggttctgagcctttgccggagcttctctttccatggacctgtcgggggtgcggccaggagctcgaagaaggcgaaggcagccggctcggcgccgccatgtgtggacggtgcatgcgcggggaggccggcggcggcgcaagtggcggaccacaagggccatcagacaagggtttcgcgtgttccctatgcccctttgcaactcattacccgaatcatctggcccgccacatgaagacacactcgggtgaaaagccctttaggtgcgcacggtgcccctacgctagtgctcacctcgacaatcttaagcgccatcaaagggtgcataccggtgagaagccctacaagtgcccactgtgcccttacgcttgtggaaacctggctaacttgaaaagacacggtcgcattcattctggagacaagccatttcgatgcagcctgtgtaattattcttgcaaccagtctatgaatctgaagcgacatatgctccggcataccggggagaaaccctttcggtgcgccacctgtgcttacacaacgggccactgggataactacaaaaggcaccagaaagttcacggccacggcggagccggaggccccgggctgtccgcgtctgaaggctgggccccgccgcactccccaccctcggtgctctccagccgaggacctcctgccctggggaccgcgggtagtcgagccgtgcacacggactcttcttag

SEQ ID NO: 141485 - DNA, 3936 bp, Artificial Sequence
  Description of Artificial Sequence: Synthetic coding sequence
atgagtaggaggaagcaagccaaaccccgatcactgaaagacccaaattgcaagctcgaagataagacagaggacggagaagcactggattgcaaaaagcggcccgaggacggagaagaactcgaggacgaggctgttcacagttgcgactcctgtctgcaagtgttcgaaagcctctcagacataacagagcacaaaatcaatcagtgccaactcaccgatggggtggatgtggaagacgaccccacatgtagttggcccgcctcaagcccttcttctaaagaccagacctctccttctcatggagaaggctgtgatttcggcgaagaggagggaggacctggactgccttatccctgtcagttttgtgataagtctttctcccggctttcatacctcaagcaccacgaacagagccactccgacaagctgccattcaaatgcacatattgtagtcgactgttcaagcacaaacggtctcgggataggcacatcaaactccacaccggagataaaaagtaccattgttctgaatgtgatgctgctttcagccggtccgatcatcttaaaattcacctgaagacgcacaccagcaataaaccctataagtgcgccatctgcagaagggggttcctttccagctctagcctgcatggccacatgcaagtgcatgagagaaataaggatggcagccagtcaggtagcaggatggaggactggaagatgaaagacacgcaaaagtgttctcagtgcgaggagggcttcgactttcctgaagatcttcagaaacacatcgccgaatgtcaccctgagtgctctcctaacgaggatagagctgccctacagtgcgtctattgccatgaactatttgtggaggagacaagcctaatgaaccacatggaacaagtccacagcggggagaaaaaaaacagttgctctatttgcagcgagtcattccacaccgtcgaggagctctatagtcacatggattctcatcaacagcccgaatcctgtaaccatagtaatagcccctctttggtaacagtgggatacacatctgtgtcatctaccacccctgacagcaacctaagcgtggactcatctactatggtggaggccgccccaccaattcctaaaagccgaggccggaagcgggcagctcagcagactcccgacatgacgggtccatcctccaagcaggctaaggtgacttactcttgtatttactgcaataaacagctttttagctccctcgccgtgctgcaaatccatttgaagaccatgcatctggacaaaccagagcaggcccatatctgccagtattgtctcgaggtgcttccatcattgtacaatttgaatgagcatctgaagcaggttcatgaggctcaggacccaggcctcattgtgtcagccatgcccgccatcgtctaccaatgcaacttttgctcggaagtagtgaatgatctgaacaccttgcaggaacacatcaggtgcagtcatgggttcgctaatccagccgcgaaagactctaatgcattcttctgtcctcactgttatatgggatttctgaccgacagcagtctcgaagaacatatacgtcaagtgcattgcgatctcagtggtagtcggtttggcagccctgtcctggggacacccaaggagcccgttgtcgaagtctattcttgttcgtattgtactaatagcccaattttcaactccgtactcaagctgaataaacacattaaggagaaccacaaaaacattcctctggctctgaactatattcacaatgggaaaaagagtagggctctaagcccccttagccctgtagctatcgaacaaactagtctcaagatgatgcaggcagtgggtggcgcccctgctcgtcccacgggagaatatatatgcaatcaatgcggtgccaaatacacctccttggactcctttcaaacacacttaaagactcatctggacaccgtccttcccaagcttacatgtccccaatgtaacaaagagttcccgaatcaggagtccctgcttaagcatgtgacaatccacttcatgatcacatccacctactatatctgcgagtcttgcgacaagcaattcacctccgtggacgacctccagaaacacctcctggacatgcacacattcgtgttcttccggtgtaccctgtgtcaggaggtgttcgattcaaaagtcagtatccagctccatctggcggtgaaacactcgaatgaaaagaaggtttacagatgtacatcctgcaactgggactttcgcaacgagactgatctccagctgcacgttaagcacaatcacctcgagaaccaaggcaaggtccacaaatgtattttttgtggcgagagcttcggaacagaggtggaactgcagtgtcatatcaccacgcactccaaaaaatataattgtaagttttgctctaaggccttccacgcaattatcttgctggaaaagcacttacgggagaagcactgcgtctttgaaactaagacacctaactgtggaacaaatggagccagcgagcaggtgcagaaggaggaggtcgagctacagactttactgacaaactctcaagagtcacataattcccacgatggcagcgaggaggacgtggacactagtgaaccgatgtatgggtgtgacatctgcggcgcagcctacactatggagactctgctccagaatcaccagctgcgagatcacaatataaggccaggagagagcgccatcgttaaaaaaaaagccgaactcattaagggcaattataagtgcaacgtatgttcccggacgtttttcagtgagaatggtttgcgggagcacatgcagacccatctgggccctgttaagcactacatgtgtccaatctgcggggagcgctttccctctttactcactctgaccgagcacaaggtcacgcatagcaagtccctggataccgggaattgcagaatttgtaaaatgcccttgcagtccgaagaagagttcttagagcactgtcagatgcacccagacttgcggaactcactaacgggctttcgctgcgtggtctgcatgcagaccgtcacaagtacgcttgagcttaaaatccacggcacgtttcacatgcagaagaccgggaacggtagcgccgtgcagactaccggaagaggacagcatgtccaaaagctgtacaaatgcgcttcctgtctgaaagagtttcgcagcaagcaggatttggtgaagctggacatcaacgggctcccttatggcctttgcgcaggctgtgtgaacttgagtaagagcgccagtcctggcatcaacgttccacctgggactaaccgccctggactcggtcagaatgaaaatctcagtgccatcgaaggaaaaggaaaagttggtggtctcaaaaccagatgctcctcttgcaatgtgaaatttgagagtgaatctgaattgcagaaccacatccagaccatccatagggaacttgtccctgattcaaattctacccagctgaaaacacctcaggtgtcacctatgcctagaatttctccaagccagagtgacgagaagaagacatatcagtgtatcaaatgtcagatggtgttctacaatgagtgggatatccaggtgcacgtggcaaatcatatgatcgatgaggggctgaaccatgagtgtaaactgtgttctcagacatttgacagtcccgctaagctgcagtgtcatttaattgagcacagctttgagggaatgggcgggacctttaagtgccctgtctgtttcactgtgttcgtgcaggcgaacaaactacagcagcacatcttttcggctcacggacaggaagacaagatatacgactgcacgcagtgtcctcaaaaatttttcttccagaccgagctgcagaatcacaccatgacacaacactctagctag

SEQ ID NO: 141486 - DNA, 3936 bp, Artificial Sequence
  Description of Artificial Sequence: Synthetic coding sequence
atatctagagctcagaaagcacagactcggcggctcaatgatcccaactgtaaattggaggacaagaccgaagacggtgaagcccttgactgcaaaaagaggccggaagatggtgaggaattggaggacgaagccgttcacagctgtgacagctgcctccaggtgttcgaatctttaagcgacattacagagcacaagatcaaccaatgtcagctgaccgatggggttgatgttgaggatgaccccacctgcagctggcctgcatcgtcacctagttctaaggatcaaacttcaccctcacatggcgaggggtgtgatttcggggaggaggaaggcggccccggtttgccctacccttgccagttttgtgacaaatccttcagccggctgagctacctgaaacaccacgagcagtcacattctgataagctgcctttcaaatgtacctattgcagtaggctattcaagcacaagagatccagagacaggcatattaagctgcataccggagataagaagtaccactgttcagagtgtgacgcggctttctccaggagcgaccacctgaaaattcacctcaaaacccacacatccaacaagccgtacaagtgtgctatatgcaggcgaggctttctctcatcctcctcactgcacggacatatgcaagtgcacgagagaaacaaagatggctcgcagagcggatcaagaatggaagattggaagatgaaggatacacagaaatgttcccagtgtgaggagggcttcgactttccagaggatctgcaaaagcatattgctgagtgccaccccgagtgtagccctaatgaagatcgcgcggcgttacagtgcgtctattgccacgaactgttcgtcgaggaaacaagtctgatgaatcacatggagcaggttcactctggggagaaaaagaatagttgctcaatatgttccgaatcgtttcacaccgtggaggaactgtattcacatatggatagtcaccagcagcccgagagctgtaaccatagcaactccccctcactggtcaccgttggttatacaagcgtgtccagcactaccccggacagtaacctctcagttgacagttcaacaatggtcgaggccgctcccccaatacctaagagtcgaggacgaaagagggcagctcagcaaactccagatatgacaggtcctagtagcaagcaggctaaggttacctattcttgcatctactgcaataaacaattgttttcttctctcgccgtgctgcagatacaccttaagaccatgcacttggacaagcccgagcaagcccatatttgccagtactgccttgaggtgctgccgtccctatacaacttgaacgagcacctgaaacaggtacatgaagcgcaggatccaggattgattgtgagtgctatgcccgccatagtgtaccagtgcaacttttgttcagaggtggtgaacgatcttaatacgttacaggagcacattcgatgctctcatggatttgcaaatccagctgcaaaggactccaatgcctttttctgcccccactgttatatgggctttttgactgatagtagtctcgaggagcatattcgccaggttcactgtgatctatccgggtcaaggttcggcagcccagtattagggacacccaaagagcctgtggttgaagtatattcctgttcctactgtacaaacagcccaatttttaactccgtcctcaagctgaacaagcacattaaggaaaatcataagaacataccactggctctgaactatattcacaacggtaaaaagagcagagcactgtccccactgtctccagtggcgatagaacagacgagcctgaaaatgatgcaggcggtcggtggtgctcccgctaggccgactggtgagtacatttgcaaccagtgcggggcaaagtacacgtccctggatagttttcagacccatttgaaaacccacctagatacagtcctgcctaaattgacctgcccacagtgcaacaaggaattcccaaaccaagaaagcctgctgaagcatgtgaccatacatttcatgatcacatccacttactacatctgtgaaagctgcgataaacagttcacctccgttgatgatttgcaaaaacacctcttggatatgcatacatttgtattcttcaggtgcaccttgtgccaagaggtgttcgattcgaaagtgagcattcaactacacctggcagtgaagcacagcaatgagaaaaaggtgtaccgctgtacaagctgtaattgggatttccgtaacgagactgatttgcagctgcacgtcaagcacaaccatctcgagaatcagggaaaagtccacaagtgtattttctgcggggaatcttttggaactgaagtcgagctgcagtgtcatatcaccactcatagcaagaaatacaattgtaagttttgttcaaaagcttttcacgctattattcttctggaaaagcacctcagagaaaagcactgcgtatttgaaacaaagacacctaactgcggaaccaatggagccagcgaacaggtgcagaaagaggaggtcgagctgcagactttgctgacaaactctcaggagtcacataatagccacgatgggagcgaagaagatgtggataccagcgagccaatgtacggctgtgatatttgcggcgccgcctatactatggagactctcctacagaatcaccagttgcgagaccacaacatccgccctggagagtccgccatagtgaaaaagaaagctgagctgatcaaggggaactacaagtgcaacgtctgctcgcgcacctttttttccgagaatggcctccgcgagcacatgcaaacgcacctcggcccagtgaaacactatatgtgtccaatttgcggagagcggttcccatcactcctgacactgacagagcacaaagtgactcacagtaaaagcttggacaccggcaattgtcgcatctgcaagatgcccctgcagtccgaagaggagtttctggagcattgccagatgcatcccgacctgcggaattcactgacaggattcaggtgcgtggtgtgcatgcagacagtcacaagcacgcttgagctaaaaattcacggaacatttcatatgcaaaaaacaggcaacggtagtgccgtccagaccacaggtcgcggacagcacgtgcagaaactttataaatgcgcctcttgcctcaaggagttccggagtaagcaggatttagtgaaactggacattaacggccttccttacggtctgtgtgccggatgtgtgaatttaagcaaatcagcttctccaggtataaatgttcccccggggaccaatcgcccaggactggggcagaatgagaacctgtccgccatcgaggggaaggggaaggtgggaggcctgaagacaagatgctccagttgtaatgtcaaattcgaatctgaatccgaattgcagaatcacattcagacgattcaccgcgagctcgtgcccgactctaatagtacacaactgaagacacctcaggtgtcacctatgcctaggatatcccccagccaatctgatgagaaaaaaacttatcaatgcatcaaatgtcaaatggtgttctataacgaatgggatatacaagtccacgtcgccaatcacatgattgatgagggcctcaatcacgagtgtaagctttgcagccagaccttcgacagccccgctaagctgcaatgtcatctgattgagcacagtttcgagggtatgggcggtacgtttaagtgccctgtgtgtttcacagtcttcgtccaggccaacaagctgcagcagcacattttctctgctcacggccaggaagacaagatctacgactgcacccagtgtcctcaaaagtttttttttcagaccgaactgcaggtgcatacagccaccccccgtcagtcttag

SEQ ID NO: 141487 - DNA, 4038 bp, Artificial Sequence
  Description of Artificial Sequence: Synthetic coding sequence
ttcctgagcgactacgttcagagtgaatcactgagggtaagaggaccactgtggtctcatcccgatggattcggcgggttggcatctattttccactactacgttgattataggtctgatagcgctgtgcaggatctggccgatcccaactgcaaactggaagacaagacagaggatggagaggcccttgattgtaaaaaaaggccagaggacggagaggaactggaagatgaggccgtccactcctgtgacagttgtcttcaagtctttgaatctctctccgacatcacggagcacaagataaaccaatgtcagttaacagatggtgtcgacgtagaagatgaccccacttgttcttggcctgctagtagccccagttctaaggaccagacttccccaagccatggggaagggtgcgactttggggaagaggaggggggccccggactgccatacccatgccagttctgtgataagtcattctctagactctcttatctgaaacaccatgagcagtctcacagcgataaactacctttcaagtgcacatattgttctcgtttgttcaaacataaacgctcacgtgaccgacacatcaagctccacacaggcgacaagaaatatcattgctcagaatgtgatgcggctttttcacggtcagaccacctgaagatccacctgaaaactcataccagtaataaaccttacaaatgcgctatttgtcgaaggggctttctctcatcgtccagcttgcacgggcatatgcaggttcatgaaaggaacaaagatggctcgcagtcaggatcccgaatggaggattggaagatgaaagacacgcagaaatgctcacaatgtgaggagggcttcgatttccccgaggatcttcaaaaacacattgccgagtgtcacccagagtgttcccctaatgaggaccgtgccgcactgcagtgtgtatactgccacgaactgtttgtggaggaaacctccttgatgaaccacatggaacaggtacactccggtgaaaagaaaaacagttgctctatttgctctgagtctttccatactgtcgaggaactgtactcccatatggactctcaccaacagcccgagtcatgcaaccactcaaactccccgagcctcgtgaccgttgggtacacaagcgtttcctctactacacctgactcaaacctctcagtggatagctccacgatggtggaggctgccccacctatacctaagtcacgtggtcgcaagcgggctgcacagcagaccccggatatgaccggcccttcttccaaacaggccaaagtgacttatagctgtatctactgtaacaaacagctgtttagctccctggccgtgcttcaaattcatcttaagacaatgcaccttgataagccagaacaggcgcacatttgccaatattgcctcgaggtcctcccaagtctatacaacctaaacgagcatcttaaacaggtacacgaggcgcaggatcctggtcttattgtgtccgcgatgccagctatcgtctaccagtgcaacttttgttcagaggtcgttaacgatctgaatactctccaagaacatattcggtgttcccatggatttgccaatcccgcagcgaaggactccaatgcttttttttgcccacattgctacatgggttttttgacggattcaagtttagaagagcatatcagacaagttcactgcgatctgtccgggtcacgctttggttcccccgtactcgggacacccaaagagccagtggtagaggtgtacagttgcagctattgtacaaattcacctattttcaattctgtactcaaactgaataagcacattaaggagaaccataagaatatacctttggccttgaactacattcacaacggcaaaaaaagccgagccctgagccccctgtccccggttgcaatcgaacagaccagtctcaagatgatgcaggcagtcgggggagctcctgcgcgtcctaccggcgaatacatctgcaaccagtgtggcgccaagtacacaagcctggactcatttcagacccatttaaagacacatcttgataccgtgctcccaaagctgacatgcccgcagtgcaataaggagttcccgaaccaagaatctctgctcaagcatgtgacaattcattttatgatcacatcaacctattacatctgcgagagctgtgataagcagttcacaagcgtggatgacctgcagaaacatctgctggacatgcacacctttgtcttcttccgctgtaccctgtgccaggaggtgtttgactctaaggtaagcatccaacttcacttggcagtgaaacatagtaatgagaagaaagtttacagatgcacgagctgtaactgggactttaggaacgagaccgacctgcagctgcatgtcaagcataaccatcttgagaaccagggtaaggtgcacaaatgtattttctgtggggagagttttgggaccgaagtggagctccaatgtcacattacaacccacagtaagaagtacaactgcaagttttgttcaaaagctttccacgctatcatcctgctggagaagcacctgcgggagaaacactgcgtctttgagacaaaaacgccaaattgcggaactaacggagctagcgagcaagtgcagaaggaagaggtggagctgcaaaccctgctgacaaatagtcaggaaagccataatagccatgacgggagtgaggaagacgtcgatacatcagagcccatgtatggctgtgatatctgtggcgcagcctacactatggaaaccctgctgcagaatcatcagctgcgggaccacaacatccggccaggcgaaagcgcgattgtaaagaaaaaagcggagcttattaagggcaattacaaatgcaacgtgtgctctcggactttcttctctgagaacggcctccgcgagcacatgcagactcatcttggaccagtgaaacactacatgtgcccgatttgcggcgagcgcttcccgagcctgctgactttgacagagcacaaggtgacgcacagcaaaagcctcgatacaggtaactgtagaatatgcaaaatgcctttgcagagtgaggaggagtttctggagcattgtcaaatgcaccccgatctccgcaattctcttaccggattccgctgcgttgtctgcatgcagacagtgacttccactctggaactgaagatccacggaacttttcacatgcagaaaacgggaaacggaagtgcagtgcagacaactggaaggggccagcacgtgcagaagctctataaatgcgcctcctgcctgaaagagttccgcagcaaacaagatctggtcaagttggatatcaacggtcttccctacggcctttgtgcgggctgcgtgaacctgtccaagagcgcctctcccggcattaatgtgccacctggcaccaacagacccggactcggccagaacgaaaacctgtcagctatcgagggtaaaggcaaggttggagggctcaaaacccgctgtagctcttgtaacgtcaaatttgaaagcgagagcgagctgcagaaccacatccaaactattcatagggaactggtgcccgactcaaacagcacccagctcaagactccccaggtgtcaccaatgcctcgtatctccccatcacaaagcgatgaaaaaaagacttaccagtgcatcaaatgccagatggttttttacaacgagtgggatattcaggtgcacgtggctaatcatatgatagatgagggcttgaatcacgaatgtaagctgtgtagccagaccttcgactctcctgccaagctccaatgtcacctgatcgagcactcattcgagggaatgggcgggaccttcaagtgccctgtctgtttcacggtctttgtgcaggcaaataaactacagcagcatatcttttctgctcacgggcaggaggataaaatatacgactgtacccagtgccctcagaagttcttttttcagacagagttacaggtgcataccgccactcctcgtcaatcatag

SEQ ID NO: 141488 - DNA, 2013 bp, Artificial Sequence
  Description of Artificial Sequence: Synthetic coding sequence
atggccgaagtggtagccgaagtggctgagatgcctactcagatgagtccaggggcagttgagatgagtacccctatgtcagcagaaatgatggagatgtctactgaggtgaccgagatgactccaggtgaagcgctggcttcttcccttttctttcagcatcatcagttcatgtgcagcgaatgcggtagtctctataatacactggaggaggtgctctcgcaccaggagcagcatatgcttgcggtaagtgaggaggaagcactgacaactcagaatgttggcttagaacccgagctggttccgggcgcagaagggccatttcagtgtggcgagtgttcacagctcatcttgtcaccgggcgagctgctggcccaccaggacgcgcacctgcgtgagagcgccaaccaaatacagtaccagtgttgggactgccaggagttgtttccctcaccagagctgtgggtggcccaccgcaaagcccagcacctgtccgccaccgtggctgaacctccagtgcctcccccacttccgccaccgacaccactgcctccaccaagccctccatctgaagtaaagatggagccctacgaatgtccagagtgcagcaccctatgtgccacgccggaagaatttctggaacatcagggaacccacttcgattctctggaaaaggaggagagaaacggcttggaggaagaggaagaggacgatgaggaggatgaggaggatgacgaggaaatggaggatgaagaagctatggcggaggtaggcgacgacgccgtggggggcgacgaatctactgcaggatgggctcagggttgtggagactgtccacaacaccaacccagtgcaggagcaagacgacaacaccggcgcacagctcactcccctgcctccgccactcatccatttcattgtagccaatgccagagatcctttagttctgccaatcgcttacaggctcatgggagagcccacgtgggtggcactcacgagtgtactacttgctcgaaggtattcaagaaagccgcaagcttggaacagcacctccgactccacaggggtgaggcccgatacctctgtgttgactgcggaagaggctttggaactgagcttacactcgtggcacaccggcgcgcacatactgctaatcctctgcatcggtgtcgttgcggcaagacttttagtaacatgactaagtttctgtatcatcgacggacccacgctgggaaatctggtgcaccgccgacaggagctaccgccccgcctgcgccagccgagcctacccctcccccaccaccccccgctccccccgcacagttgccctgcccccaatgtagtaaatcattcgcaagcgcttcacgactgagcaggcatagacgggctgtgcacggaccaccagaacgaagacaccgctgcggcgtgtgcgggaagggatttaagaagctgatccacgttcgcaaccatctaaggacacacaccggcgagcgaccctttcagtgccacagttgcggaaagaccttcgcctcattagccaacttaagtaggcatcagctcacacacacgggcgcccgcccctaccagtgcctggattgtggtaagagattcacacaatcttccaacttgcagcagcaccgacgtctgcacctgcgccccgtcgcttttgctcgcgccccacggcttccaatcactgggctctacaacaaaagcccctactattgcgggacttgtggccgatggtttcgcgctatggctggcctgcggctgcatcagagggtgcacgcccgcgcccgaactctcacactacagcctccccgcagcccgtcaccagccccccccccaccacctgagccccaacaaaccatcatgtgcaccgaactcggcgagaccatagccattatcgagacttcccagccattggcactggaggacacattacagctgtgtcaggcggccctgggcgcatcagaggctggcggtttgctgcagctggatactgccttcgtttag

SEQ ID NO: 141489 - DNA, 1581 bp, Artificial Sequence
  Description of Artificial Sequence: Synthetic coding sequence
atggccgaagtcgttgcagaagtcgccgaaatgcctacgcagatgagccctggcgctgttgaaatgtccacacctatgtccgccgagatgatggagatgagtacagaagttaccgaaatgaccccctcacccccctccgaggtgaagatggaaccttacgagtgccccgaatgctccaccctgtgcgctactcctgaggaatttctcgagcaccagggtacgcacttcgactcattagaaaaggaggagagaaatgggctggaggaggaagaggaggacgatgaagaagatgaagaagacgacgaagagatggaagacgaggaggccatggccgaggttggcgacgacgccgtgggtggagatgaaagtacagctgggtgggcacaaggctgcggcgattgccctcaacaccaacctagcgcaggagcccgtagacaacaccgccgcacggctcattcgcctgcctctgcaacacatccattccattgctcacagtgccagaggagtttctcgagtgcaaatcggcttcaagcacatggacgagcgcatgttggaggcacacacgagtgcaccacctgctctaaagtttttaagaaagcagcatccctcgagcagcacttaagattgcatcgaggggaggcccgttatctctgcgtggattgtggccgcggtttcgggactgaattgactttagtcgcgcaccgccgcgctcatactgcaaaccccctccatcggtgtcgatgcggaaagaccttctccaatatgaccaaattcctttatcaccgcagaactcatgccggcaaatccggtgcccctccaaccggggcaaccgcccctcccgctcctgccgagccgaccccaccgcccccccccccagcaccccctgcacagctgccatgcccgcaatgctcaaagtcctttgcatccgcctcccgactctctcggcatcgacgcgcggtgcatggcccccctgaaagacggcacaggtgcggtgtctgtggaaaaggctttaagaaactcattcacgtaaggaaccatctgcgaacccatacaggagaaaggcccttccaatgtcattcatgcggtaagacattcgccagcctcgccaacctctccaggcatcagttaacccatacgggagcaaggccgtaccagtgcctggattgcgggaagagattcacccagtcctccaatctccagcagcacaggaggttacatcttagacctgttgctttcgctagggcccccagactccccattactggcttatacaataaatctccctactactgcggtacatgcggacggtggttccgcgcgatggccggtctccggctacaccagcgggttcatgcacgggccagaacactcaccctccaacccccccgtagcccctctcccgcccctccacccccgcccgagccacagcagaccatcatgtgcaccgaacttggggagacgattgctatcatagaaacaagccagcccttggcactcgaggacactctccagctatgccaagcagccttgggggcctctgaggccggcggactcctccaactcgataccgccttcgtctag

SEQ ID NO: 141490 - DNA, 1983 bp, Artificial Sequence
  Description of Artificial Sequence: Synthetic coding sequence
atggcgcatgcccttgtgacattcagagatgtggctatcgattttagtcaaaaagagtgggaatgtctagacaccacacagcgcaaattgtaccgtgacgtaatgcttgaaaattacaacaacctggttagtttgggctatagcgggtccaaacccgacgtgatcactcttctggagcaggggaaagagccctgtgtcgtggctagagacgtgacagggagacagtgtcctggcctgctatccaggcacaaaaccaagaagctttcaagcgagaaggacattcacgaaatttcactgagcaaggagagcatcatcgagaaatcaaaaacactccggctcaagggatctattttcagaaacgagtggcagaacaaaagtgagtttgagggacagcaaggcctcaaagagagatccataagccagaagaagatcgtgagcaaaaagatgagcactgacaggaagcggccctcctttactctgaatcaacggatccataactccgaaaagtcatgtgactcacatttggtgcagcacggcaagattgattcagatgtaaaacacgactgtaaggagtgcggatccacatttaataatgtataccagctgacacttcatcagaagatccacactggagaaaagagctgcaagtgcgaaaagtgtggtaaagtttttagccattcgtaccagctgacactccaccagcgtttccacactggtgagaaaccctacgaatgtcaggagtgtggaaaaacgttcacactgtacccacagttaaacaggcaccagaagatccacaccggtaaaaagccctatatgtgcaaaaaatgcgataagggattcttttctaggctggaactgactcagcataagagaatccatactggaaaaaaatcatatgaatgtaaagagtgtggaaaagtgttccaattgattttttacttcaaagaacacgaacgtattcacaccggaaaaaagccatatgagtgtaaagaatgcggtaaagcattttccgtctgtggacaactgacccgtcatcagaagattcatacaggtgtgaaaccctacgagtgcaaggagtgcgggaagacttttagactgtcattctatctgacagaacaccggcggacacacgccggtaaaaagccttatgagtgtaaggaatgcgggaagtcttttaatgtgcgcggccaactgaacagacacaagaccatccatacaggcataaagcccttcgcttgtaaagtgtgcgagaaggccttttcatactctggggacctacgggtccactctaggatccacactggagagaaaccatacgaatgcaaagaatgtgggaaggcattcatgttgaggagtgtacttacagagcaccagcggttacacaccggcgtgaagccatatgaatgtaaagaatgcgggaaaacatttagggtgcgttcccagatttctctgcacaagaagatccatacagacgtgaaaccctacaagtgcgttcgatgtgggaagacttttaggtttggattttacttgacagaacatcaacgtatacacaccggagaaaaaccttacaagtgtaaagaatgtggcaaggcctttatcaggcgaggaaacctgaaggagcatctcaagattcacagcggcctgaaaccttacgactgcaaggagtgtggaaagtctttctcgcggcggggtcaattcaccgagcaccagaagatccacactggcgttaagccctacaagtgcaaggaatgcgggaaggccttttctagaagcgttgatctgcggattcatcagagaattcatactggggaaaagccatacgaatgtaagcagtgcgggaaagcattccggctcaattctcatttaaccgagcaccagagaatacacaccggcgagaaaccttacgagtgcaaagtctgtaggaaagcttttcggcagtacagtcatctataccagcaccagaagactcataatgtgatatag

SEQ ID NO: 141491 - DNA, 1887 bp, Artificial Sequence
  Description of Artificial Sequence: Synthetic coding sequence
atggcacatgccctcgtcaccttccgggacgtggctatcgacttttctcagaaagagtgggaatgccttgatactacacagagaaaactgtacagggacgtgatgctggaaaactataacaatttggtcagtttggggctgctcagccgtcacaagaccaagaagctgtcctctgagaaggatattcacgagatttcactgtctaaggaatctattattgagaaatccaaaactctgcgactgaagggatccattttcagaaatgaatggcagaacaagtctgagttcgaaggccagcaaggtctcaaagagaggagcatctcgcaaaaaaaaatcgttagtaagaagatgtccactgacaggaaaagaccttccttcaccctcaaccagcggatccacaacagcgagaagagttgcgactctcacctggttcagcacggtaagatcgactcggacgtgaaacacgattgtaaagagtgcggctccacttttaacaatgtgtaccagcttaccttgcatcagaaaatccacactggggagaaatcatgcaagtgtgagaagtgcgggaaagtgttcagccacagttatcagttaacgttgcaccaaagattccacaccggggagaaaccctacgagtgtcaggaatgtggcaagacctttacactatatccccagctaaatcgacaccaaaaaatccacacgggcaagaagccttacatgtgtaaaaagtgtgataagggattttttagtcggctcgaactgacacagcacaagagaattcatactggcaagaaaagctatgagtgtaaggagtgtggtaaggtcttccaactgatcttctattttaaggagcatgagcgcatccatactggaaaaaaaccatacgaatgcaaggagtgtgggaaagcctttagcgtttgcgggcagctcacacgtcaccagaaaatccatactggcgtgaaaccatacgaatgtaaagaatgcggcaagacttttagactgtccttttacctaacagaacatcgccgcacacacgccggcaagaagccttacgagtgcaaagaatgcggtaagagcttcaacgttagaggtcagctgaacaggcacaagacaatacatacggggataaagccgtttgcctgcaaggtctgtgagaaagccttctcctactccggagacctaagggtgcacagcagaatccacaccggggagaaaccctatgaatgcaaggaatgtggaaaagcattcatgttgcgctcagttttaaccgagcaccagaggctccacaccggtgtcaagccctatgaatgcaaggaatgtggcaaaacatttcgggttcgaagccagatctcactgcacaagaaaattcacactgacgtgaagccctacaagtgcgtccggtgtggcaagacttttcggttcggcttttacctgaccgagcatcagaggatccacaccggggaaaaaccctacaagtgcaaagaatgtgggaaggcttttatcagacggggcaacctcaaagaacatttaaagattcattctggtctgaaaccctacgattgcaaggagtgtggaaagagtttcagtcggagaggccagttcactgagcatcaaaaaatccatacaggagtgaagccctataagtgcaaagagtgcggtaaagcatttagcaggtccgtcgatctcaggatccaccagaggatccacaccggcgaaaaaccttatgagtgcaagcagtgcggtaaagcgtttcggcttaattctcacttaaccgagcaccagagaatccacactggcgagaagccctacgaatgcaaggtttgcaggaaagctttcaggcaatatagtcatttgtatcaacaccagaaaacgcacaacgtcatctag

SEQ ID NO: 141492 - DNA, 1887 bp, Artificial Sequence
  Description of Artificial Sequence: Synthetic coding sequence
atggcgcatgcgctcgtaactttcagggatgttgctattgacttcagccagaaggagtgggagtgccttgatacaacacagcgaaagctctatcgcgacgtaatgttggagaactacaataatttggtcagcctgggcctcctatcgaggcataaaactaaaaagttgtcctctgagaaggatatccatgagatctcactgtccaaagagagcatcatcgaaaagagtaaaactctgcgactcaaaggctccatatttcggaacgaatggcagaataagtccgaatttgagggacagcagggcctcaaagagaggtctatttcccagaaaaaaattgtgtcaaagaaaatgtcgacggacaggaaaaggcccagcttcacactgaatcagcgcatacataattcagaaaagtcctgcgactcccatctcgttcagcacggcaaaattgactcggacgttaaacatgactgcaaggaatgcgggagcacattcaacaatgtttaccaattgaccttgcatcagaaaatccacacaggcgagaagtcatgcaagtgcgagaaatgtggcaaagttttttcccacagctaccagctgaccctgcatcagcgatttcatacaggtgagaaaccctacgaatgccaggagtgcgggaagacttttaccctctatccacagctgaacaggcatcagaagatccacacaggtaagaaaccctacatgtgtaagaaatgcgacaagggatttttctcacggctcgagttgactcaacataaacgaatccataccggcaaaaaatcttacgagtgtaaggagtgcggcaaggtatttcagttgatcttctacttcaaagagcacgagcgtattcatacgggtaaaaaaccatatgaatgtaaagaatgtggcaaggcattctctgtctgcgggcagctgacacgccatcagaagatccataccggggttaagccctatgagtgcaaggaatgcggcaaaaccttccggttaagcttttacctgaccgagcaccgaagaactcatgcggggaagaaaccttatgaatgtaaggaatgtggcaaatcatttaacgtgcgaggacagcttaataggcataagacaatccacaccggtattaagccctttgcctgtaaagtgtgtgaaaaggctttctcctattcgggcgatctgcgggtgcactcaagaattcacacgggcgagaaaccttacgaatgtaaagagtgtggaaaagctttcatgctgcgttctgtcctgactgagcatcaacggctgcacactggcgtaaagccgtatgagtgcaaagaatgcggaaagacatttcgggtccggtcacagatttctctgcataaaaagatacacacagatgtgaaaccctataaatgcgtgcggtgcggcaagacattccgttttggcttctacctgacggagcaccagaggatacatactggtgagaagccttataaatgcaaagagtgtgggaaggcttttatccggcggggcaacttgaaagaacatctaaaaattcactccggattgaaaccatacgactgcaaagagtgcgggaaaagcttttccagaaggggccagtttaccgagcaccaaaaaattcatacaggggtgaaaccatacaagtgtaaggagtgcgggaaagcctttagtagatcagtcgacctacggatccaccagcgcatccacacaggcgagaagccatacgaatgtaaacagtgtggaaaggcatttcgattgaattcccatctcactgaacatcagagaatccacactggagaaaagccatacgagtgcaaggtatgcagaaaggccttcagacagtatagccatttgtaccagcaccagaagacacacaatgtcatctag

SEQ ID NO: 141493 - DNA, 1983 bp, Artificial Sequence
  Description of Artificial Sequence: Synthetic coding sequence
atggctcacgccttggtgacattccgcgacgtggccatcgatttcagccaaaaagaatgggagtgcctggacacgactcagagaaagctctatcgtgacgtgatgctggagaattacaataaccttgtgtcactcggatattccggcagtaaacccgatgtaatcacactgctggagcagggcaaggagccatgtgtcgtggccagggacgtgactggcaggcagtgtcccgggttactgtcgcggcacaagacgaaaaagctgtcttctgaaaaggatattcacgaaatcagcctgagcaaggagagcattattgaaaagtccaagacgctacgcctcaagggtagcatcttccgcaatgaatggcagaacaaaagcgagtttgagggccaacagggattgaaggagaggtccatctcccagaagaaaattgttagtaagaaaatgtccacggatcgaaagcggcccagttttacactcaaccaacggatccataatagcgagaaaagctgtgattcgcacctcgttcagcatggtaaaattgattcggatgtgaagcatgattgtaaggaatgcggttctacctttaacaacgtctatcagctcactctgcatcagaagatccacacaggagaaaagagttgtaaatgtgaaaagtgtggcaaagtcttctcccactcttaccagctgaccttacaccaaaggttccacacgggcgagaagccctacgagtgccaggagtgcggaaagacattcaccctctacccccagctgaatcgacatcaaaaaattcataccggaaagaagccatatatgtgcaagaaatgtgataaagggttctttagcagactcgagcttacccaacataagaggatccatacaggcaagaaatcctacgagtgcaaagagtgcggaaaggtctttcagctgatcttttattttaaggagcatgagcggatccatacagggaagaaaccctacgagtgcaaagaatgcggcaaggcgttctctgtttgtggtcagttaacacgtcaccagaagattcataccggggtgaaaccctacgaatgtaaagaatgcggtaaaactttccgcttgtccttttacttaactgaacatcggcggacccacgcaggcaaaaagccgtacgagtgcaaggagtgcggtaagagttttaatgtacgcggccagctgaaccggcacaagactatccataccggaatcaaaccatttgcctgcaaggtttgcgaaaaggcgtttagctattccggcgacttgagggtccattcaagaattcatactggtgagaaaccttacgagtgcaaagaatgtggaaaggcatttatgcttcggagcgtgctgactgagcaccagcggttgcacaccggtgtgaaaccatacgaatgtaaggaatgtggaaaaacgttcagggttaggtcccaaatcagccttcacaaaaagattcatactgacgtcaagccttataaatgcgtgagatgtggcaagactttccgctttggattttatctgacagagcatcagcgtattcacacgggagaaaaaccttataagtgcaaagagtgtgggaaggcttttatccgcagagggaatctgaaggaacacttaaaaattcacagtggtttgaaaccctacgactgcaaggagtgtggcaaatcgttctcgcgacggggacaatttaccgaacaccaaaagatccatactggcgtgaaaccttacaagtgtaaagagtgcgggaaggcctttagccgttccgtggatctgagaatccatcagcggattcacactggagagaagccatacgaatgtaaacagtgcggcaaggcttttcggcttaatagtcatctaaccgagcatcagagaatccacaccggtgagaaaccctatgagtgtaaggtttgccgaaaggcctttagacagtacagtcacctgtatcagcaccaaaaaacccacaatgttatttag

SEQ ID NO: 141494 - DNA, 1500 bp, Artificial Sequence
  Description of Artificial Sequence: Synthetic coding sequence
atggcacaaggacttgtcactttccgcgatgtcgcgattgagttctccctggaggaatggaaatgcttggaacccgcacaacgagacctgtatcgggaagtgactcttgaaaatttcggccacttggcctccctaggactgtccattagtaaacctgacgtagtgagcctactcgaacagggcaaggagccttggatgatagcaaatgatgtcaccggtccgtggtgccctgacctggagtccagatgtgagaaattccttcagaaagatatattcgagatcggtgcttttaattgggaaataatggagagcctgaagtgtagcgatctcgaggggtctgacttccgtgcggattgggagtgtgaaggacagtttgaaagacaggttaacgaggagtgctattttaagcaggtgaacgtaacctacggccatatgccagtattccagcaccatacaagtcacactgtgcgccaatctagagagaccggcgaaaagctgatggagtgccatgagtgtgggaaagcgttctctcggggaagccatcttatacagcatcaaaaaatccacaccggtgagaaaccattcggatgtaaagagtgcgggaaggccttctcaagagcctcccacctcgtccagcatcagcggatacatacaggcgagaagccgtacgactgtaaagactgcgggaaggcgttcggaaggacgtcagagctgatcttgcatcagaggctgcacacgggtgtaaaaccctacgagtgcaaggagtgcggcaaaacctttaggcaacactctcagcttattctccaccagcgaacccatactggcgagaaaccttacgtgtgtaaggactgtggcaaggcctttatccgagggtcccagctgacagtgcatcggcggatccacacaggcgccaggccatatgagtgtaaggaatgtggcaaagcctttaggcaacacagccagctgactgtacatcagcgtatacatacaggagagaaaccgtatgagtgtaaggagtgcggaaagggttttatacacagtagtgaggtgactagacatcaacgcattcactccggggaaaagccttatgagtgtaaagagtgcggtaaggctttccgccagcacgctcagctgactcgccaccagcgcgtccacactggtgataggccctatgagtgtaaagattgtggaaaagccttcagtcggagtagttacctcatacagcaccaacggatccacaccggagataagccgtacgagtgcaaggagtgcggcaaggctttcatccgggtatctcagcttacacaccatcagcggatccacacctgtgaaaaaccatacgagtgtcgagagtgtggcatggcattcattcgctcctctcaactgacagaacaccaacgcattcatccagggatcaagccatacgagtgtcgagagtgtggacaggcattcatcttgggttctcagcttatcgaacattatcggatccacactggatag

SEQ ID NO: 141495 - DNA, 1620 bp, Artificial Sequence
  Description of Artificial Sequence: Synthetic coding sequence
atgcgcagaggtccttgggaacgctggagccttgccagccatcggctggacgcaggcctctgcacgtgccctagagaggaatcacgggaaatcagagcggggcaaatcgttcttaaggccatggcccaggggcttgtaacctttcgcgatgttgcgatcgaatttagcctcgaagaatggaagtgtttagagcccgcccaacgtgacctgtaccgggaggtcacattggaaaatttcggacacttggcttcgctcggtttgtctatctcaaagcctgatgtggtgtccctgctggagcagggaaaagagccatggatgatcgccaacgatgtgactggaccatggtgtcccgacctcgaatctaggtgtgaaaagttcctccagaaagatatctttgaaatcggagcattcaactgggaaatcatggagtccctgaagtgtagcgacctggagggctccgatttccgcgccgattgggagtgtgaaggacagttcgaaaggcaggtgaacgaagaatgttattttaaacaggttaatgttacgtatggacatatgcccgtctttcagcatcacacctctcacacagtcaggcaatctcgtgagaccggggaaaagctaatggaatgccacgaatgcggtaaagctttcagcaggggtagtcacttgatccagcaccagaaaattcacaccggtgagaaacctttcggttgcaaggaatgcggtaaggccttttctcgggccagtcatctggtacagcatcagagaattcatactggcgagaagccttacgattgcaaagattgcggaaaagctttcggacgcacctccgagctgatcctgcatcagcgcttgcacaccggtgtcaagccttatgagtgtaaggaatgcggaaaaacattccgtcagcattcccagttgatactgcatcagcgtacacacaccggcgagaagccttatgtctgtaaggactgtggcaaagccttcattaggggtagtcaactcactgttcaccgccgaattcatacaggggccaggccgtacgagtgtaaggagtgcggtaaggccttccgtcagcactcacaacttaccgtccaccagcgaattcacaccggtgaaaagccctatgagtgtaaggaatgcggtaaagggttcattcatagctccgaggtcacccgacaccagaggatccacagcggagagaagccatacgagtgtaaagaatgcggcaaggcctttcgccagcacgcccaattgacaaggcatcagcgcgtgcacaccggagaccggccctatgaatgcaaggactgcggtaaggcattttctcgaagctcctatctgattcaacaccagaggatccataccggggacaaaccgtacgagtgcaaggagtgtgggaaagctttcatacgggtgagtcagctaacacaccaccaaaggatccacacatgcgaaaagccatacgaatgtcgtgaatgtggcatggctttcatcaggtcctcccagctgaccgagcaccaacgaattcacccaggaattaagccatacgagtgtagagagtgcgggcaggcgtttatcctgggaagccagctcattgagcactatcggattcatacagggtag

SEQ ID NO: 141496 - DNA, 1500 bp, Artificial Sequence
  Description of Artificial Sequence: Synthetic coding sequence
atggcacaagggctggtgacttttcgggatgtcgccattgagtttagcctggaagaatggaaatgtctggagcctgcacagagagacctgtaccgagaggtcactttagagaactttggccatctggccagccttggcctgtcaatttccaagccagacgtagtgagtttgctagaacaaggcaaagagccatggatgatagccaatgacgtcacaggcccttggtgccccgacttggagtcaagatgtgaaaagtttctccagaaggatatcttcgagattggagccttcaattgggagatcatggagtccctaaaatgttctgacctggaaggatcagatttccgcgccgattgggagtgtgaggggcaatttgaaagacaagtgaacgaggagtgctattttaagcaggtgaatgtcacttacggccatatgcccgtctttcaacaccatacctcccacacggtgaggcaatctagagagaccggggagaaactgatggaatgtcacgaatgcggcaaagccttctccagaggctctcacctaatccagcatcagaagatccatactggcgagaaaccctttggatgtaaagagtgcggaaaagcatttagccgcgcaagccatcttgtccagcatcagagaatccataccggcgagaagccctatgattgcaaggactgcggtaaggcattcggccgtacatctgaattaatcctccaccagaggctacacactggcgtcaaaccctatgagtgcaaagagtgtggcaaaacttttcgtcagcactcccagttgatcctccatcaacgcacacacaccggtgagaaaccctacgtttgcaaagactgcggcaaagccttcatcagaggatcacagctgaccgtacatagacgaattcacactggagctagaccttatgagtgcaaggaatgcggtaaagcgtttcggcagcactcccagctcacagttcaccagagaatccatactggggagaaaccgtatgagtgcaaggagtgcgggaagggatttatacattccagcgaagttaccaggcatcagagaatccattcaggcgaaaagccttatgagtgcaaagagtgtggaaaggctttccggcaacacgctcaacttacacgccaccagcgggtccatacaggggacagaccttacgagtgtaaagactgtggcaaagccttctctaggtcttcatatttgattcagcatcagcgcattcacacgggcgataaaccctacgagtgcaaggaatgcggaaaagccttcatcagggttagccaattgacacatcatcagaggatccatacttgtgagaagccgtacgagtgtcgagagtgtgggatggcatttatccgttcttcccagctgactgagcaccagaggatccacccggggattaagccatacgagtgtcgggagtgcgggcaggcgttcatactgggatcccagctcatcgaacattataggatacacaccggctag

SEQ ID NO: 141497 - DNA, 2061 bp, Artificial Sequence
  Description of Artificial Sequence: Synthetic coding sequence
atgacagagtcacagggcacagttaccttcaaggacgtggcaatcgattttacccaagaggagtggaagcgtctggatccagcgcagcgtaagctgtaccggaatgttatgctggaaaactataataatctgatcaccgtggggtacccttttaccaagcccgacgtgattttcaaactggaacaggaagaggaaccatgggtaatggaggaggaggtcctgcggcgccattggcagggcgagatctggggtgttgacgagcaccagaagaaccaggatcggttactgcgccaggtcgaggttaagtttcagaagaccttgaccgaggagaaggggaacgaatgccagaagaaattcgcgaatgtcttcccactgaattccgacttcttcccaagccggcacaatctgtacgagtatgacctgtttggcaaatgcctcgagcacaatttcgactgccacaataatgtgaagtgcctgatgaggaaggagcattgcgagtacaacgagcctgtgaaatcgtacggaaattccagcagtcacttcgtcatcacgccttttaagtgtaatcactgcggcaaggggttcaatcagacgctggatttgatccggcatctccgtatccacaccggtgagaaaccctacgaatgcagcaattgtaggaaagctttttcgcacaaggaaaaactaattaaacattataagatacattctagagaacagtcatacaagtgtaatgaatgcggcaaggcattcattaaaatgagtaacctgatccgccaccagcgcatacacacaggtgaaaagccctacgcttgcaaggagtgtgaaaagagctttagccagaagagcaatctgattgaccacgagaaaattcatactggagaaaagccctatgaatgcaatgagtgcggcaaggcgttttctcagaagcagagcctgatcgctcatcagaaggtgcacaccggagaaaaaccttacgcctgcaacgaatgtggaaaggcgtttcctcgaatagcttccttagctctgcatatgcggtcccacacaggcgaaaagccatacaagtgcgataaatgcggaaaggctttctcccagtttagcatgcttatcattcacgtgcgaattcacacaggagaaaagccctatgagtgcaacgagtgcggcaaggctttttcccagtctagcgctctgaccgtgcacatgagatcccataccggagagaagccatacgaatgcaaggaatgtagaaaggccttttctcacaaaaagaactttatcactcatcagaaaatccacactagagaaaagccctatgaatgtaacgaatgtggtaaggctttcatccagatgtcaaacctcgtgcgacaccagaggattcacaccggggagaaaccttatatctgcaaggagtgtggaaaggcattttcccagaaatccaatctgatcgcccacgagaaaattcacagcggggagaagccgtacgaatgtaatgagtgcggcaaagctttttcccagaagcagaactttataactcaccagaaggtgcatactggcgaaaaaccatatgattgcaacgagtgcggaaaagccttctctcagattgcaagtttgaccctccatttacgcagtcacacgggcgagaaaccctatgagtgtgacaaatgtggtaaagcattttcacagtgttccctgctgaaccttcatatgcgttcccacacaggcgaaaagccctacgtgtgtaacgagtgtgggaaggccttcagccaaaggacaagcctgattgtacatatgcggggtcacaccggagaaaaaccttatgagtgcaacaagtgcggaaaagcattctctcagtcctcgagtttgaccattcatatccgtggacacactggagagaaacctttcgactgctccaaatgcggcaaggcattcagtcagatttccagtcttaccctgcacatgcggaaacataccggtgagaagccctaccattgtattgagtgtggcaaggccttctcccaaaagtcacacctcgtccgacatcaaagaatacacactcattag

SEQ ID NO: 141498 - DNA, 1029 bp, Artificial Sequence
  Description of Artificial Sequence: Synthetic coding sequence
atgaggtctcacaccggggaaaaaccgtacaagtgtgacaagtgtggaaaggccttcagccagttttccatgctgatcatccacgtgcgcatccacaccggcgaaaagccctacgagtgtaacgagtgtggcaaggccttctcccagagcagtgccttgacagtccatatgcggagtcacaccggtgagaaaccatatgagtgcaaagaatgtcgaaaagcctttagccacaaaaagaattttattactcaccaaaaaatacatacacgtgagaaaccttacgaatgtaatgaatgtggaaaggcgttcatccagatgagtaatcttgtccggcaccaacgaatacatacgggcgaaaagccttacatttgcaaggagtgtggtaaagcttttagccagaagagcaacctcatagcgcatgagaaaattcattctggagagaaaccatacgaatgcaacgagtgtggcaaagccttctctcaaaaacaaaattttataacccaccagaaagtgcacaccggagagaagccttacgattgtaatgaatgcggaaaggcctttagccagattgccagtcttacactccacctgcgttctcataccggcgagaagccttatgagtgcgataagtgcggcaaggcattcagccagtgttccctgctcaatcttcatatgcgtagtcacacgggagagaaaccgtatgtttgcaacgaatgtggaaaagcgttcagccagcgaacatcactgatagttcacatgagggggcacactggcgaaaagccgtacgagtgtaataagtgtggtaaggccttctctcagtcttctagtttgactatccacatccggggccacacgggagaaaaacctttcgactgctcaaaatgcggtaaggccttcagccagatctcctcgctgactcttcacatgagaaaacacactggggagaaaccctaccactgcatcgaatgtggaaaggcgtttagccagaagagccatcttgtccggcatcaaaggattcacacacattag

SEQ ID NO: 141499 - DNA, 1584 bp, Artificial Sequence
  Description of Artificial Sequence: Synthetic coding sequence
atgcggaaggaacattgcgagtacaatgagcccgtgaagtcatatggtaacagcagcagccatttcgtcattaccccttttaagtgcaaccattgtggaaaaggctttaaccagacccttgatcttatccggcacctccgtatccatactggggaaaagccatatgaatgctctaattgccgcaaggcttttagtcacaaagagaagttgattaagcactataagattcacagccgagaacagtcctacaaatgcaacgaatgcggaaaggccttcatcaagatgtccaatttgatcagacaccagagaattcatactggcgagaagccttatgcctgcaaagagtgcgagaaatcttttagtcagaagtctaatctgatcgaccacgagaagatccatacgggagaaaagccctacgaatgcaacgaatgcggtaaggcttttagccagaagcagagtctgatcgcccatcagaaagtccacaccggcgagaagccctacgcatgcaatgaatgtggcaaggcgtttcctagaatcgcttcattggccctgcacatgcgatcacatacaggcgaaaagccctacaagtgcgataagtgtgggaaggctttctctcaatttagcatgcttataatccatgtgcgcatccacaccggggagaagccttacgagtgcaatgaatgtggcaaggctttcagtcagtcgtcagccctgacagtgcacatgaggtctcacaccggtgaaaagccttacgaatgtaaagaatgtcgcaaagcttttagtcataaaaaaaatttcattactcaccaaaagatccatacaagggagaagccctacgaatgcaacgagtgtggaaaagcatttattcaaatgtccaacctcgtgcgccaccaacgaatccataccggggaaaaaccatatatttgtaaagaatgtgggaaggcctttagccagaaatccaatctcattgcacacgagaaaattcacagtggtgagaaaccctatgaatgcaatgaatgcggaaaagccttctcacaaaagcaaaactttatcacacaccaaaaggtccatacaggcgagaaaccttacgattgcaatgaatgcggtaaagctttcagtcagatagcttccttaacactccacttgagatcccacacgggggaaaagccttacgaatgcgataagtgtgggaaggcgttcagccagtgttccctgctcaaccttcatatgcgttctcacaccggggagaagccctacgtctgcaacgaatgcggcaaagctttttcccaacgcacatccctcatcgtccatatgcgcggccatactggcgagaaaccttacgaatgcaacaagtgcggcaaagccttttcccagtccagcagcctaactatccacattaggggacacaccggcgaaaagccatttgattgctcaaaatgtggcaaagcatttagccagatatcaagtctgaccctccacatgaggaaacataccggcgagaaaccctaccactgtatcgagtgcggcaaggccttctctcaaaaaagccatctggtgcgacatcaacggattcatacccattag

SEQ ID NO: 141500 - DNA, 1551 bp, Artificial Sequence
  Description of Artificial Sequence: Synthetic coding sequence
atgtttgagcagctgaagcccattgagccccgagactgttggagggaagccagagtcaagaaaaaacctgtaacatttgaggacgtagcggtgaatttcacacaagaagagtgggactgcctggacgcatcacagcgtgttctgtaccaggatgtaatgtccgaaaccttcaagaatcttacatccgtggcccggatattcctgcacaagcccgagttgatcacgaagttggaacaggaggaagagcagtggagggaattcgtccacctcccaaataccgaagggctgtcagagggcaaaaagaaggagctgcgcgagcagcacccgtctctgcgtgatgagggaacttccgatgataaggtcttcctggcttgcagaggagcaggtcagtgtccactctctgccccagcggggacaatggaccggaccagagtcctacaggcatcacaagctggccccccttttttctgctatacttgtggcaaatgcttttcaagacggagttacctgtacagtcatcagttcgtacataatcccaagttaactaacagctgtagccaatgcgggaaactcttcaggagtcccaagagcctgtcctaccatcggaggatgcatctgggggagcggccgttctgctgtaccctgtgcgacaaaacctactgcgacgcctccggcctttctaggcaccggcgcgtccaccttggctacaggccgcatagctgctccgtctgcgggaagagcttcagggaccagagtgagctgaagaggcatcaaaagattcaccaaaatcaggaaccggtcgatgggaaccaggagtgcacactgcgtatcccgggcactcaggctgagtttcagaccccaattgctagatcccagaggtccatccagggtttacttgacgtcaatcatgctccagtggcaaggagtcaggagccaatctttcggacggaggggcccatggctcagaaccaggcctctgtgcttaagaaccaggcgccagtgactcgaactcaagcgcccatcaccggcactctgtgtcaggatgcccggtctaacagtcacccagtgaaacctagccgtcttaatgttttttgctgcccccactgtagtttaacctttagcaagaaatcctaccttagtaggcatcaaaaggcccacctgacagaacccccaaactactgcttccactgttctaagtctttttcttctttctcgaggctggtgaggcaccagcagacgcactggaagcagaagagttatctctgtcctatatgtgacctgtctttcggtgaaaaggaggggctcatggaccactggagggggtacaagggaaaggacctctgccaatcatcacaccacaagtgtcgcgtcattctcggccaatggttgggattctctcacgatgtcccaactatggccggggaagaatggaagcatggtggagaccaatcccctcctagaattcatacccctcggcgcaggggtctgcgggagaaagcttgtaaaggggacaaaactaaggaggccgtgagcatactgaaacataagtag

SEQ ID NO: 141501 - DNA, 1551 bp, Artificial Sequence
  Description of Artificial Sequence: Synthetic coding sequence
atgtttgagcagttaaagccaatcgaacccagagactgctggcgggaggctagagtgaaaaaaaagccagtgaccttcgaggatgtggctgtcaacttcactcaggaggagtgggactgccttgacgcatctcagcgggtgttatatcaggacgtgatgagcgagacatttaaaaacttgacaagtgtggccagaattttcttgcacaaaccagagcttataacaaagctcgagcaggaggaagagcagtggagagagtttgtgcacctgcctaatacggaaggcctgtctgagggaaagaagaaggagctccgtgaacagcatccatccttaagagacgaagggacatcagacgataaggtgtttctcgcatgtcgaggcgcaggacagtgtcctctgtcagcgcccgccggtactatggaccgtacgcgggtgctgcaggcttcccaggctggaccacctttcttctgctacacctgcggaaagtgttttagccgccgcagctatctgtattcccatcagtttgtacacaatcccaagctcactaattcctgctctcagtgcggcaagctgtttcgctccccaaagagcctttcataccaccggaggatgcatcttggagaacgcccgttttgttgcaccctgtgcgacaagacttattgtgacgccagtggcttgtcccgacatagaagggttcatttaggctatcgtccccactcatgcagcgtgtgtgggaagtccttccgggatcagtccgagctgaagagacaccagaaaattcatcagaatcaggaacctgtagacggcaatcaagagtgtaccttacggattcctggcacccaggcagagtttcagacccctatcgccaggtcccagcggtctattcagggcctcctcgacgtgaatcatgcccccgtggcccgctcccaggagcccatcttccggacagaaggacctatggcccagaaccaagccagcgttctcaaaaaccaagcacctgttacgaggacacaggcgccaattacaggtacgctgtgccaggatgcacgatccaacagtcaccccgtgaagccatcccggctgaacgttttctgttgccctcattgtagcctgactttctcaaagaaaagctacctctcccgacaccaaaaggcccacctaacagagcctcccaactactgtttccactgcagcaagtcctttagttcattcagtcgtctggttcgccaccagcagacccactggaagcagaagagctatctctgcccaatttgcgatctcagtttcggggagaaagaggggttgatggaccactggcggggctacaaaggaaaggacctgtgccagagcagccatcacaaatgtagggtgattcttgggcagtggctgggcttcagccatgacgttcctaccatggccggagaggagtggaagcatgggggggatcagtcaccaccgcggattcacactcctaggaggagaggcttacgggagaaggcttgcaaaggggacaagacaaaagaagctgtgtcaattttaaagcataagtag

SEQ ID NO: 141502 - DNA, 1551 bp, Artificial Sequence
  Description of Artificial Sequence: Synthetic coding sequence
atgttcgaacagctgaagcctattgaaccaagggattgctggcgggaggctagggtaaaaaagaaacctgtcactttcgaggacgtggctgtgaatttcacccaggaggagtgggactgccttgatgcctcgcagcgagtgttgtaccaagacgtgatgtccgaaacattcaagaacctcacttccgtcgcccgtattttccttcataaacccgaacttatcaccaaactcgagcaagaagaggagcagtggagagaatttgtgcatctgccaaacactgagggtctctctgagggaaaaaagaaggagctaagagagcagcaccctagtctgagagacgaggggacttctgacgataaggttttccttgcgtgccggggggcaggccaatgtcctctctcagcacccgctgggacaatggacagaactagggtactacaagcaagccaagccgggccgcctttcttctgctacacctgcggtaagtgctttagtcgcaggtcttatctctatagccatcagtttgtgcacaacccaaagctcacaaattcgtgcagtcagtgcggtaagctgtttaggagccccaaatccctctcttaccataggcgaatgcacctgggcgaacgccctttttgctgcactctgtgtgacaagacatactgcgatgcttcaggtttgagcaggcatagacgagtgcacctgggctaccgaccacatagctgttccgtgtgcggcaagagcttcagggatcagtccgaactgaagcgccatcaaaaaattcatcagaaccaggaaccagtggacggcaaccaggagtgcacactccgaattcccgggacgcaggccgagttccaaacgccgatagcacgcagccagcgatctatccaaggcctgctggatgttaatcacgcgccagtggccagatcgcaggagccaattttccggaccgagggccctatggctcaaaatcaggccagtgttctcaaaaatcaagcccccgtaactaggacccaggcaccgattacaggtaccttgtgtcaggacgccagatcaaactcacatccagtaaaaccctcaagactgaatgtgttctgttgcccacattgctccttaacatttagcaagaagtcatatttgtcaagacaccaaaaggcccacttgaccgagcctccaaactactgctttcactgcagtaaaagctttagctcattctcaaggctggtcagacaccagcaaacccactggaagcagaaatcctatctatgcccaatctgtgatctaagctttggagagaaagaagggctcatggatcattggagagggtacaaaggcaaggatctttgtcagtcctctcatcacaaatgtagggtcattctcggccagtggctcgggttctcacacgatgtgccaacgatggcaggcgaagagtggaagcacggcggcgatcagagccctcctagaatacacacccctagacgtcgaggtctccgagaaaaagcctgcaagggggacaagactaaagaagcggttagcatcctgaaacacaagtag

SEQ ID NO: 141503 - DNA, 1551 bp, Artificial Sequence
  Description of Artificial Sequence: Synthetic coding sequence
atgtttgaacagctgaaacccattgaacctagggactgttggagagaggcccgggtgaaaaaaaaacccgtgacctttgaggatgtggctgtcaatttcacgcaggaagagtgggattgcttagacgcatcccagcgcgtcttgtatcaagatgtaatgagcgagacttttaaaaacctgacatccgtagctcgaatctttttgcacaaacccgagttgatcaccaaattggaacaggaggaggaacaatggcgggagttcgttcacttgcctaataccgaaggactgtccgagggcaagaagaaagagctgcgggagcagcatccctctttacgcgacgaggggacctctgatgataaagtgttcttagcatgccgcggagcggggcaatgtccactgagcgcaccagccggaacgatggaccggaccagagtcctgcaagctagtcaggcaggacctcctttcttctgttatacctgcggaaagtgctttagcagaagatcgtatctctattcacatcagtttgtgcataatccgaaactaaccaattcctgtagccagtgtggcaagctgtttcgttcgcctaagtccctgtcataccataggagaatgcatctgggagagagacctttctgttgcactctctgtgacaaaacctattgtgacgcctcggggcttagtcgccatagacgcgtgcatctggggtatagacctcactcgtgctccgtgtgcgggaagagttttagagatcaatcagagctcaagcgtcatcagaagatccatcaaaaccaggaaccagtcgacggcaaccaggaatgtaccctgcgtattccaggaacccaggctgagttccagacgccaatagccagatcacagcgtagcatccagggcctgctggatgtgaatcacgctccagtggcgcgcagccaggaacccatctttcggacagaaggcccaatggcacagaatcaggctagcgtgttgaagaatcaggccccggtgacacggacacaggcccctataacaggtactctttgtcaagatgcaaggtctaactcacatcccgtcaagccatctcggctgaacgtcttttgttgtccacactgcagcctgactttttcaaagaaaagttatctgtccaggcatcagaaggcccatctcactgaaccaccaaattactgttttcattgctccaagagtttctcgtctttctcaagactggtcaggcatcagcagacacactggaagcagaaaagttacctttgcccaatctgcgacctgagcttcggagagaaggaaggcctaatggatcactggaggggctataaagggaaggacttatgccagtctagtcaccataaatgcagagttatcctaggtcagtggttgggcttttcgcacgacgtgcctaccatggccggtgaagaatggaaacatgggggcgatcagtcaccccccagaatccatacgcctcgaaggagggggctgagggaaaaggcctgcaaaggcgataaaacgaaagaagcggtctccatactcaagcacaaatag

SEQ ID NO: 141504 - DNA, 636 bp, Artificial Sequence
  Description of Artificial Sequence: Synthetic coding sequence
taggcccggtcccaggaacctattttcaggaccgaaggcccaatggcccaaaaccaagcatccgtgctgaaaaaccaagcccccgtgacacggacacaggcacccatcacaggaactctctgccaggatgcccgaagcaattcccatcccgttaagccatcccgccttaatgtgttttgctgccctcactgcagcttaacatttagtaagaaaagttacttaagcaggcatcaaaaagcccacctgaccgagcctccgaattactgctttcactgtagtaagtctttttcaagtttttcacggctggtgcgacaccaacagactcactggaaacagaagagctacctgtgtccgatatgcgatttgtctttcggcgagaaagaaggtctgatggaccattggcggggatacaagggtaaggatctctgccagagctctcatcacaaatgtagggtgattttagggcagtggctgggtttttcacatgatgtgcccaccatggctggagaggaatggaagcacggtggcgaccagtcgcccccgagaatccacactccccgacgcagaggactcagagagaaggcctgtaaaggcgataaaaccaaggaagcagtaagtatcctcaagcataagtag

SEQ ID NO: 141505 - DNA, 1551 bp, Artificial Sequence
  Description of Artificial Sequence: Synthetic coding sequence
atgttcgaacagctgaaaccaattgagccaagagactgctggagagaggcaagagttaagaaaaagcctgtcactttcgaagacgtggccgtgaacttcactcaggaggagtgggactgccttgatgccagccagcgggtgttgtaccaagatgtaatgagcgaaacgtttaaaaacctaactagcgtggcccgaattttcttacataaacctgaacttattaccaaacttgaacaagaggaggagcagtggcgagaattcgtccacctgccaaacacggaaggcttaagtgaagggaaaaagaaggagttaagagaacagcaccctagtctccgcgacgaagggaccagcgacgataaagtgtttctggcatgccgaggtgctgggcagtgtccactctctgcacctgccggaaccatggatcggacaagagtactacaagcgagccaggcaggccccccatttttctgctatacctgtgggaaatgtttcagtcggcgctcctacttgtacagccatcagttcgtgcacaaccctaaattgactaacagctgctcccagtgtgggaagctgttccgatcccctaagtcactatcctatcaccgcagaatgcacctgggggagagacccttctgctgtaccctgtgtgataagacatattgtgacgcttcggggctctcgagacacaggcgtgtgcacttgggctataggccccactcctgtagcgtttgtggtaaatccttccgcgaccaaagcgaactcaagagacaccagaagattcaccagaatcaggaacctgtggacgggaatcaggagtgcacattaagaataccaggcacccaagctgagttccagacaccaatcgcccggtcccagcggtctatccagggcttgttggatgtcaaccatgcccctgtggcccgatcacaggaaccaatcttcagaaccgaaggacccatggcccagaatcaagcctctgtactcaaaaaccaagctccggtaacgaggacacaggctcctatcacagggacactctgccaggacgctcgaagtaattcccacccggtgaagccttctcgcctgaacgtgttttgctgcccacattgtagcctgacattttctaaaaagtcttatctgtctagacaccagaaggcccatctgaccgagcctcccaattattgttttcattgtagcaaatccttctcatctttttctcgtctggtcagacaccagcagacacactggaaacagaagtcctatctttgccccatatgcgacctcagtttcggagaaaaagaagggctgatggaccactggagagggtataaaggaaaagatttgtgtcaatccagtcaccataagtgtcgagtcattttagggcagtggctcggtttttctcatgacgtgcctacgatggcaggagaggaatggaagcacgggggagaccaatcgcctcctagaatccacaccccccggcggcggggtctcagggagaaggcctgtaaaggagacaagacaaaggaggccgtgtctatcctcaaacacaaatag

SEQ ID NO: 141506 - DNA, 1551 bp, Artificial Sequence
  Description of Artificial Sequence: Synthetic coding sequence
atgttcgaacagttgaagcctattgaaccgagagactgctggagggaagcccgggtgaaaaagaagcccgtcaccttcgaggatgttgcagttaatttcactcaagaagagtgggactgcctggatgcaagtcagcgggtgctgtaccaggacgtgatgagcgagactttcaagaatctcacatccgtggctagaatctttctccacaagcctgagttgatcaccaaactggaacaggaggaggaacagtggcgcgagtttgtgcacctgcctaatacagaaggtctgagcgaggggaagaaaaaggaactgagggaacagcacccatccctcagggacgaaggcacgtcagatgataaggtgtttttagcctgccggggtgcaggtcagtgtcctctatctgctccagccggaacgatggataggaccagagtcctgcaggccagtcaggctggccctcccttcttctgctatacgtgtggcaagtgtttctccaggagaagctacctttactctcaccagttcgtgcacaatccaaagctgaccaactcttgttcccagtgcggcaaactattccgcagccctaagtccctttcctatcaccggcggatgcatcttggggagcgcccattctgctgcacactctgtgataaaacctactgcgacgcctctgggcttagtagacacaggcgagttcatctgggttatcgtcctcatagctgcagtgtttgtggaaaaagcttcagggatcagtccgaacttaagagacaccaaaaaattcatcaaaatcaagaaccagtggacggcaaccaggagtgcacgctgaggatccctggaacccaggccgagtttcagactcccatcgcccggtcccagcggtccatacagggactgctcgacgttaaccacgcacccgttgcccggtcccaggagcctattttccgcacagagggaccgatggcccaaaatcaggcctctgtcttgaagaatcaggccccggttaccagaactcaagcaccgataacaggaacactttgccaggacgcgcgtagcaactctcatcctgtcaagccttcaaggctgaatgtgttctgttgtccgcattgtagcttgacattctcaaaaaagagttacctgagtaggcaccagaaggcacacctgactgagcctccaaattattgcttccattgctccaagagcttcagcagcttttctcgcctggtccgccatcagcagacccattggaagcagaagagttacctctgcccgatttgtgatctgagcttcggagagaaggagggattgatggatcattggcgcgggtataaggggaaagatttgtgtcaatcctcccaccacaagtgtagggtgattctggggcagtggctggggttctcccacgacgtccctacgatggcaggggaggagtggaagcatggtggggatcaatccccacccagaatccatactccccgcagacgggggctgagagaaaaggcctgtaagggggataaaaccaaagaagcggtcagcattctgaaacataagtag

SEQ ID NO: 141507 - DNA, 1551 bp, Artificial Sequence
  Description of Artificial Sequence: Synthetic coding sequence
atgttcgagcaactcaagccgattgagcctagagactgctggagagaagctagagtcaagaaaaaacctgtcacttttgaagacgtagctgtgaacttcacccaggaagaatgggactgtttggacgccagtcagcgagtgctgtatcaggacgtgatgtcggagacgttcaagaacctcacttccgtggccagaatctttctccacaaaccagaattaatcaccaagctggaacaggaggaggagcagtggcgggagttcgtacacttaccgaacaccgagggcttatctgaggggaaaaaaaaggaactgcgcgaacaacacccttcactacgtgatgaagggacatccgacgacaaggtcttccttgcctgccggggtgcaggccagtgccccttaagcgcccctgcaggaaccatggaccgcaccagggtgttgcaggcctcgcaggcaggcccccctttcttctgctatacgtgcggaaaatgcttttcacggcggagttatctgtattctcaccagttcgttcacaatcccaagttgacaaactcatgcagtcagtgtggcaagctgttcagatcacctaagagtctgtcataccaccggaggatgcacctgggagaacggcctttttgctgcacactgtgcgacaaaacctattgcgatgccagcggcctgagcaggcaccgcagggtacatcttggctacagaccgcactcatgctctgtgtgtggcaagagtttccgggatcaaagcgagctcaaacgccatcaaaagatccaccagaatcaggaacccgtggatggcaaccaggagtgcacactgcgcatccccgggacccaggccgagttccagactcccatagctcgatcccagagaagtatccaggggctcttggatgttaaccatgccccggtcgctcgatcccaagagcctatattccgaactgaaggcccgatggctcagaatcaggccagcgtgctaaagaatcaagctccggttacacgcacacaggcgcctattaccggaacgctgtgccaggacgcgaggagtaattctcatcccgtaaaacctagccgtctcaatgttttctgctgcccacattgttccctcacattcagcaaaaaatcctacctgagtcggcatcaaaaagcgcaccttactgagcccccaaactattgctttcactgttccaagtcttttagctccttctcccgccttgtgcggcaccagcaaacgcattggaagcagaagagctacctctgtcccatctgcgacctgagctttggcgaaaaagaaggcctcatggaccattggcggggctataaaggcaaagatctatgccaaagttcacatcataaatgtagggttatcctcgggcagtggttaggcttcagccacgacgtgcccacaatggctggtgaggaatggaagcacgggggagatcaaagcccccctagaattcatacaccacgccgcagaggcttgcgcgagaaggcatgtaagggggataagactaaagaagcggtgagtatactcaaacataaatag

SEQ ID NO: 141508 - DNA, 1551 bp, Artificial Sequence
  Description of Artificial Sequence: Synthetic coding sequence
atgtttgagcagctgaaaccaatcgaacctagggattgttggcgggaagccagagtaaaaaagaaacctgtaacttttgaggacgtcgctgttaattttacgcaggaggaatgggactgcctggatgcatcacaacgcgttctttaccaggatgtaatgtccgaaactttcaaaaatctcactagtgtggcccggatctttctccacaaaccagagcttattactaagttagagcaggaagaggagcaatggagagagttcgtgcacctgcccaacactgaggggctttcagaaggcaagaaaaaagagctccgcgaacagcacccaagcctgcgcgacgagggaacaagtgatgacaaagttttcctggcttgtcgcggcgctggccagtgccccctttctgccccagctggcacgatggatagaaccagagtgctgcaagcaagccaggctggacctcctttcttctgctatacatgtggaaaatgcttctcccggcgctcttacctttattctcatcagtttgttcacaaccccaagcttacaaactcatgctctcagtgcggcaaactcttcaggtccccgaaatccctgagttatcatagaaggatgcacttgggagaacgcccattttgctgcacactctgtgataaaacctattgtgatgcatccggcctctctcggcacaggagagtgcacctgggctatcgcccgcatagttgcagtgtttgcggaaaaagctttagagaccagtctgagcttaagcggcaccagaagatccatcaaaaccaagagcccgtcgacggtaaccaggagtgtactttgagaatacccggaacacaagcggagtttcagactccaattgcaaggtcacagcggtccatccagggcctccttgatgtgaaccacgctccagttgcgagatcccaggagccaattttcaggacagagggaccgatggcccagaatcaagccagcgtcctcaaaaatcaagcccccgtcactcggactcaggctcctatcaccggcacactgtgccaggatgcccgcagtaattcacacccagttaagcctagcagattaaatgtgttttgctgtccccactgttcgttaacctttagtaaaaaaagctatctgtccagacatcagaaggcccatctgacagaaccgccaaactattgtttccactgcagcaagagtttttcatcttttagcaggctcgtgcgccaccagcagactcactggaaacagaagtcctatctctgtcctatctgcgatctgtcttttggggaaaaagagggactaatggaccactggagaggttacaaggggaaggacctctgccagtcctctcaccacaagtgccgcgtgatcctgggtcagtggttgggcttctctcacgatgtcccaactatggctggggaggagtggaagcatgggggcgaccagtctccaccaaggatacataccccaaggcggcgcgggctgcgtgaaaaggcctgcaagggagacaaaaccaaagaagccgtctcaattctgaagcacaagtag

SEQ ID NO: 141509 - DNA, 1611 bp, Artificial Sequence
  Description of Artificial Sequence: Synthetic coding sequence
atgttcgagcagcttaagcccattgagcccgtccaaaagactcttccatgggtaggggaggtggctgcaacactgcaggaggctatgaagagggattgttggcgcgaggcacgggttaagaagaaacccgtgacatttgaagatgtggctgtgaatttcactcaagaggaatgggactgtttggatgcttcccagcgggttctttaccaggatgtcatgagcgaaacgtttaaaaatttaacatccgtggctcgaatattcttacacaagccagaactaattacaaagctcgaacaggaggaggaacagtggcgcgagtttgtgcatttgcccaatactgaggggctctctgagggcaagaaaaaagaactgcgggaacaacatcccagcttgagagatgaggggacctctgacgacaaggtgttcctggcctgtcggggggcgggtcagtgccccctttccgcccctgccgggactatggacagaactcgggtgctgcaggcatcccaggccgggcctccctttttttgttacacctgtggcaagtgcttctcacgccgatcttacctgtactctcatcagttcgtacataatccaaagctgactaattcttgctcccaatgcggcaagctctttagatcccccaagtctttaagttatcataggaggatgcaccttggggaaagaccattttgttgcacactttgcgataagacgtattgcgacgcttcagggcttagtagacacagacgcgttcatcttggatatcgcccccactcttgcagtgtatgtggtaaaagtttccgcgaccagtccgaactaaagcggcaccagaagatccaccaaaatcaggaaccggtggacggtaaccaagagtgcacgttgcgtatccccggcacgcaggcggagttccagaccccgatcgcaagatctcagaggagcattcaggggcttcttgatgtgaatcatgccccagtggccagatcccaggagccaatcttccgcactgaaggtccaatggcccagaatcaggcctctgtactcaaaaaccaggctcctgtgactagaactcaggccccgattaccggcaccttgtgtcaggacgctaggtccaactcgcacccggttaagcctagtaggctgaatgtgttttgctgcccacactgctccttgactttcagcaaaaagtcgtatctgtcaaggcatcagaaggctcacctcacagagccccctaattactgttttcactgttcgaaatccttttccagtttcagccgactggtgaggcatcagcagacccattggaaacagaaatcctatctgtgtccgatatgcgacctgagctttggtgagaaggaaggattgatggaccactggaggggctataaaggaaaagacctctgtcagagcagtcatcataagtgcagagtgatcctcggacaatggctgggtttttcccatgacgtgccaacaatggccggagaagaatggaagcatggtggcgatcaaagcccacctcgcatccatacgccccggagacggggattaagggaaaaggcctgtaaaggggataaaactaaggaagcagtaagcatacttaagcacaagtag

SEQ ID NO: 141510 - DNA, 1551 bp, Artificial Sequence
  Description of Artificial Sequence: Synthetic coding sequence
atgtttgagcagctcaaacctattgagcctcgtgattgctggagagaggccagggtgaagaaaaagcctgtgaccttcgaagacgtagccgtcaactttacacaggaagagtgggattgtctggatgcatcccaacgcgtattgtaccaggacgtaatgtcagaaacgtttaaaaatctgactagcgtggcccgcatattcctgcacaaacctgagctgatcaccaagctcgaacaagaagaggagcagtggcgcgaattcgtgcacctgcccaacaccgagggcctctccgaggggaaaaagaaggagctgagagaacagcatccatccctaagggatgagggaactagcgatgacaaggtcttcttggcttgccgcggagctggtcaatgtcctctttccgcccccgccgggactatggataggacacgcgttctgcaggcttctcaggctggtccgccgttcttctgctacacatgtggaaaatgcttttccaggcgaagctacttgtactctcatcagttcgtccataatcccaagctgactaacagctgctctcagtgcggtaaactgttcaggtctcccaaatcactcagttatcacagaaggatgcacctgggggagcggcctttctgttgtaccctgtgtgataagacctactgtgatgcttcaggtctgagcagacacagacgggtgcatttggggtaccgaccgcattcttgcagcgtctgcgggaaatcatttagggatcagtccgagttaaaaaggcaccagaagatacaccagaaccaggaaccagtggacgggaatcaggagtgtacgttgagaattccaggaacgcaggctgagttccagacacccatagcccggtcccaaaggagtatacaaggcctactggacgtgaaccacgctccagtagcgagatcccaggaaccgatttttcgtacagaagggccgatggcccagaatcaagctagtgtcttaaaaaaccaggcacctgtgacacgcacccaggcccccataacagggactctgtgtcaagatgcgcggtctaactcccatcccgtcaagccttccaggctcaacgtcttctgctgtccccattgttccttaactttctctaaaaagagctacttgagtcgtcatcagaaagctcacttgaccgagcccccaaactattgcttccactgtagcaagagtttctccagcttttccagattagtgcgccatcagcagacacactggaagcagaagagttacctatgtcctatttgcgatctgtcttttggcgagaaagaagggctgatggatcactggagaggctataaaggcaaagatttgtgccagtcttctcatcataagtgtagagtcatcctcgggcaatggttgggctttagccatgacgtgcctactatggccggcgaagagtggaagcatggcggtgatcagtcaccaccacgtatccacactccccgcaggcgggggctgcgcgagaaggcctgcaagggagataaaactaaagaggctgtgtccattcttaagcataaatag

SEQ ID NO: 141511 - DNA, 1356 bp, Artificial Sequence
  Description of Artificial Sequence: Synthetic coding sequence
gcgggcggctcaccagaaagcctgttgttctttcagaagcccgtgacttttgaagatgtggcagtgaactttacacaggaggagtgggactgcttggatgcctcccagcgcgtgctctaccaggacgtaatgtccgaaaccttcaaaaacttaacatccgtggcacgaatcttcctccataagccagaacttatcactaaacttgagcaggaagaggagcagtggcgcgagacccgcgtgttgcaggcaagccaggctggacctccatttttttgttacacttgtggaaaatgtttttctcgccgatcttatctgtactcacaccaatttgttcataaccctaaactgaccaatagctgctctcagtgtggaaagcttttccggagccccaaatcattatcttaccacagaagaatgcatctgggtgagcgccccttttgttgcacactctgtgataagacttactgtgacgcctcgggactttccagacatcgccgagtacacctgggctaccgtccccatagctgctccgtttgcgggaagtccttcagggatcaatcagagctcaagagacatcagaaaattcaccagaaccaggagccagtggacgggaatcaggaatgtactttacgcataccaggtactcaggcagagtttcagacccccattgctcgaagtcagagatcgattcagggacttcttgacgttaaccatgcccccgtggcaagaagtcaagaacccatattccggactgaaggccctatggcgcagaatcaggcctcagtgcttaagaatcaagcaccggtgacacgtacgcaggcgcccatcaccggcactctgtgtcaagacgcacggtcaaattctcatccggtgaaaccaagcaggctcaatgtattctgctgccctcactgctctctgacatttagcaagaaatcttatctgtccagacaccaaaaagcccatctgaccgagccacctaattattgttttcattgcagcaagagtttctctagcttcagcagactcgtccgacaccagcagacccactggaagcagaagagctatctgtgtcctatctgcgacctcagcttcggtgagaaggaggggctgatggaccattggaggggatacaagggcaaggatctctgtcagtcttcacaccacaagtgtagagtcatcctcggtcagtggttgggattcagccacgacgtgcccaccatggctggcgaggaatggaaacatggaggagaccagtccccccctagaatacacacacctagaagaaggggccttcgggaaaaggcctgtaaaggcgataagacgaaagaggcggtttccattctcaaacacaaatag

SEQ ID NO: 141512 - DNA, 1551 bp, Artificial Sequence
  Description of Artificial Sequence: Synthetic coding sequence
atgttcgaacagctaaagccgattgaaccaagagactgttggagagaggcccgagtcaagaagaagcctgtcaccttcgaagatgttgccgtcaattttacacaggaggagtgggactgcttggacgctagccagagggtgttgtaccaagacgttatgagcgagaccttcaagaacctaacaagtgtggcccgaatctttctccacaagcctgagctgattaccaaactcgagcaggaggaggaacagtggagagaattcgtacatctgccaaataccgagggattgtccgaggggaaaaaaaaggaattgcgagagcagcatccttctctgagggacgaaggcactagcgatgataaggtgttccttgcttgccggggcgctggacagtgtccgctaagtgccccagcagggaccatggacaggacacgggttttacaggcctcgcaggccggaccgcccttcttttgctacacgtgcggcaagtgcttctcacggcgctcttacttgtacagccatcagtttgtgcataaccccaaactgacgaacagctgtagccagtgcggaaagttgttccgcagccccaaatcccttagctatcatagacgaatgcacctgggggaaagacccttctgttgcaccctgtgcgataagacctattgcgacgcatccggactgtccagacataggcgggtgcacttagggtaccgacctcactcgtgttccgtatgcggcaagagcttccgcgaccagagtgagcttaaacgacaccagaagattcaccagaatcaagagcctgtggatggaaatcaggaatgcacactgcgcatcccaggcactcaagcagaatttcagactccaattgcacgctctcagagatcaatccagggtctcctggatgtgaatcatgctcccgtggcgcgttcgcaagaacccattttcagaaccgaagggccaatggcccagaaccaagcaagcgtgctgaagaatcaggctcctgtgacccggacacaggcgcctattaccggaactttatgccaagacgctaggtccaatagccaccctgtcaagccttcaagattgaatgtgttctgctgcccccactgtagcctgacattttcaaagaagtcctacctgtcccgccaccagaaggcgcacctgacggagcctccaaactactgttttcattgttctaagtcattttccagcttttcacgcttggtccgacaccagcagacccattggaaacaaaagtcctacttgtgtcccatatgcgacttatccttcggcgagaaggagggcctaatggatcattggcgggggtacaaggggaaggacctgtgccagagctcccaccataagtgtagagtgatattgggccagtggctaggcttcagtcatgacgtacccacgatggctggcgaagagtggaaacacggcggcgaccagtctccgcctagaattcataccccccgccggcgaggcctgagagagaaagcttgcaagggcgacaaaacaaaagaagcagtgtccatactcaagcataagtag

SEQ ID NO: 141513 - DNA, 1611 bp, Artificial Sequence
  Description of Artificial Sequence: Synthetic coding sequence
atgtttgagcagcttaaacccatcgaacctgtccagaagacgctgccctgggtcggtgaggttgccgcgacactgcaagaggcgatgaaaagagactgctggcgcgaagctcgggtcaagaaaaagccggtgaccttcgaagacgttgccgtgaatttcacgcaggaggagtgggattgccttgacgcaagccagagggtgctctaccaggatgttatgagtgaaacattcaagaacttgacaagcgtggcacgtatttttctacacaaacccgagctgatcactaaactggaacaagaagaggaacagtggagagaattcgttcatttgccgaatactgagggactcagcgaagggaagaagaaagagctgagggagcagcacccaagcctcagagatgagggcacctctgacgataaggtcttccttgcttgtcggggtgccggtcagtgcccgctgtcagctcctgccggaaccatggatagaactcgtgtgcttcaggcttcccaagccggaccgccctttttttgctacacgtgcggcaaatgcttctccaggcgctcttatctgtacagccaccagttcgtccacaaccccaagctcacaaactcctgcagccaatgtggaaaattatttaggtctccaaagtctctgagttatcatcgcagaatgcatctcggcgagcgcccattctgttgcactctctgtgacaaaacctattgtgacgccagcggtctctcaagacaccgccgcgtgcatttaggctaccgacctcattcatgttcagtgtgcggcaagagtttcagggaccagtccgagctcaagcgacaccagaagatacatcagaatcaggagccagtggatggtaaccaagagtgcaccttgcgcatccctggaactcaagccgaattccagaccccaatagctcgcagccagcgctccatacagggattgctagatgtgaaccacgctcccgtggctaggtcacaagaaccaatttttcggactgagggaccaatggcacagaatcaggcaagcgtgctaaaaaatcaggccccggtgacgcgcactcaggcccccatcacaggcactctttgtcaggacgctcgctccaattcacacccagttaaaccctcccggctcaatgtgttttgctgtccccattgtagcctaactttctcaaaaaaaagctatctgtccaggcatcagaaggctcacctcaccgagccacctaattactgctttcattgcagcaagagtttctcttcatttagtaggctggtcaggcaccagcagactcattggaagcagaagtcatatctgtgtccgatttgtgatctgtcgttcggcgaaaaggaaggactcatggaccactggaggggctacaaaggtaaagacctttgccagagtagccatcataagtgcagagttatcctaggacagtggctgggatttagccatgacgtaccaaccatggccggcgaggaatggaaacacggtggcgaccagtctccccccaggatccacacaccaagaagaagggggttaagagagaaggcttgcaagggcgataagacaaaagaggccgtgagcatcctgaaacacaagtag

SEQ ID NO: 141514 - DNA, 1611 bp, Artificial Sequence
  Description of Artificial Sequence: Synthetic coding sequence
atgttcgaacaactcaaacctattgagcctgttcaaaagactcttccttgggtgggagaggtggccgccacactacaggaggctatgaaaagagactgttggcgggaagctcgcgtcaagaagaagcccgtgacgttcgaggatgtggctgtgaacttcacgcaggaggagtgggactgcttggatgcctctcagagagtgctctatcaagacgttatgtctgagacctttaaaaacttgaccagcgtggcccgtatatttctgcacaaaccagagctcattacaaagttggagcaggaggaggagcagtggagggaatttgttcatttacccaatactgaggggctcagcgagggcaaaaagaaagagctgcgggagcagcatccctcgctacgtgacgaggggacttccgacgacaaagtcttcctggcttgccgaggcgcgggacagtgtcctttatcagctccggctggcacaatggaccgcacccgggtgctccaagcatcgcaggccggtccaccttttttttgctatacgtgtggtaaatgtttctcccgcagaagttatctgtattcacatcagttcgttcacaatcctaagctcacaaattcgtgcagccagtgtgggaaattgttccgaagcccaaagagcctgtcctatcatcgaaggatgcacttaggggagaggcctttctgctgcacgttatgtgataaaacatactgcgacgcttcagggctgtctagacatagacgagttcacttgggttacagaccccattcttgctccgtgtgcggaaagtcattccgcgaccagagcgagttgaagcgccaccagaagatccaccagaatcaagaaccagttgacggaaaccaggagtgcacactaagaatacccggcacacaggctgagttccaaactcccatcgctcgatcccagcgcagcattcaaggattgctggacgttaaccacgccccggtagcaaggtctcaagaacctatcttccgaactgagggccctatggcgcagaatcaggcttccgtgctgaagaatcaggcacccgtgaccaggactcaggctccaatcaccgggactctttgtcaggacgctagaagtaacagccatcctgtgaagccgagtcgtctgaatgtgttctgctgcccgcactgttcactaacattcagtaaaaaaagctatctaagcaggcaccaaaaggcccacctgacagaaccaccaaactattgctttcactgttccaagagcttctcgagcttcagcaggctggtccgacaccagcaaacacactggaagcagaagtcatatctttgtccaatttgcgatctgtcattcggagaaaaggagggcttgatggaccattggcgaggctataagggcaaggatctgtgtcaatcatcccaccacaagtgtcgtgtcattttagggcagtggctgggattttcacacgacgtccctaccatggccggtgaggaatggaaacacggcggggaccagagccccccgaggatacacacacctcgacgcaggggactcagagagaaagcgtgtaagggcgacaagaccaaagaagcagtttccatcctaaagcacaaatag

SEQ ID NO: 141515 - DNA, 1611 bp, Artificial Sequence
  Description of Artificial Sequence: Synthetic coding sequence
atgttcgaacagctgaaacctatagaacctgttcagaagactctgccatgggtgggagaagtagctgctactctgcaggaagcgatgaagagagattgttggcgtgaggctcgcgttaaaaagaagcctgtaacattcgaagacgtggcggtgaatttcacccaagaggagtgggactgcttagatgcctctcagcgtgtgctttatcaagacgtcatgagcgagacgttcaagaatctcacatccgtggcacgcatctttctgcacaaacccgagctgattacgaaattagagcaagaagaggagcagtggcgcgaattcgtccacctccctaacacagaaggcctgagtgaggggaaaaagaaagagctccgtgaacagcacccttccttgcgggacgagggcacctccgatgacaaagtgtttttagcctgtagaggcgctggtcagtgccccctctcagcccctgcaggcacaatggataggacgagggtgctgcaagcatctcaagctggcccaccatttttttgctatacatgtggtaaatgcttctccagacggtcatatttgtactcacaccagtttgtccataatcctaaattaacaaacagctgctcacaatgtggtaaactgtttagaagccccaaatctctgtcttaccaccggaggatgcatctcggcgaaaggcccttctgctgcacactgtgcgataaaacatattgcgacgctagtggcctgtcccggcatagacgagtgcaccttggctacaggccccatagctgctctgtgtgtgggaagtctttccgggatcagtctgagctcaaaaggcaccagaagatccatcagaaccaagaacccgttgatggtaaccaagaatgcaccctgcgcatcccgggtacacaagcagaattccaaactcctattgcgagaagccaacggagtattcaaggtctgctagacgtcaaccatgcccctgtggcaaggagtcaggaacctattttccgaactgagggccccatggctcaaaatcaggcttctgtactgaagaatcaggctccggtcacgagaacccaagcccccataacaggtacgctttgtcaggacgctaggtctaactctcatcctgtaaagcccagccggttgaatgtgttttgttgcccccattgttcactgactttttctaaaaaatcctacctgtcaagacaccaaaaggcacacctgaccgaaccaccaaactattgcttccattgtagtaaatccttctcttcttttagcaggctggtgagacatcaacagacccattggaaacaaaaaagttatctgtgccctatatgcgacctcagcttcggagagaaagaaggcttgatggatcattggagagggtataaaggcaaggacttgtgccagtccagccatcacaagtgtagagttattctagggcaatggttgggattcagccacgatgtaccaaccatggcaggcgaagaatggaagcacggcggcgatcagtctcccccacggattcacaccccaagacgccggggactgcgggaaaaggcctgcaaaggggacaagaccaaggaggcagtctcaatcctgaagcacaaatag

SEQ ID NO: 141516 - DNA, 1611 bp, Artificial Sequence
  Description of Artificial Sequence: Synthetic coding sequence
atgtttgagcaactgaagccgattgagcctgtgcagaagactctcccatgggtaggggaagtggccgccaccctgcaggaggctatgaagagggactgctggcgcgaggcacgagtaaagaaaaagcccgtgacgtttgaagacgttgccgtgaactttacgcaggaggagtgggattgtctggacgcctctcagcgcgtgctgtaccaggatgtgatgagcgagaccttcaagaatctcactagcgtggcccgcatattccttcacaagcccgagctgatcactaaactggagcaggaggaggaacagtggcgcgagtttgtgcatctgcccaataccgaagggctaagcgagggtaaaaaaaaggagctccgagaacagcacccaagtctcagggatgagggaaccagcgatgataaagtgttcctggcttgccggggcgctggtcagtgccccctgtcagcgcctgccggtactatggaccgcacccgggtgcttcaagccagccaggccggcccgcccttcttctgctacacatgtggtaaatgtttctccaggaggtcctatctgtatagccatcagtttgtccacaatcccaaactcacaaatagctgcagtcagtgtggaaagttatttcgatcccctaaatcactgagttatcacaggcgcatgcacctgggtgaaagacccttctgctgcactttgtgtgataagacatactgcgatgcatccgggctgtcccgacacaggcgcgtgcacttaggctatagaccacacagttgcagtgtgtgtggcaaatctttccgggaccagtctgagctgaagagacaccagaaaattcaccaaaaccaggaaccagttgacgggaaccaggaatgcaccttgcgtattcctggtacccaggcagaatttcaaacacctattgcacgctcccagcgcagtatccagggcttactagacgtgaaccacgcaccagtggccagatcccaggaaccaattttccgaactgagggaccaatggcccaaaaccaggcttcagtgctgaagaaccaggcccccgtgactcgcacacaggcccctatcactggcaccctgtgtcaggacgcaaggtcaaactctcatcctgtcaaaccttctcgcctcaatgtcttctgctgtccacactgttccctcactttcagtaaaaagagttacctctcgcgccatcaaaaggcccacttgaccgagcctcccaactactgtttccactgctccaagagcttctcttcgttctcccgactcgtcaggcaccagcagacccactggaaacaaaaaagctatctgtgtccaatatgtgacctatcgtttggggagaaggaaggccttatggaccactggaggggctataaaggcaaagacttgtgtcaatcgagtcaccacaagtgccgggtcattttaggtcagtggctcggcttcagtcatgatgtcccaacaatggcgggtgaggagtggaaacacgggggggaccaatccccacctcggattcacacccccagacgcagagggctcagagaaaaagcttgcaaaggggacaagactaaagaggcggtttcgattctgaaacacaagtag

SEQ ID NO: 141517 - DNA, 1551 bp, Artificial Sequence
  Description of Artificial Sequence: Synthetic coding sequence
atgtttgaacaactcaagcccatcgagccccgagactgctggcgagaggcacgagtgaagaaaaagcccgtgacttttgaggatgttgccgtgaattttactcaagaagagtgggattgtctggacgcctcccaacgggtcctgtatcaggacgtgatgtccgagacattcaaaaatctcacatctgtcgccaggatctttctgcataaaccagaactgattaccaaactagagcaggaagaggaacaatggcgagaatttgtccatctgcccaataccgaaggtctgtcagagggcaaaaagaaagagctcagggaacagcacccttcccttcgcgatgagggcacttcggacgataaggtgtttctcgcttgccggggagctggccagtgccccttgtctgctccagccgggactatggatcgtacccgtgtattgcaggcctctcaggctgggccgccatttttttgctacacctgcgggaagtgtttcagcagacgctcttacctgtactcccatcagttcgtccacaaccctaaattaaccaactcttgcagccagtgcggtaaattgttcaggagcccgaaatctttatcttaccaccgcagaatgcacttaggcgaacggcccttttgctgcaccctgtgcgataagacatactgcgacgcgtcaggcctgagtcggcatcgcagggtgcaccttggctatcgtcctcattcctgctcagtgtgcgggaaaagctttagggatcaaagcgagctgaagagacatcagaagattcaccaaaaccaggaacctgtcgacggcaaccaggagtgcacactgcgaataccaggcacccaagcggagttccagacacctattgctaggtcccagaggagtattcagggacttctggatgtgaaccacgctccagtcgccaggagtcaagagcccatattccggacggagggccccatggcccagaaccaggcctccgtgctaaaaaaccaggcccctgtgacgcggacacaggctcccatcactggtactctgtgccaggacgcgagatccaactctcatcctgtgaagccttctcgcttaaacgtcttttgctgcccccactgctcgctcacgttttctaagaagagctacttatccagacaccagaaggctcacctgacagaacccccgaactattgcttccattgtagcaaatctttctcaagcttttctagattggtgaggcaccaacaaacccactggaaacagaagtcctatctgtgccccatctgcgatctgtctttcggcgagaaagagggactaatggatcattggcgggggtacaaaggaaaagatctgtgtcaatctagccaccacaaatgcagggtaatactggggcagtggctgggcttctcccatgatgtgccaactatggcaggtgaagaatggaagcatgggggcgatcagagtcctcccaggatccacaccccgcgccgcaggggactacgggagaaggcatgcaagggggacaaaaccaaagaggccgtatcgattctgaagcacaagtag

SEQ ID NO: 141518 - DNA, 1551 bp, Artificial Sequence
  Description of Artificial Sequence: Synthetic coding sequence
atgtttgaacaactgaagccaatcgaaccccgagattgctggagggaggcacgcgtaaaaaaaaaacccgtcacctttgaggacgtggcagtaaattttacgcaggaagaatgggactgtttagacgcctcgcagcgtgtactttatcaggacgtgatgagtgagactttcaagaatctcacatctgtggcacgaatctttctgcacaaacctgagttgattaccaaactcgagcaggaagaggagcagtggagggagttcgttcacttacccaatactgaaggactgagcgagggcaaaaagaaggagcttcgagaacagcatccgtcactacgcgacgagggcacgtccgatgataaagtattccttgcttgcagaggggcggggcagtgcccactgtctgctcccgccggtacgatggacagaaccagggtcctgcaggcatcccaggccgggcccccttttttttgctacacctgcggcaagtgttttagcagaaggagctacctttactcccaccaattcgtccataaccccaagctgacaaattcatgttcacagtgtgggaagctttttaggtctcctaaatcgctcagctatcatcggagaatgcatctgggagagcgccctttttgttgtacgctctgcgataaaacatactgtgacgctagcggactttcaaggcatcgccgtgtacatctgggctataggccacattcatgcagtgtgtgcgggaaatcattcagagatcagtcggagctaaaaagacaccagaaaatccatcagaaccaggagcccgtggacggaaatcaggagtgtacattacgtattccagggacacaggccgagttccaaacccccatagcacgctcccagcgctcaatacaaggcctgctggacgtgaatcatgccccagtagcccgatctcaggagccgatattcaggacagagggtccaatggcccagaaccaggcctccgtgttgaagaaccaggcacctgtgaccaggacccaggcccctattaccggaaccctgtgtcaggatgcgagaagcaacagccaccctgtgaaaccctctcgcttgaatgttttttgttgcccccactgttcattgacttttagcaaaaagagctacctctccagacatcagaaggcccacctcacagagccccccaactactgcttccactgcagcaagtcttttagctccttctcacgcctcgtccggcatcagcaaacccattggaaacagaagtcatatctttgtcccatctgcgacctgagtttcggagaaaaagaggggctgatggaccactggagaggctataaaggaaaggacttgtgccagagctcacaccataagtgtcgcgtcatcctgggacaatggcttggattcagccacgacgtaccaacaatggccggggaagaatggaaacatgggggcgaccaatcaccacccaggattcatactccgcgtaggaggggcctgcgcgagaaagcatgtaaaggagacaagaccaaagaagcagtaagtatcctgaaacacaaatag

SEQ ID NO: 141519 - DNA, 1611 bp, Artificial Sequence
  Description of Artificial Sequence: Synthetic coding sequence
atgtttgagcagctgaaaccaatcgagcccgtacagaagactttgccttgggttggtgaggttgctgctacactgcaggaagccatgaagcgagactgttggcgtgaggcacgcgtaaagaaaaagccagtgacgtttgaggacgtggccgtgaattttacacaagaagaatgggactgtctagacgcctcacaaagggttttatatcaggacgtgatgagtgagacgtttaagaatttaacctcggtggcccgcatctttctgcacaagccagaactcataaccaaactggagcaggaagaagagcagtggagagagttcgtccatctgcctaacacggaaggcctatcagagggaaagaagaaggagttgagagaacagcaccctagcctgagagatgaaggcacgtccgatgacaaggtttttctcgcttgccgcggcgctggacaatgcccactatccgctccagccggaaccatggaccgcacaagggtcctccaggcatctcaagcgggacctcctttcttctgctacacttgtgggaagtgtttttcgaggcgctcctacttgtactctcaccagtttgttcataatcctaaactgacaaacagttgttctcagtgcggaaaactcttccgatctccgaagtctctaagctaccatcggaggatgcatctgggagagcgtcccttctgctgcaccctttgcgataaaacatattgtgatgcctccggactgagtcggcacaggagagtgcacttgggttatcgacctcactcatgcagcgtgtgtggcaagtcattcagggaccagtcggaattaaagagacaccaaaagatccatcagaatcaggagccagtggatgggaatcaggaatgcaccctcagaatcccaggcacccaggcggaatttcagacgcctatcgcccgctcacagagaagtattcagggattgctcgacgtgaaccacgcgcctgtggcacgctcacaggaaccgatctttcgcactgaggggccaatggcccagaatcaggcaagtgtcctaaagaatcaggccccagtgactcggactcaggccccaattactgggaccctctgccaagacgctaggtccaattctcatccagtcaaaccgagtagactgaatgtgttttgctgcccccattgctctctgacattttccaaaaaaagctatttgtcccggcatcagaaagctcacctgacagaaccccctaattattgcttccactgcagtaaaagcttctctagcttctcccgcctggttcggcatcagcagacgcactggaaacagaagagctatctgtgccctatttgtgacttatcattcggcgagaaggaaggactcatggaccattggagggggtacaagggcaaggacctatgtcagagctcccaccataaatgtagggttattcttggccagtggctcgggtttagccatgatgttcctacaatggccggcgaggagtggaaacacggcggtgatcagagtccccctaggatccatactccacgtcgaagaggcctgcgcgagaaggcctgcaagggtgataagactaaggaagctgtgtctattctgaagcataaatag

SEQ ID NO: 141520 - DNA, 1551 bp, Artificial Sequence
  Description of Artificial Sequence: Synthetic coding sequence
atgtttgagcagttaaagcctattgagcccagggactgctggagggaggcaagggtcaagaaaaagcccgtgaccttcgaggacgtcgcggtgaacttcacgcaagaagagtgggactgcctcgatgccagccagagagtactgtaccaggatgtgatgtctgagacttttaaaaatctcacaagcgtggcaaggatattcctgcacaagcctgagttaattaccaaactggagcaggaagaagagcagtggagagagtttgtacacttgccaaacacagagggactctctgagggaaaaaagaaagaactccgggagcagcatccctccctgcgcgacgagggtacttccgatgataaggtgttcctagcttgcagaggagcaggccaatgccctctgtcagcaccagcgggtacaatggacaggacccgggtccttcaggcctcccaggctgggcctccttttttttgctacacatgcggcaagtgtttctccagacgcagttacctgtattcccatcagttcgtacacaaccccaaactgacgaattcatgctcacagtgcggaaagctgttccgcagtccaaagtctctgtcttaccacaggcgcatgcatctgggagagcgaccattttgctgtactctgtgtgacaagacatactgcgatgcctccggcctttccaggcatcggcgcgtccacctgggctatcgccctcactcctgctccgtatgcgggaaaagttttcgcgaccagtcagaattaaagcggcaccagaaaatccaccaaaaccaggagcccgtggatggcaatcaggaatgtacactccgaatccctgggacacaagctgagtttcagaccccgatcgctagaagccagcgaagcatacaaggactgctagacgttaatcatgcccctgtggctaggtctcaggagccaatcttcagaaccgaaggtccaatggcccagaaccaggcttcagtgttgaagaaccaggcacctgtgacacgcacccaggcacccatcaccggaacactgtgccaggacgccaggtccaattcacaccctgtcaagccttctcgactgaacgtcttctgctgtccgcactgttcactgacgttctcaaagaaaagttacctgtctagacaccaaaaagcgcatcttaccgaaccaccaaattactgctttcattgttcaaagagtttctcatcattctctcggctggtgcgacaccaacaaacacactggaagcaaaaatcctacctttgtcctatttgtgacctctcctttggcgaaaaagagggcctgatggaccattggagaggttataaaggtaaggatctgtgccagagctcacaccacaagtgtcgcgtgatcctggggcaatggctggggttctcacacgacgtgccaactatggcgggcgaggaatggaaacatggaggagaccagagccctcctagaatccacactccgcgtcgccgggggttgagagagaaggcatgtaagggggataagaccaaggaagcggtgtcgatcttaaagcacaaatag

SEQ ID NO: 141521 - DNA, 1551 bp, Artificial Sequence
  Description of Artificial Sequence: Synthetic coding sequence
atgtttgagcagctcaagccaatcgagccgagggattgctggcgtgaggctagagtcaagaaaaagccagtcacgttcgaggacgttgcagtcaatttcacacaggaagaatgggactgtcttgacgcaagtcagcgggttctatatcaagacgtgatgtctgagaccttcaaaaacctcacaagcgttgcgcggatcttccttcacaagcccgaactgataacgaagctcgagcaagaggaagaacaatggcgcgaatttgtacatctgcccaataccgaggggctatcagagggcaagaaaaaagagctcagagagcaacatccatctttgagagacgagggtactagtgatgataaggtgtttcttgcctgccgtggcgctggccaatgtccactgagcgctcccgcaggcactatggatagaacacgggtgttacaagcatctcaggctggcccccccttcttctgttatacatgcggaaagtgttttagccgtcgctcttacctgtactcacatcaatttgtacacaatcctaaactgactaatagttgcagtcaatgtggaaagctatttcggtccccgaaatctctatcttaccacaggagaatgcacctcggggaacgacccttttgctgcacgctgtgcgataaaacctactgcgacgccagcggactttcaaggcatcgacgagtccacctaggatacaggcctcattcatgtagcgtctgcggaaagagcttccgcgatcagtcagagcttaaacgccaccagaagatccatcaaaaccaagagcccgtcgacggcaatcaagagtgtactctgcgcattccagggacacaggctgaatttcagaccccaatcgcccgctctcagcggtctatccagggcctgcttgatgtaaatcatgccccagtagcacggtcgcaggagccaatattccgcacagagggacctatggcacagaatcaggccagcgttctcaaaaatcaggccccagtgacccggacccaagcaccaataaccggaacactttgccaggacgcaagaagtaacagccaccctgtgaagccctctagacttaatgttttttgttgcccacactgctcactcaccttttcgaaaaaatcctaccttagcagacaccagaaggcccacctgaccgagccgcccaattactgttttcattgttccaaaagcttttcaagttttagtcgactggtccggcatcaacaaactcattggaagcaaaagtcctatctgtgtccaatatgcgatctcagctttggtgagaaagaagggctgatggaccactggcgcggctataaaggaaaagatctttgtcagtcctcacatcacaaatgccgcgtgatcctgggccagtggctgggcttctcccacgacgtcccaaccatggcaggagaggaatggaagcacggaggcgatcagagcccccccaggattcacacccctcgtcgtcggggtctgcgggaaaaagcatgtaagggcgacaaaactaaagaagccgtgtctatcctcaaacataaatag

SEQ ID NO: 141522 - DNA, 1611 bp, Artificial Sequence
  Description of Artificial Sequence: Synthetic coding sequence
atgttcgagcaactcaagccaattgaacccgtccaaaagactctgccctgggttggagaggttgccgctacactgcaagaagctatgaagagggactgctggcgggaagcgcgggttaagaaaaaacccgtaaccttcgaggacgtcgccgttaattttacgcaggaggagtgggattgcctggacgcctctcagagggtcttgtaccaggacgtcatgtccgagacttttaagaatttaacctccgtagctagaattttcctgcataagcctgaactcatcaccaaacttgaacaggaagaggagcagtggagagagttcgtgcatctgcctaacactgaaggtttgagcgaaggtaaaaaaaaggagctgcgggagcaacacccgtcccttagggatgaaggtaccagcgatgacaaagtgttcttagcttgtcgaggtgccggacagtgccccctaagtgctccagccggaaccatggaccggaccagggtgttgcaagcctctcaggccggacccccattcttttgttacacctgcgggaaatgcttcagtaggcgaagctatctgtactcacaccagtttgtacataatcctaagctcaccaattcttgctctcagtgcgggaaactatttcgaagcccaaaatctctctcttaccatcgccggatgcacctgggcgagcgtcctttttgctgtacactgtgtgacaagacatattgtgacgctagcggcctgagtcgtcacaggcgggttcatcttggataccgcccccatagctgctctgtctgtgggaaaagtttccgcgatcagtcggagcttaagcgccatcagaaaattcatcaaaaccaggaacccgtcgacggtaatcaagagtgcacacttaggattccagggactcaggcagagtttcagactcccatagctaggtcgcaaaggtcaattcaagggttactggatgtgaatcatgcccctgtagcccggtcccaggagcccattttccggacggagggacctatggcacaaaatcaggcttcagtgctgaaaaaccaggcccccgtgaccaggacccaggctcctatcaccggaaccctttgccaggatgcgcgctctaatagtcacccagtgaaacccagccgacttaacgtcttttgctgtccccactgctctctgaccttttcgaagaagagctatctgtcccgccaccaaaaagctcatttgaccgagccccctaattattgttttcactgctccaagagcttttcaagtttctcgcggctggttcggcatcaacagacacattggaaacaaaagtcttacttatgtcccatctgtgatttaagtttcggggaaaaagaagggctaatggaccactggcgtggctacaagggcaaagacttatgtcaaagctcacaccacaagtgtcgggtgatactgggacagtggttaggcttttcacacgatgtaccgaccatggctggggaagaatggaaacatggtggagaccagtctccacctcggatccacacacctaggagaagagggctgcgagagaaagcatgtaaaggcgacaaaactaaggaagctgtcagcatcctcaaacacaaatag

SEQ ID NO: 141523 - DNA, 1725 bp, Artificial Sequence
  Description of Artificial Sequence: Synthetic coding sequence
atggccgccgctgtgccccggcggccgactcagggcactgtgactttcgaggatgtggcggttaatttctctcaggaagagtggtgtctgctctcagaggcccagcgatgtctctatcgagacgtgatgcttgaaaatctggccctaatttcttcccttgggtgctggtgcggctcgaaagacgaagaagcaccgtgcaaacaacggatctccgtacagcgcgagagtcagtctcggacaccgagagccggggtcagcccaaagaaggctcacccatgcgaaatgtgcggactgatcctggaagacgtgtttcactttgcagaccaccaggaaacccaccataagcagaagctgaaccggagcggggcctgcggcaaaaatctggacgatactgcctaccttcaccagcaccagaaacaacatatcggagaaaagttttatagaaaaagcgtacgggaggccagtttcgtgaagaaacgtaaactgagggtctctcaggaacccttcgtgtttagggagtttggtaaggacgttttgccctcatccgggctgtgtcaggaagaggccgctgtggaaaagacagattccgaaaccatgcacgggccccccttccaggaaggtaaaaccaactactcgtgtggtaagcgcaccaaagctttctccacaaagcactccgtaatcccacaccagaagctcttcactagagacggctgttacgtgtgctccgactgtggtaagtccttttccaggtacgtctccttctctaaccaccagagagatcatacagccaaggggccgtacgactgcggcgagtgcggtaagagctatagccgaaagagctcgcttatacagcatcaacgggttcatactggtcaaacagcctatccatgtgaagaatgcggcaaatccttctcgcagaaggggagccttatcagccatcaattggtgcacaccggcgaagggccttacgagtgccgagagtgtgggaagagctttggacagaagggcaaccttatccagcatcagcagggtcatacaggcgagcgggcctaccactgcggagagtgtggcaagagtttccgtcagaaattttgtttcataaaccaccagagggtccataccggagagaggccttataagtgtggagaatgcggtaagtccttcggccaaaaaggaaatcttgtgcaccatcagcggggtcatacaggagagcggccgtatgagtgtaaagagtgtggcaagagtttccgctatagaagtcacctgacggaacatcagcgcttgcatactggggaaagaccgtataattgccgggagtgtgggaagctgtttaaccgaaagtaccacctgttagtgcacgaaagagttcacacaggcgagagaccatacgcatgtgaagtgtgcggcaaactgttcgggaataaacactctgtgactatccaccaacggattcatacaggagaaagaccgtatgagtgtagtgagtgcggcaaaagtttcctaagtagtagcgcgctacatgttcataaaagagtgcacagtgggcaaaaaccatacaaatgctctgagtgcggaaagagcttctccgagtgttcatctctcataaagcaccggcggattcacactggagagaggccttacgagtgtaccaaatgtgggaaaacttttcagcgatcatctacattattacaccatcagtcttcccacagacggaaggcactgtag

SEQ ID NO: 141524 - DNA, 3804 bp, Artificial Sequence
  Description of Artificial Sequence: Synthetic coding sequence
atgggggacatgaagactcccgactttgatgatttacttgccgccttcgacattcccgatcccacaagcctcgacgctaaggaagctatccagacccccagcgaagaaaacgagagccctctcaaacctccaggcatctgtatggacgaatccgtgtccctcagtcactccggaagcgcacctgatgttcctgctgttagcgtgatcgtgaaaaacacgagtcgccaggagtcttttgaggctgaaaaggaccatattaccccttcactgctgcacaatggtttccgggggtcagatctgcccccagatccgcataactgcggcaaatttgattccacttttatgaacggtgacagcgctcggtcctttcctgggaagttagaaccacctaagagtgagccgctgcccaccttcaatcagttctctcccattagcagccctgagccggaagaccctatcaaagataacggttttggcataaagccaaaacatagcgactcctacttcccccctcctctgggctgtggcgccgtgggaggcccagtcctcgaagcacttgcgaagttcccagttccagaactccatatgttcgatcacttttgtaaaaaagaaccaaagccagagccactcccccttggctcccagcaggagcatgagcagtctggtcagaatacagttgaaccacacaaggaccccgatgcaacacggttctttggcgaggcattggagtttaattcgcatccatcaaactccattggggaatcaaaggggctcgcacgggagctggggacctgtagcagcgtgccccccaggcagcggttaaagcccgcccacagcaaacttagctcgtgcgtggccgcactggttgcgctgcaggctaagcgagtggcatctgtgaccaaggaggaccaacctggacacactaaagacctttctggccctacaaaggaaagctcaaaaggaagtccaaagatgcccaagagtcctaaatctcccagatccccgctcgaagctactagaaagtctattaagccgagcgacagcccccgttctatctgttcagacagctcctctaaaggtagccctagtgtggctgcatcttctccgccagctatccccaaagtacgcatcaaaacaataaagacctcatccggggaaatcaaacggactgtaacccgaatcttgcctgaccctgatgatcccagcaagagtcctgtggggtcccctctgggatcagctattgctgaggcaccaagcgagatgccaggggacgaggtcccagtagaggaacattttccagaggcaggaaccaatagcgggagtccccagggcgccaggaagggagatgaaagcatgacgaaggcctcagacagttccagcccgtcttgctcctctgggccacgcgtgcctaagggagccgccccagggtcacagaccggaaagaaacaacagagtacagctctccaggcctctacactggctccagccaatctcttaccgaaggcggtacatttagccaatctcaatctcgttccacacagcgtcgccgcgtcagtgacggccaagagcagcgtgcaacgccgctcccagcctcagctcacacagatgtcggtgcccctggtccaccaagtgaagaaagcagccccattgatcgtcgaggtgttcaataaagtgctgcatagcagcaatcccgtccccctgtatgccccgaacttaagcccccccgccgatagccgcatccacgtgcctgcttctggatactgttgcttggaatgcggggacgccttcgcccttgagaagagtctctcacagcactatgggaggaggtccgtgcacattgaagtgctctgcacactgtgttccaagacccttctgttcttcaacaagtgttctctgctcagacatgcccgtgaccataagagtaagggcctggtgatgcagtgtagccagctgctggtcaagcctataagtgctgatcagatgtttgtgagcgcacctgttaactccacagcccccgcagcccccgccccatcatcctcccctaaacacggcctgacttcggggtctgcctcgccgcctccacccgccctgcccctgtaccccgaccccgtaagactgatccgttactctattaagtgcctggagtgccacaagcagatgagagactatatggtcctggctgcccattttcagaggacaacggaggagaccgaaggtttgacatgccaagtctgtcagatgctgctgccaaatcagtgcagtttttgcgcacaccaacgcatccacgcccataaatctccctactgttgccccgaatgcggggtgctgtgtagatcggcttactttcagacgcatgtgaaagagaattgcctgcactacgcgcggaaggttggctaccgatgcatacattgtggggttgtccatctcaccctcgccctgctaaaatcgcatatccaggagcgtcattgccaggttttccataagtgcgctttctgccctatggcttttaaaacagcctcttctacggcagatcacagtgcaactcaacacccaactcagccccacaggcctagccagcttatttataagtgtagttgtgaaatggtttttaacaagaagcgacacatccagcagcacttctatcagaacgtatctaagacacaggtgggagtgttcaagtgccccgaatgtcccttactgttcgtccagaaaccggagttgatgcaacacgtcaaatccacacacggggttcctcgcaacgtagacgagctcagctcacttcaatcttctgcggatacatcttcatcacgccctggctcacgggtccctactgagccacccgccacctccgtggcagctcgctcatctagtctgcccagcggccgatgggggaggccagaagcacatcgacgagtagaggctagacctcgcttaaggaacacgggttggacatgccaagaatgccaggaatgggtgcctgatcgagaaagttatgtctcccatatgaaaaagtcccacgggcgtactctgaagagatacccatgtaggcagtgtgagcagagcttccatacaccaaacagcctgcgaaagcacatccggaataatcacgataccgtgaaaaagttttatacatgtggctattgtactgaagactccccctcttttcctcgcccctcactactggagtcgcatatttccttgatgcatgggatcaggaacccggacctgagccagacctcaaaagtgaaacctccgggggggcactccccccaagtgaaccacctcaaacggccagttagcggggtgggggatgcccctggcacctctaatggcgccaccgtctccagcacgaagaggcacaaatctctttttcagtgcgcaaaatgcagtttcgctacagacagcggacttgagtttcagtcacatattccccagcatcaggtcgattcctccaccgctcagtgtcttctctgcggtctctgttacacttcagcttcaagtctaagtcggcacttatttattgtgcacaaggtgcgagatcaggaggaggaggaggaagaagaagctgcagctgcagagatggccgtcgaagtggccgaaccagaagagggctctggcgaggaggtcccaatggagaccagggagaatgggctcgaagaatgtgccggcgaaccactgtccgccgaccccgaagcccgacggcttttaggtccggcgcccgaggacgatggcggacacaacgatcacagccaaccccaggcatctcaggatcaagattcccacactctgtccccccaggtctag

SEQ ID NO: 141525 - DNA, 3804 bp, Artificial Sequence
  Description of Artificial Sequence: Synthetic coding sequence
atgggggatatgaagacccctgattttgatgatcttctagcggcttttgatattccagatcccaccagccttgacgccaaagaggccatacagactccgtcagaggagaatgagtcccccctgaaaccaccaggaatatgcatggacgaatctgtttctttgagtcattcagggagtgcccctgatgtaccagccgtgtcagtgattgtcaagaacactagcagacaagagtccttcgaggcagagaaggatcatattaccccatctctcctgcacaacggcttccgaggatcagatctgccacccgacccccacaattgcggcaaatttgattctactttcatgaacggagactctgccaggtcttttccaggcaaactcgagcccccgaaatcagaacctctgccaacattcaatcagtttagccctatttctagtcctgagcctgaggacccaatcaaggacaatggatttggcatcaagcccaagcactcggactcatatttccctccgccattgggttgtggtgccgttggcggcccagtgctcgaagccctagcgaagtttcctgttcctgagctgcacatgttcgaccacttctgcaagaaggagccaaaaccagagcctttgcctctgggtagccagcaggagcacgaacaaagcggtcaaaatacagtagagccccataaggatcctgatgccaccagattctttggagaggctctggagtttaattcacatccatctaattccatcggagagagcaaagggctcgcgagagagttgggcacctgctcttccgtgccacctaggcagagactgaaacctgcacacagcaaactgtcatcctgcgttgcggctctcgtagcactgcaggcaaagcgagtcgccagtgtcactaaggaggatcagcccggccacaccaaggacttatctggccctaccaaagagtcctctaagggatcaccaaagatgcctaagtcccccaaaagcccgagaagcccattggaagcgacacggaaaagtattaaaccatctgacagtcctagatccatttgctctgacagcagttctaaagggtccccctctgtcgccgcaagctctcctcctgcaatacctaaagtgagaatcaaaactataaagaccagtagtggggaaatcaaacggacagttacacgcatcctccccgatcctgacgacccatcaaagtcccccgttggcagtccccttggctcagccattgccgaggccccaagtgagatgcctggggatgaagttcccgtcgaggagcactttcccgaggcgggcacaaattccggctccccccagggggctcgtaagggtgatgagtccatgactaaggccagtgacagcagctccccatcttgttcatcaggccccagagtccccaagggcgctgcaccaggtagccaaactggtaagaagcaacagtccactgctctccaggcatcaactctggcaccagcaaacctgctccctaaagccgtgcatttggcaaacctaaacctcgtgcctcatagtgtcgccgcaagcgtgacagctaaaagcagcgtgcagaggcgaagtcagccccaactgacccagatgagcgttccccttgtccatcaggtgaaaaaggcggcccccctgatcgtggaagtattcaacaaggtgctgcacagttcgaacccagttccgctgtatgcgcctaacctgtcccctccagcagatagtcgaattcacgtgccagcttcagggtactgctgtcttgagtgcggcgacgcattcgccctggagaagagtttatcccagcactacggtcggaggtctgtgcacattgaggtcctctgtacactgtgcagcaagaccctgctgttcttcaacaagtgcagtttgcttcgccatgccagggatcacaagagtaaaggactcgtcatgcaatgcagccaattgctggtgaagccgattagcgccgatcagatgttcgtgagcgctccagttaattcaacagctccagctgctccagcccccagttcatcaccgaagcacgggttaacatcggggagcgcgagccccccaccgccagctctccctctgtaccccgaccccgtgcggctaatccgctattccatcaaatgcctggaatgccacaagcagatgcgagactatatggtcctcgccgcacactttcagcgcacaaccgaggaaactgaagggctgacctgccaggtctgtcagatgctcctgcctaatcagtgcagcttctgcgcacatcagaggattcacgcccataaaagtccttattgttgcccggagtgtggtgtgctttgtcgaagcgcctattttcagactcacgtgaaggaaaactgcttacactacgcacggaaagtgggatataggtgtattcactgtggagtggtgcacttaaccctggctctattgaagtcccacattcaggagcgtcactgccaggtcttccataagtgtgctttttgcccaatggcgttcaaaacggcctcttccaccgcagaccactccgcaacgcagcatccgacacaaccacataggccgtcccagctcatttacaagtgcagctgcgagatggtgttcaataagaagcgtcacatccagcagcacttttaccagaatgtgtctaaaacccaagtgggggtttttaagtgccctgaatgccctctgctgtttgtccagaaacctgaattgatgcagcatgtcaagagcacgcatggagtgcctcggaatgtggatgagctctcatccctacagtccagcgcagacacttcctccagccggcctggatcacgtgtgcccaccgagcccccagctaccagcgtcgctgcacgaagttcatccctgcccagcggccgctgggggcgcccagaagcccaccggagagtcgaggcccgaccacggctgcgtaacactggctggacgtgccaggagtgtcaagagtgggtacccgaccgagagtcttacgtgtctcatatgaagaagagccatggtaggacactcaaacggtacccatgcaggcagtgtgaacagtcttttcatacaccaaatagcctgaggaagcacattcgcaacaatcacgataccgtcaagaagttttacacgtgtggttactgtacagaagattctccctccttccccagaccatcgctcctcgaatctcacatatccttgatgcatggaattcgaaaccccgacctgagccagacatctaaggtgaagcccccaggcgggcattcccctcaggtgaatcacctaaaacgtcccgtgtccggagtaggggacgctcccggtacgagcaatggcgcaacagtatcttctaccaaacggcacaagtcactattccaatgtgctaaatgctcgtttgctaccgactctggcctggaattccagtcccacatacctcagcaccaggtggattcctccacggcacagtgtctcttgtgtggcctctgctacaccagtgcatcctcattatcaaggcacttatttattgtgcataaagtgcgagatcaagaagaagaagaggaggaggaggcagcagcggctgaaatggccgtggaggtagctgaaccagaggaggggagtggtgaggaggtgccaatggagactcgggaaaacggactggaggagtgcgcaggggagccgttaagtgccgaccctgaagcacgtcggctgttgggccctgcaccagaggatgatggagggcacaatgaccattcccaaccccaggcttctcaggaccaagactcacacacactgagtccacaggtgtag

SEQ ID NO: 141526 - DNA, 2379 bp, Artificial Sequence
  Description of Artificial Sequence: Synthetic coding sequence
atggctgcgataaacccctgggcttcctggggtgcgcttacagaccagagctggggcatgacagccgtggatccctgggcttcatgggcgctttgcccacagtacccggcctggcacgtagaaggcagtttagaggagggcagacgagctacagggctacctgctgcacaggtgcaggagcccgtgaccttcaaggatgtggctgtcgatttcacccaggaggaatggggccagctcgacctagttcagagaactctgtatcgggatgttatgctcgagacatatggacaccttctctctgtaggcaatcaaattgctaagccagaggttatttcactactcgaacagggtgaagaaccttggtccgttgaacaggcctgtccgcagcgaacatgcccagaatgggtgagaaatctggaatcaaaggccctgatccccgcacagtccatctttgaggaagaacagagtcacgggatgaaattggagcgctatatttgggatgacccctggttttcgagactggaagtgctggggtgcaaggatcaactcgagatgtatcacatgaaccagtccacagcaatgcggcagatggtgtttatgcagaaacaagtcctgagccagaggtcctctgagttttgcggcctgggcgccgaattctcacagaacctgaactttgtcccatcccaacgcgtgagccagatcgagcatttttacaaacccgacacacacgcccagagttggagatgcgatagcgccattatgtacgctgacaaggtaacctgtgagaataacgattacgacaaaaccgtctatcagtctatccagccaatttacccagctagaatccagaccggtgacaatctcttcaaatgtaccgacgccgtgaagagcttcaaccacataattcatttcggtgaccacaaaggaatacacaccggagaaaaattgtacgaatataaagaatgccatcaaatctttaatcagtctccgtccttcaacgagcaccctcgtctgcatgtgggcgagaatcagtacaactataaagaatacgaaaacatcttttactttagcagttttatggagcatcagaaaatcggtactgtggagaaagcctacaagtacaacgagtgggaaaaggttttcggctatgacagctttctcacccagcatacaagcacctatacagctgaaaagccctacgactataacgaatgcggcacttctttcatttggtcgagctatttgatacagcacaagaagactcatacgggagagaagccttatgaatgtgataaatgcggtaaggtctttagaaacagatccgccctgacaaaacacgagaggacccatactggaattaagccctatgaatgcaacaagtgtggcaaagcattttcgtggaatagtcatctgatcgtccacaaacgaatccataccggcgagaaaccctacgtctgcaacgaatgcggaaagagcttcaactggaacagtcacctcatagggcaccagcgtacacacaccggcgagaagccgttcgaatgcacagaatgtggcaagagtttctcctggtcaagtcacctgattgcccacatgcgaatgcacactggagagaagccctttaagtgtgacgagtgtgagaaagcgttccgcgattattccgcactgtctaagcatgagcgaacgcatagcggcgcaaaaccttacaaatgtacagagtgcggcaagagtttctcgtggtcttcccacttgatcgcacaccagcgaacacacaccggggaaaagccctataattgccaagagtgtggtaaggcatttcgggagcggagcgcgcttacaaagcatgaaattattcattctgggataaagccctacgaatgtaataagtgcggtaaatcttgttcccaaatggcgcatctcgtgaggcaccagaggacccacaccggagaaaaaccctacgaatgtaacaaatgcggcaagtcattttcccaatcttgtcatctggttgctcacagacgcatccataccggtgagaaaccctacaagtgcaatcagtgtgaaagatcctttaattgctcgtcccatcttattgcccaccggagaactcataccggcgagaagccctataggtgtaatgaatgcggcaaggcgtttaatgaatcatcttcattgatagttcacctgcggaatcacaccggcgaaaaaccttataaatgtaaccactgtgaaaaggccttttgcaagaactctagcctgatcattcatcagagaatgcatagcggcgagaaaagatttatttgctcggaatgcggtaaagcttttagcggtcatagcgctttgctgcagcaccagcggaaccactctgaagaaaagcttaactag

SEQ ID NO: 141527 - DNA, 2109 bp, Artificial Sequence
  Description of Artificial Sequence: Synthetic coding sequence
atgctggagacttatggccatctgctgagcgtcgggaatcaaattgcaaagccagaggtcatcagtctactagagcaaggcgaagagccatggtccgtggaacaggcctgcccccagcgcacctgtcccgaatgggtacggaacctagagtcaaaagctcttatccccgcacagagtatcttcgaggaggagcaaagtcacgggatgaagctggaaaggtatatctgggatgatccctggttctctcgtttagaggtgctgggatgtaaagaccagttggaaatgtatcatatgaaccagtcaacggctatgcgccaaatggttttcatgcagaagcaggtgctttcccagaggtcatctgagttctgtggactgggagcagagttctcgcagaatctgaacttcgttccttcccagcgggtcagccagatcgaacatttttataaacctgatactcacgcccagtcttggcggtgcgactctgccattatgtacgcggataaagttacctgcgaaaacaatgattacgacaagacggtgtatcagagtatccagccgatatatcccgccagaatccagaccggggataacctgttcaagtgcacagacgccgtaaagagcttcaaccatatcatccactttggggatcataagggaattcacactggggaaaagctgtatgagtacaaggagtgccaccagattttcaaccagtcccccagtttcaacgaacatcctcgactccacgtgggtgagaatcagtacaactataaggagtacgagaatatcttctacttttcttcctttatggaacaccagaaaatcgggaccgtcgaaaaagcctataagtacaacgaatgggaaaaggtgtttgggtacgattcattcctcactcagcacactagcacttatacagccgagaagccctatgattacaacgagtgtggcacctccttcatctggtcatcctacctgatacaacataaaaaaacccacacaggcgagaagccttacgagtgcgataaatgtggtaaagtgttcaggaatagaagtgcccttacgaagcacgaacgaacacacaccggaatcaagccctacgaatgcaataagtgtggcaaggctttttcgtggaatagccatttgattgtgcataaacggatccacactggcgaaaaaccatacgtgtgtaatgagtgtggcaagagctttaactggaattctcacctgatagggcatcagagaacacacacaggagagaaacctttcgaatgcactgagtgcggcaagtctttcagctggagctcccacctgatagctcacatgcgcatgcacaccggcgaaaaaccgttcaagtgtgacgagtgcgaaaaagcattccgcgactatagcgcgctgtctaagcatgaacgcacacatagcggggcgaagccctataagtgtaccgaatgtgggaaaagcttcagctggtcgtcacacctcattgcacaccagcgaacccacacaggagagaaaccttacaactgccaggaatgcggcaaagcctttagagagagatctgccctaacgaagcatgagatcatccattccggcattaaaccatacgaatgcaacaaatgcggtaagtcgtgtagtcagatggctcatttggttaggcaccaacgcacccacacaggggaaaaaccctacgagtgcaacaagtgtgggaaaagcttcagtcaaagctgtcatctggtggctcaccgaaggatacacacaggagagaagccatataaatgcaaccaatgtgaaagatccttcaactgtagctcccatctgatagcacataggcgaacccacaccggcgagaaaccctataggtgtaatgagtgcgggaaggcctttaacgagagctccagcctaattgtgcatctgaggaatcacaccggtgagaagccctacaagtgcaaccattgtgaaaaggccttttgcaagaactccagcctcattatacaccaacggatgcacagcggtgagaaaaggttcatctgttctgagtgtggcaaggccttctctggccattccgctctcctgcagcatcaacggaatcacagcgaagaaaagctgaattag

SEQ ID NO: 141528 - DNA, 1527 bp, Artificial Sequence
  Description of Artificial Sequence: Synthetic coding sequence
atggcagcaattaacccatgggcgtcctggggagccctcactgaccagagttggggcatgactgcggtcgatccctgggcctcttgggctctgtgcccccagtacccagcatggcacgtcgagggctccttggaggaaggaaggcgagccaccggactcccggcagcccaagtgcaagagccggtgacgtttaaggacgtcgccgttgacttcactcaggaggagtggggccagcttgacctggtccagagaaccctgtacagagatgtgatgcttgagacctacggccatctactgagcgtcgggaaccagattgccaagcccgaggtaatctcacttctggagcaaggcgaggaaccctggtccgtggagcaggcatgtccccagaggacctgtccagagtgggtcagaaatcttgaaagcaaagccctcatacccgcgcagagcattttcgaggaggagcaaagccacggtatgaagctggaacgttatatttgggacgatccctggttttctcggctggaggtcttgggttgcaaagatcagcttgagatgtatcatatgaaccagagcaccgccatgcggcagatggtgttcatgcagaagcaagttctgagccagaggagctccgaattctgtggtctgggcgctgaattcagccagaaccttaactttgtcccctctcagagggtttctcagattgagcatttttataaaccggatacccacgcacaaagttggcgctgcgattcagcgatcatgtatgctgataaagttacttgcgagaacaacgattacgataaaaccgtgtaccagtctatccagcccatttaccccgccagaatacagacaggggacaatttattcaagtgtactgatgcagtgaagagtttcaaccacatcatccatttcggagaccataagggtatacacacaggggaaaaactatatgagtataaggagtgccatcaaattttcaatcagagccctagctttaacgaacaccctcgactacacgtgggcgagaatcagtacaattataaggagtatgaaaatatattctatttctcttcctttatggagcatcagaagattggtacagttgaaaaggcctacaagtacaatgagtgggagaaggtgtttggctacgatagctttttaacgcagcacacttcaacatatacggccgagaaaccttacgactacaacgagtgcggaacttcttttatctggtccagctacctgatccagcacaagaagacccacactggtgaaaagccatacgagtgcgataaatgtggtaaggtgttcagaaatagaagcgccctcaccaagcacgaaaggactcatacaggaattaaaccatatgaatgtaacaagtgcgggaaagcgttcagttggaattcccatctcattgttcacaagcgtatccacactggggagaagccctatgtgtgcaatgaatgtgggaaatccttcaactggaacagtcatctgatcggtcatcagaggacacatacaggttag

SEQ ID NO: 141529 - DNA, 2523 bp, Artificial Sequence
  Description of Artificial Sequence: Synthetic coding sequence
atgaaggaagataaaagtagtatccgagaggctatctccaaggcgaaaagtacagcaaatatcaagacagagcaggaaggcgaagcctctgagaagtccctgcatctaagccctcagcacataacacatcagacaatgccaatcgggcagcgggggagtgaacaaggaaagcgagtcgagaatattaatggcacatcttacccttcattgcagcagaagaccaatgctgtcaaaaaactacacaagtgcgatgaatgcgggaaaagttttaaatataactctagactggtgcaacacaagataatgcacaccggagagaagaggtacgagtgcgacgattgcggagggacctttagatcttcgagcagcctgcgagtacacaaacggatccatacgggcgaaaaaccttacaagtgtgaggaatgcggcaaggcttacatgtcctacagtagcctcatcaaccacaaaagtacacactctggcgaaaagaactgcaaatgtgatgaatgcggcaagtctttcaattacagctctgtcctagatcaacacaagcgaatccacacgggcgaaaagccctatgaatgtggagaatgcggtaaagcgttcaggaatagtagcgggctccgggttcacaagcggatccacacgggagaaaagccttatgagtgcgacatctgtggcaaaacgtttagcaacagttctgggttgagggtccacaaaaggattcatacaggcgaaaagccatatgaatgcgacgagtgtggaaaggcattcattacctgccggactttgctcaatcataagtcaatccattttggggacaaaccgtacaaatgcgacgaatgtgagaaatctttcaactattcctctctcctgatacagcacaaggttattcatacaggcgaaaagccgtacgagtgcgacgagtgtggcaaggcatttcgaaactcgtccggactcattgtgcacaaaaggatccacacgggggaaaagccgtacaagtgcgacgtatgcgggaaggcgttttcatattctagtggcctcgcagttcataagtctatccaccctggcaagaaagctcatgaatgtaaggaatgcggtaaatccttctcatacaattccctgctgctccagcacaggaccattcacaccggagagcggccatacgtgtgcgatgtttgtggcaaaacatttcggaacaatgcgggcctcaaagtccatcggagactccacaccggggagaaaccatataagtgcgacgtttgcggaaaagcttacatctctcggagttcccttaagaaccataagggaatacacctcggggaaaaaccttataagtgtagttattgtgagaaaagctttaattactcctctgcacttgaacaacataaacggatccatacccgggaaaagccttttggatgcgatgagtgcggaaaagcattccgaaataacagtgggctcaaagttcacaagcgcattcataccggggagagaccatacaaatgcgaagaatgcgggaaagcctacattagtctatcgagccttatcaatcataagtccgttcaccctggggaaaaacctttcaagtgcgacgagtgtgaaaaagcctttattacctacaggacgctgacaaaccataagaaggtacacctcggggagaaaccgtataaatgcgacgtgtgcgaaaaatccttcaactacactagcctgttatcgcagcaccgaagggtgcacactcgagaaaagccttatgaatgtgaccgctgcgagaaagtgtttaggaataacagcagtctcaaagtgcacaagcgaattcatacaggtgaaaggccatatgagtgcgacgtctgtggcaaggcctacattagccattcctctctgatcaaccacaagtcaacacatccggggaggactccacacacctgcgatgagtgcggaaaggcttttttcagtagtaggactctgatttcccacaaacgcgtgcacctgggagagaagcccttcaagtgtgtggaatgcggtaaaagcttttcttattcctccctactctcacaacacaaacgtatccatacaggcgagaagccctatgtgtgtgacagatgtggaaaagcttttcgcaatagcagcggcctgactgttcacaaacggatccataccggtgagaaaccttacgaatgtgacgagtgtggcaaagcatacatctcccactcttctctgatcaaccacaagtccgtccaccaaggtaagcaaccctacaactgcgagtgcggtaagagcttcaactacagatcagtcctggaccagcacaagcggatacacacaggaaagaagccatacaggtgcaatgaatgcggaaaagccttcaacatccggagtaatctgacaaagcacaagcggacccacaccggggaagagagcctgaacgtcatatatgtggggagttatagtggaacatcccagaaacgcacctatgaagggggcaatgccctagacggcggccgaatgaggatgccgctgtag

SEQ ID NO: 141530 - DNA, 1497 bp, Artificial Sequence
  Description of Artificial Sequence: Synthetic coding sequence
atgtcatacagctctctcatcaatcacaaatccacgcactctggtgagaaaaattgcaaatgcgacgaatgtgggaaatcgttcaactactcatcagttcttgaccaacataaacggatccacaccggcgagaagccatacgagtgcggggagtgcggcaaagctttccgaaatagttctgggctgagggttcacaaacgtatccatacaggtgagaagccatatgaatgcgacatctgcggcaaaacgttctctaactcctcgggcttgcgcgtccacaagagaatccacaccggagaaaagccgtacgagtgtgacgagtgcggtaaagcgttcattacttgccgcacactcctgaaccacaaatctatacatttcggcgacaagccttacaagtgcgatgagtgtggcaaagcttttagaaataattctggcctgaaagtgcataaaaggattcataccggtgagaggccgtacaaatgtgaagaatgtggaaaggcctacatatcgctgtcaagcctgattaatcataaaagtgtgcatcctggcgagaaaccatttaagtgtgacgagtgcgagaaagccttcatcacctatcgcactctgaccaatcataaaaaggtacacttgggagagaagccttacaaatgtgatgtgtgtgagaaatcgttcaactatacatccttactgagtcagcataggagagtgcatacccgtgagaagccgtacgaatgtgaccgttgcgagaaagtctttcgcaataacagctcactgaaagtccataagcgtatccacacgggagagcgcccctatgaatgcgatgtgtgcgggaaggcttacatttcccattctagcctgataaaccataaaagtacccacccaggtcggaccccacacacctgtgacgagtgcgggaaggcctttttctcgtcaagaacacttatcagtcacaaaagagtgcatttaggcgaaaagccattcaagtgcgttgagtgcggaaagagcttctcatacagtagtctcttaagccagcacaaacggatacacactggggagaaaccctacgtctgtgatcggtgcggtaaggcctttcgaaatagcagcggccttaccgtacacaagcgtattcacaccggagaaaaaccatatgaatgcgacgagtgcgggaaagcctacattagtcacagctcactcataaatcacaaatccgtgcatcaaggaaaacagccctacaattgcgaatgcggtaagagctttaattatcgctctgtgctggatcagcacaagaggatccacactggcaagaagccgtacaggtgcaacgaatgcggaaaggcattcaatatccggtctaatctgactaagcacaaacgaactcacaccggcgaggaaagcctgaacgtaatttacgtcggatcctacagtggcaccagtcaaaagagaacctacgagggcgggaatgcactggacgggggtagaatgcgcatgcccctgtag

SEQ ID NO: 141531 - DNA, 2703 bp, Artificial Sequence
  Description of Artificial Sequence: Synthetic coding sequence
atgtcacacctcaaaaccagcaccgaggatgaagagccaaccgaagaatatgagaacgtgggaaacgcagcctccaaatggccgaaagtggaggacccaatgcctgagagtaaggtcggggacacctgcgtgtgggactccaaagtggaaaatcaacagaagaagcccgtagaaaatcgaatgaaggaggataaaagtagcatccgggaagccatcagcaaggctaagtccacagcgaacatcaaaaccgagcaagagggcgaggctagcgagaaatccctgcacctatctccccagcacatcacgcaccaaacaatgcccattggccagcgtgggtcagaacaggggaaaagagtagagaacatcaacggaacctcctatccgagcctgcagcagaagacaaatgcggtgaaaaagctccacaaatgcgatgagtgtggcaagtcttttaagtataacagccggctagtgcaacacaagatcatgcacacaggggaaaaaaggtacgagtgcgatgactgcggcggaacttttcgcagctcttcaagtcttcgcgtacacaaacgcattcatactggcgagaaaccctacaagtgtgaagagtgtggcaaggcctatatgtcatactcttcactgatcaatcataagagcacacattctggcgaaaagaattgtaagtgtgacgaatgtggcaaatccttcaattactcaagtgtgctggaccaacataaacggatccacaccggcgagaagccctacgagtgcggggaatgtggaaaggcgttccggaactcctccggtctgagggtgcacaagcgcattcatactggcgagaagccctacgagtgcgatatctgtggcaagacattcagtaactcaagcggtttgcgcgtgcacaagcggatccataccggggagaagccttatgaatgcgatgagtgcggcaaggccttcattacgtgtcgtactttgctcaaccataaatctatacactttggagataagccgtataagtgcgatgagtgcgaaaagtcttttaattacagctctctgttgattcagcataaagtcattcacaccggtgaaaaaccatatgagtgtgacgagtgtgggaaggcatttcgcaatagtagcggactgatcgtgcataagcgtattcataccggagagaagccatacaagtgtgatgtttgcggaaaagctttctcctactccagcggacttgccgtacacaagtctatccatccggggaaaaaggcccacgagtgcaaagaatgcggaaaatccttttcttataatagtctgctgctgcagcatcgcactatccacaccggagagcggccatacgtttgtgacgtgtgtggtaagacgtttagaaacaacgcaggacttaaagtccaccgcaggctgcacacaggtgagaagccctacaaatgcgacgtgtgtggtaaggcctacattagtagatcgtcgcttaagaaccacaaaggtattcatctgggggagaaaccatacaagtgctcctattgcgagaaaagtttcaactatagtagcgcactcgagcaacataaaaggatacatactcgagagaagccctttggatgtgatgaatgcggaaaggcctttagaaataattcaggactgaaagttcacaagagaattcacaccggtgaacgaccatacaaatgtgaggagtgcgggaaagcctacatctcactttcctctttgattaatcacaagtctgtccatcctggtgagaagccatttaagtgcgacgagtgcgagaaagcttttattacctacagaacacttacaaatcacaagaaggttcatctgggcgagaagccttacaagtgcgatgtctgcgagaagtcttttaattacacctctctcctgtcccagcaccgacgggtacataccagagaaaaaccatatgaatgtgacagatgcgagaaggtgtttagaaacaactcctctctgaaggttcataaacggattcacactggggagcggccttacgaatgtgatgtctgcggcaaggcatatatttctcatagcagcctcattaaccacaagagtactcatcccggtaggaccccccacacctgcgatgagtgcgggaaggcctttttttccagcagaaccctcatcagccacaagagggtgcacctgggtgaaaaaccattcaaatgcgtggaatgtggcaagagtttctcttatagctcgctgcttagtcaacacaagaggattcatacaggcgagaaaccctatgtttgcgatcgttgtggcaaggccttccgtaacagttcagggctgactgtccacaagagaattcatacgggagaaaagccctacgagtgcgatgagtgtggtaaagcctatatcagccacagtagccttattaatcacaagagtgtgcatcagggaaagcagccatacaactgtgaatgtggcaagtcattcaattatagatcggtcctcgaccagcacaagaggattcacactggaaagaaaccgtaccgatgcaacgagtgcggtaaagcgtttaacatccggagcaacctcacaaaacacaaacgaacccacaccggcgaggagtctctaaacgtgatttacgtggggtcatactcaggcacaagtcaaaaacggacctacgagggagggaatgctctagatggtggccggatgcgaatgcctctctag

SEQ ID NO: 141532 - DNA, 483 bp, Artificial Sequence
  Description of Artificial Sequence: Synthetic coding sequence
atgcctgaaagcaaagtgggtgacacttgcgtgtgggacagtaaggtggagaatcagcagaagaagcccgtggagaacagaatgaaagaagataaatcctccattcgggaggctatctcaaaagccaagtccacagctaatatcaaaacagaacaggagggggaggcctctgagaaatccctgcacctctcgcctcaacatattacacatcaaacaatgccgataggacaaaggggatccgagcaggggaaaagagtggaaaacataaacgggacctcctacccctcccttcaacagaaaacaaacgctgtgaagaagctccacaagtgcgacgagtgcggcaagagcttcaaatataactctcgacttgtccagcacaaaatcatgcacactggggaaaaaaggtacgaatgcgacgactgtggcggtacattccgatcttcctcttctctccgcgtccacaaaaggatccataccggctag

SEQ ID NO: 141533 - DNA, 315 bp, Artificial Sequence
  Description of Artificial Sequence: Synthetic coding sequence
atgccggagagtaaggtcggcgacacatgcgtgtgggactcaaaagtcgaaaaccaacagaaaaagcctgtcgagaaccgtatgaaagaggataaatcgagcattcgggaagctatttctaaggccaagagtaccgccaacatcaagaccgaacaggaaggcgaagcctctgagaaatccctgcacctctctcctcaacatatcacccaccaaacaatgcccatcgggcagcgcggtagcgagcagggtaagagggtcgagaacataaatgggacctcctacccctcactccagcagaaaactaacgcggtgtag

SEQ ID NO: 141534 - DNA, 237 bp, Artificial Sequence
  Description of Artificial Sequence: Synthetic coding sequence
atgcccgagtccaaagtcggtgatacttgcgtgtgggatagtaaggtagaaaaccagcaaaaaaaaccagtcgaaaacagaatgaaggaagataagagcagtattcgggaggcaatcagtaaagctaagagtacagccaatattaagacagagcaggagggcgaggccagcgaaaaatccctacacctcagtcctcaacatatcactcaccagaccatgcccattggtcagcgctag

SEQ ID NO: 141535 - DNA, 2604 bp, Artificial Sequence
  Description of Artificial Sequence: Synthetic coding sequence
atgcccgaaagcaaagtcggggatacctgcgtgtgggatagcaaagtggagaaccagcagaagaagccagtcgagaatcgtatgaaggaggacaagagctccattagagaagccatcagcaaggctaagagtacagccaatattaagacggagcaggaaggagaggcctctgagaagtccctgcacctgtctccccaacatatcactcaccagacaatgcccatcggccagagaggcagtgagcagggtaaacgcgtcgagaacatcaacggaacctcttaccctagcctccagcaaaaaaccaacgccgtgaaaaaactgcataagtgcgacgaatgtggaaaatccttcaaatacaactcgaggctggtgcagcacaaaatcatgcacacgggagaaaagcggtacgagtgcgacgattgcggtgggacgtttagatcgagcagttccttacgggtgcacaagcgcatccacaccggtgagaagccttataagtgtgaggagtgtggcaaggcatatatgtcttacagtagtttgattaatcataagagtacccattcaggtgaaaagaactgcaaatgcgacgagtgcggaaagtctttcaactacagctctgtgctggaccaacacaagaggattcataccggtgaaaagccctatgagtgcggcgagtgcggcaaagctttccggaattccagcggccttagggtgcacaagaggattcatacgggcgagaagccctatgagtgtgacatctgcgggaagacatttagcaattctagcggcctgagagtccataaaaggatccacactggtgaaaaaccatacgaatgtgacgaatgcgggaaagccttcataacctgtcggacgcttttgaaccacaaatccatacatttcggggataagccttacaaatgcgatgaatgtgagaaatcgtttaactattcctcactgctgatccagcataaagtgatccatactggggagaaaccctatgagtgtgatgagtgcggcaaggcattccgcaattcctctggactgatcgttcataagagaatccacacaggggagaagccgtataaatgtgacgtatgtggaaaggccttttcttactccagcggattggctgtccataagtctattcatccagggaaaaaagcacatgagtgtaaggaatgcggaaagtccttttcctataactccttgctgctgcagcacagaaccatccatacaggagaaagaccatatgtgtgtgatgtttgtggcaaaaccttccgtaacaacgctgggttaaaggttcaccgccggctgcataccggtgagaaaccttacaagtgcgacgtgtgcggaaaagcatacatcagtaggtcatcactcaagaaccacaaagggattcatctgggcgagaagccatacaaatgctcgtactgtgaaaagtcatttaattacagcagcgctctggagcagcataagagaattcataccagagagaagcctttcggatgcgacgagtgtgggaaagcgtttcgcaacaacagcggtctgaaggtgcataagcggatccacacaggcgagaggccttacaaatgtgaagagtgtggtaaagcgtacatcagcctgtcatctttgatcaatcacaaatcggtgcacccgggggaaaagccctttaaatgcgacgagtgcgaaaaagccttcatcacctaccgtactctaactaatcataagaaggtgcacctcggggagaagccttataagtgtgatgtgtgtgaaaagtcttttaattatacttctctgctgagccaacaccgccgcgtccatacaagggagaaaccatatgagtgcgacaggtgtgaaaaggtatttcgcaacaatagctctctaaaagtgcacaagaggatccacaccggcgagaggccctatgaatgcgacgtatgtggtaaggcttatatctcccacagcagcttgatcaatcataaatctacacatcccggacgtacaccacacacgtgcgacgagtgcggcaaggccttcttttcgtcaaggaccttgatttcgcacaagcgtgtccatctgggcgaaaagccattcaaatgtgtggaatgtgggaaaagcttttcatacagcagtcttctgtcccagcacaagcggatacacacaggggagaagccctacgtctgtgacaggtgtggcaaagcttttaggaatagctccggactgactgttcataagcggatccacacaggtgaaaagccttacgaatgtgatgaatgcggcaaagcgtatatttctcactctagccttataaaccataagtccgttcaccaggggaagcagccctataactgcgaatgtggcaagtctttcaattaccggtcagtcctggatcagcacaaacggatccataccggcaaaaagccatacagatgcaacgagtgtggcaaggcttttaacattaggagcaatctaacaaagcataagaggacacacaccggtgaagaatcactgaacgtcatatacgttggcagctactccgggaccagtcagaagaggacatatgaagggggcaatgcactggatggcgggaggatgaggatgcccctctag

SEQ ID NO: 141536 - DNA, 1386 bp, Artificial Sequence
  Description of Artificial Sequence: Synthetic coding sequence
atggattccgtggcttttgaggacgtggcagtgaatttcacactggaagaatgggccttactggaccccagccagaaaaacctgtatcgtgacgttatgagagagaccttcagaaacttagccagtgttggtaagcagtgggaagaccagaatattgaggaccctttcaagattccaagaagaaacatctcccacattcctgaaagattatgcgagtcaaaagagggcggtcagggcgaagagacctttagtcagatccccgatggaattctgaataaaaaaaccccaggtgtcaaaccctgcgaatcttccgtgtgcggggaggtgggaatggggccatcatctctaaaccgccacatccgcgaccacacaggacgagagccaaatgagtaccaagagtacggcaagaagtcatatacaaggaaccagtgcggacgtgcattgtcctatcaccgatctttccccgtgcgcgagaggacccaccccggaggcaaaccttatgactgtaaagagtgcggagaaacctttatttccctggtttccatccgccgccatatgttaacacacagaggtggggtcccgtataagtgtaaggtttgcggcaaggcgttcgattatccaagtttgtttcggatccatgaaagatcccacaccggggagaaaccgtacgagtgcaagcaatgtggtaaggcgttctcctgcagctcttacatacggatccacgaacggacccacactggtgataagccttacgaatgtaagcaatgcgggaaagcattttcatgcagcaaatatattaggatccacgagcggactcacactggcgagaagccctatgagtgtaagcaatgcggcaaagccttccgatgtgcaagcagtgtgcgctctcacgagcgtacacatacaggggagaaactatttgagtgcaaagagtgcgggaaggcccttacctgtttggcaagtgtgagaagacacatgatcaagcataccggtaacgggccatacaaatgcaaggtctgcggcaaagccttcgactttccgtccagctttcggattcacgagcgcactcacactggcgagaagccctacgattgcaagcaatgtggaaaggcattctcttgctcttcgagttttcgcaaacatgaacgcatccatacaggtgaaaagccctacaagtgcaccaagtgtggcaaagccttttcccgatcgagttattttaggatacatgagcgaacccatacaggggagaagccgtatgagtgcaagcagtgcggcaaggctttctcacgtagtacatactttcgagtgcatgaaaagattcacaccggtgaaaagccctatgagaaccccaaccccaacgcatccgtagtccctgttctgtcatag

SEQ ID NO: 141537 - DNA, 3168 bp, Artificial Sequence
  Description of Artificial Sequence: Synthetic coding sequence
atggtgggctctcatgcagatatggctccagcctccacagccgagggcgcaggtgagaaaccggggcctgcagcccctgcgcctgccgcccagtatgaatgtggagagtgtggtaagagcttcaggtggagctcacgattattacaccatcaaaggactcacacgggggaaagaccctacaaatgcccagactgccccaaagcgttcaaagggtctagcgcattgctgtatcatcagaggggtcataccggcgagagaccatatcagtgccccgactgtcccaaggcatttaaacggagttcccttctacaaatccaccggtctgtgcatactggcttacgcgcgtttatttgcgggcagtgcggactggcattcaaatggtcttctcactatcagtaccatctgcgtcagcacacaggcgagagaccctacccatgtcctgattgtccaaaggcattcaaaaatagcagtagtcttcgaagacaccgacatgtgcatacgggcgagcgaccctatacctgcggggtgtgtggcaaatctttcacgcaatcgacaaacttgagacaacaccagcgcgtgcacacaggggagcggccttttcggtgtcctctgtgccccaagacctttacacattcatcaaatctgctcctccatcagcgcacacacggcgccgccccggcacccggaactgccagtgcagccccccccccccagagcagggagcctggaaaagtgtttgtctgtgatgcatatctccaacggcacctgcagccccactccccgcctgcccctccagcccccccacctcctccacctccagtcgtgccagaactgttcctggctgcagccgagaccaccgtggagcttgtgtatcggtgtgatggatgcgagcagggtttctcatcagaagagcttttgctggagcatcagccctgtccgggcccagatgcagctccccagccacaggaagcccctgctgaggcccctaaggccgatcaacccccaagccctctgccacagccaccacctcctgctgcagctcctgcaccaggatttgcctgcctaccatgtggcaagagcttccggaccgttgcgggcctctctcgccatcagcattctcacggcgcagctggcgggcaagcgtttcgttgtggatcgtgcgacgggagcttcccccagctggcctcactgctggcccaccagcagtgccacgtcgaggaggccgctgctggccgtccaccacctcaggcagaggccgccgaggtgacttgtccccaggagccattagccccagcagctccagtgcctccgccacccccctccgccccagcctccgccgaaagaccatacaaatgtgcagaatgcgggaagtcctttaagggcagctctggcctccggtaccacctgagagatcacaccggagagcggccgtaccaatgcggggagtgcggtaaagcttttaagcggtcctccttgctcgccatccaccaaagggtccacactggcctcagggcctttacatgtggccagtgtggtttaaccttcaaatggtctagtcattatcagtatcatctccgacttcatagcggagaacggccctacgcttgcggagaatgcgggaaggcctttcggaatacaagctgtttacgaaggcatcgccacgtgcacaccggcgaacggccgcacgcatgcggagtttgcggcaaaagcttcgctcaaaccagtaatctgcggcagcatcagagagtgcataccggagagagacccttccgctgtcccttgtgtccaaaaactttcacacactcaagtaatctactgctccatcagcggacacacagcgcagaaagacccttcacttgcccaatctgtggacgggggttcgttatggccgcgtacctccagagacatcttcggactcacgcacccgccaacacccctccttccacgactgccccggccgcaggcccccagccgccagccccactggctgctgctagagcccccccagccacgcaggatgtccatgtactgccacaccttcaagccacactcagcctggaggtcgccggaggcactgcccaagcaccctccctcgggccagcggcccccaattcccagacctttctgttggtacagacagcccagggactgcaactgattccctcatccgtacaaccccccacccccccccctcctcccgcccctcccaagctcatcctgttacccagctcgagcgctggcgcagggggtggcagggcacgccagggacctcgggccgtgggcaaggccggacagggggcgggtgttgtgtggctgcccggccctgggggtctgggcgtccagggcgccgcatccgctggagccagcggcaccgggcaaagtctgattgttctgcaaaatgtggggggcggagaagcaggccctcaggaaatgagcggcgtccaactgcagccactacggcccgcaccagaggtcacaaccgtgcagttgcaacctgcccaagaggtgacaaccgtgcagctccagccggcccaggaggtgactacggtacaactgcagcccgcacaggaggttaccacagttcaactccagcctgtggccggccaactcagcaattcctcagggggcgcagtggctactgaggctccaaacctgctcgtcgtgcagtctggtgctgccgaagagctgctaacggggcccggcccaggtgaagcgggcgacggcgaggctagcacaggtgtggttcaggatgtccttttcgaaacactacagactgacgagggcctccagagtgtgcttgtattgagtggggctgacggggaacagaccaggctgtgtgttcaagaggtggagacgctcccacccggcctgactgaaccaccagccacaggacctcctggacaaaaactgctcatcatcagatcagcgccggcaacagagctgctcgattcatccaatacagggggcggaacggctacactccaactgttagctccacctcccagtggaccagcgtcaggacccgccggcctcccaggcgcccctgccagccagatggtgcaggtggtgcccgcaggagccggcccgggagtgatgacgccccaggggctacccagcatccagattgtacaaactcttcccgcggtgcagttggtgcacaccttttag

SEQ ID NO: 141538 - DNA, 1602 bp, Artificial Sequence
  Description of Artificial Sequence: Synthetic coding sequence
atggatagatatcagggtaaccaagacagagttctgaggcaggttactgtgatctcacgagagaccctgaccgacgagatggggagcaagtattctgcctttggcaaaatgtttaacaggtgcactgatttagcccccctgagtcagaaattccataaatttgactcctgcgaaaactcattaaaatcaaactccgacttgctgaattacaataggtcctatgccaggaaaaatcctacaaagcgcttccgatgcggccgccccccaaagtacaacgcttcatgtagcgttccagagaaagagggattcattcatactggcatggagccttacggcgattcacaatgtgagaaggttctgagccacaagcaggctcacgtccagtataagaagttccaggcaagagaaaaacccaacgtgtgtagcatgtgcgggaaagcctttattaaaaagagccagctcattattcatcaacgaatacacaccggggaaaagccctacgtgtgtggagattgcagaaaagccttctcagagaaaagtcacctgatagtgcatcaaaggatccacaccggtgaaaagccctatgaatgtactaagtatggcagagccttctctaggaagtccccctttaccgtgcatcagcgggtccacacaggagagaagccatatgaatgcttcgagtgccctaaggcctttagccagaagagccacctgattatacatcagcgcgtgcacactcgggagaaaccattcgagtgctccgagtgtcgaaaggccttctgcgagatgtcccatctgttcattcaccagatcactcacacagggaaaaaaccctacgaatgtacagagtgtggtaagacatttccaagaaaaactcagcttatcattcatcaacggacccacacaggcgaaaagccgtacaaatgcggagagtgcggaaagaccttctgccagcagtcccatttaattggacatcagcgaatacacacaggagagaaaccatatgtgtgtactgactgcggaaaagctttctctcagaagtcccacctcaccgggcaccagcggctccataccggcgagaagccctacatgtgtactgaatgtggcaaaagtttctcccaaaagtcccctttgattattcatcagcgcatccatacaggtgagaaaccttatcaatgcggcgagtgcggcaaaactttttcacaaaagtctctgcttattatccatctgagggtccatactggagagaagccttacgaatgcacagaatgcggacgggccttttccttgaagtcacacctgattctgcaccagcggggacacactggcgaaaaaccatacgaatgctctgagtgcggcaaggctttttgcggaaaatcccccctcatcatacatcaaaagacacaccctcgggaaaagacacccgagtgcgccgaaagtgggatgacatttttctggaagtcccaaatgatcacctatcaacgcaggcacacaggggaaaagccttcgaggtgttcggactgtggaaaggctttttgtcagcacgtgtactttactggacatcagaacccttaccggaaagatacattgtatatttgttag

SEQ ID NO: 141539 - DNA, 1974 bp, Artificial Sequence
  Description of Artificial Sequence: Synthetic coding sequence
atgatcgagagtcaggaacccgtaactttcgaggatgttgcggtggattttacgcaggaagaatggcagcagttgaacccagcacagaaaaccttacaccgagacgtgatgctggagacttataatcatctcgtgtccgtgggctgttctgggatcaagcctgacgtaatattcaaactcgagcacggaaaggacccatggattattgagtcagagttaagccgatggatttatccagatagggttaaaggtttggaaagcagccagcagatcatcagtggtgagctgctgttccagagggagattctggaaagagctccgaaggacaacagcctctactcagtgttgaagatctggcacattgacaatcagatggacagatatcaggggaaccaagatagagtccttcggcaggtgaccgtaattagtcgagagactctgaccgacgagatgggtagcaagtattcagccttcggtaaaatgtttaatagatgtaccgaccttgccccgctgagccagaagtttcacaagttcgactcctgtgagaatagtctcaagagcaacagtgaccttctcaactacaaccggtcgtatgctagaaagaaccccacaaaacgtttccgctgtggcagaccccccaagtacaacgcatcctgcagtgtgcctgagaaagagggtttcatccatacaggaatggagccttatggggacagccagtgtgaaaaagtgctgtcacacaaacaagcccacgtccagtataaaaagttccaggcccgagaaaaacccaacgtgtgttcaatgtgtggcaaggccttcataaagaagagtcaactcatcatccatcagcgcatacacactggcgaaaagccatacgtttgtggcgattgccgaaaggctttctctgagaagagccatttaatagtccaccagcggatacatacaggcgagaaaccatacgaatgtaccaagtatgggagagctttttctcgaaagagtcctttcactgtgcatcagcgggtccacaccggagagaaaccgtatgagtgcttcgagtgccctaaagcgttctcacagaagagccatctcataatacatcagcgagtgcatacaagggagaaaccttttgaatgcagtgagtgccgcaaagccttctgtgagatgagccatttgttcatccatcagattacacacactggaaagaaaccctacgaatgcaccgagtgtggcaaaaccttccccagaaagacgcagctcattatacatcagcggacacataccggcgaaaagccttataagtgcggtgagtgtgggaagacattctgccagcagagccatctcatcggacatcagcggattcacactggcgagaagccatacgtatgcaccgattgtgggaaagccttctcacaaaaatcccaccttaccggacaccagaggctgcataccggcgaaaagccttacatgtgtaccgagtgtgggaagtccttcagtcagaagtcaccactaattatccatcagagaatccacacaggcgaaaagccataccagtgtggggagtgtggaaagaccttttcccagaaaagtttgctgattatccatttacgcgttcacaccggcgagaaaccctacgaatgtactgaatgtggtcgcgccttttcgctgaaatcacacctcatcctgcatcagaggggccacacaggggagaagccctatgaatgttccgaatgcggcaaggctttctgcgggaagtcgcctctcatcatccaccagaaaacccacccccgtgaaaaaaccccagagtgtgcagagtctgggatgacgttcttttggaagtcccaaatgatcacctaccagagacgtcatacaggcgaaaaaccctcccgctgtagtgattgtggaaaggccttctgtcagcacgtttattttacgggacatcagaatccttaccgcaaagacactctgtacatatgctag

SEQ ID NO: 141540 - DNA, 645 bp, Artificial Sequence
  Description of Artificial Sequence: Synthetic coding sequence
atgattgagtcccaagagccagtaacattcgaagacgtagcagtggattttacccaggaggaatggcagcagctcaatcctgcgcagaaaactctgcatcgagacgtgatgctagagacttacaaccatctggtaagcgtggggtgctcagggattaagcccgatgtaatcttcaaattggagcacggaaaagatccttggataatagagagcgagctgtcccggtggatctatcccgatagggtgaaaggcctggagtccagccaacaaattattagtggagagttactgtttcagcgcgagatcttggaacgggcgcccaaagacaatagtttgtacagtgtgctgaagatttggcacatcgataaccagatggaccgttaccagggcaatcaggatcgggtgctgcggcaggtgaccgttatcagccgagagacactgaccgacgagatgggatccaagtatagcgcgtttgggaaaatgttcaatagatgcactgatctggccccactgtcgcagaagttccataaattcgactcctgtgagaacagcctgaagagcaattctgatctcctcaattacaatcggtcttacgcaaggaaaaatccgaccaaacgttttcgatgcggacgccccccaaagtag

SEQ ID NO: 141541 - DNA, 1932 bp, Artificial Sequence
  Description of Artificial Sequence: Synthetic coding sequence
atgattgagtcgcaggaggagtggcagcaattgaacccagctcaaaagacgcttcatagggatgtgatgcttgagacttataaccacctggtctccgtgggatgttccggcatcaagcccgatgttatttttaaactggaacatgggaaggacccatggattatcgagagtgagctaagccggtggatctatccggaccgagtgaaaggccttgagtctagccagcagatcatttccggagagcttctgtttcaacgtgagatcctcgaaagagcccctaaagataactctctctacagtgtactgaagatttggcacattgataatcaaatggaccgctaccaggggaatcaagaccgcgtcttgagacaagtgactgtcattagtcgagagacccttacagacgaaatgggcagcaagtactctgcatttggtaagatgtttaatagatgtacagatctggcaccactgtcccagaaatttcacaaatttgattcttgcgagaacagtctcaagagcaactccgacctgctcaattacaatcggagttatgcacgtaaaaatccaaccaaaaggttccggtgtggccggccccctaaatacaacgctagttgctctgtacccgagaaagagggctttattcataccggcatggaaccctatggtgatagccagtgtgaaaaagtattaagtcacaagcaagcgcacgttcagtacaagaaatttcaggcccgagagaaacctaacgtctgctctatgtgcggcaaggctttcatcaagaagtcccagctcataattcaccagcggattcacaccggcgagaagccatatgtgtgcggcgattgtcgaaaagcctttagcgagaagagccatcttattgtacaccagcgcatccacacaggcgagaaaccttatgaatgtacgaagtacggccgagcctttagtagaaaatcaccctttacagttcaccagcgagtgcacacaggggaaaagccttacgaatgcttcgagtgccctaaggccttctcgcaaaaatctcacttgatcatccatcagagagtccacacccgcgagaaaccgttcgaatgttccgagtgtaggaaggccttttgcgagatgtcacatcttttcattcatcagataacccacaccggaaaaaagccttacgagtgcactgaatgcggtaagacttttccacggaaaacccaacttatcattcaccagcggacgcacaccggtgagaaaccatacaagtgcggagagtgcggaaaaactttctgccagcagtcccacctgattgggcaccagcggatccacaccggtgaaaaaccttatgtatgcacggattgcggcaaggcattttcccaaaagagccacttaacaggccaccagaggctgcacacgggggagaaaccttacatgtgcacagagtgcggcaaatccttcagtcagaaatcaccgttgattattcaccagcgaatacataccggagagaagccctaccagtgcggcgagtgtggaaagacttttagtcagaagtctttactcattattcacttgcgggtgcatactggcgaaaagccttacgaatgcacggagtgcggaagagcattttcactcaagagccacctgattctgcaccagagaggccataccggagagaaaccatatgagtgctcagagtgtggtaaagctttttgtgggaagagtcctctgatcatccatcagaaaactcaccctagggagaagacacctgagtgcgctgaatccggaatgacgtttttttggaagtcacaaatgataacctaccagcggcgtcacaccggcgaaaaaccaagcaggtgttccgattgcgggaaggctttttgtcaacacgtctactttacgggccaccagaatccgtaccggaaggatacactttacatttgttag

SEQ ID NO: 141542 - DNA, 5937 bp, Artificial Sequence
  Description of Artificial Sequence: Synthetic coding sequence
atgtcaagaccgaggttcaatcccagaggcgatttcccacttcaaagacctcgtgcacctaatccatctgggatgaggcctccagggcccttcatgcggcccgggtcaatgggcttaccccggttttatcctgccggtcgagccagaggtatcccacatcgcttcgcgggacacgaatcctaccagaatatgggaccccagcgtatgaatgtgcaggtcactcagcaccgaactgatcccaggctgaccaaggagaaactagacttccatgaggcccagcaaaaaaaggggaaaccccatggctctcgttgggatgacgaaccgcatatctctgcctcggtggcagtcaaacaaagcagtgttacccaggtaacagaacaatctcccaaggtccagtctcggtacacaaaagagagtgcttccagcattctcgcctcttttggtctatctaatgaggatttggaggagctctccaggtacccagacgagcagttgaccccggagaacatgcccttaatcctgagagacattagaatgagaaaaatgggtaggcgtctgccgaacttacctagccaaagtagaaacaaagagaccctgggctccgaggccgtgtcttcaaacgtgatagattacgggcatgcgtctaagtatggctacacggaagatcctttagaggtcagaatctatgaccccgaaattcccactgacgaggtggaaaatgaatttcaatcgcagcagaacatctccgcctcagtgcctaacccgaacgtgatttgcaattctatgttccctgttgaagatgtgttcagacagatggattttccaggggagagtagcaacaatcggtctttcttcagcgtggaatccggtacaaagatgtcaggcctgcacataagcggaggacagagcgtccttgaacctataaaatcggtaaaccagtcaataaaccagactgtgtctcagactatgagccagagtttgattcctccctcgatgaatcagcagcctttctctagtgagcttatctcatcggtgtcccagcaagaacggatcccgcatgaacctgtgatcaactcttcaaatgttcacgtggggtccaggggcagcaaaaagaactaccagtcacaggcagacatcccaatcagatcgcccttcggaatcgtcaaggcctcttggctgcccaagttttctcatgcagacgcccagaaaatgaagaggttacccactccatctatgatgaacgattattatgctgcgtccccacgtatattcccccacctctgctcattgtgtaatgttgagtgctctcacctcaaggattggatacaacaccagaacacctcaacacatatcgagtcatgtagacagctgaggcagcagtatcccgattggaatcctgaaattctccccagccggagaaatgaagggaaccgcaaggagaatgaaacacccaggcgcaggagccattccccaagcccgcgtagaagccgtaggagctcgtcttcccacagattcaggaggagtcgcagtcccatgcactacatgtacaggccacgatcacgcagtcctcggatttgtcatcggttcattagtagatataggtcgcgaagcagaagcaggagcccgtaccgcattcggaatcccttcagaggatcaccaaaatgtttccgcagcgtgtctcccgagcggatgagccggagaagtgtgcgcagtagcgatcgaaaaaaggcacttgaggacgtggtgcagcgttccggccacggtactgaattcaacaaacaaaaacatctggaggcagcagacaagggccactctcccgctcagaaacccaagacgtctagtggaactaaaccgagcgtcaagccaacaagcgcgacaaaatccgatagtaatctggggggtcatagcatacgctgcaagtccaagaatctggaggatgatactctcagtgaatgcaaacaggtgtctgataaagcagtgtctctgcagcggaaactgcggaaagagcagagcctccactacggatcagttttactgatcacagaacttcccgaggatgggtgtaccgaggaagacgtgcgcaagttatttcagcctttcgggaaggttaacgacgtcctcatagtgccatacagaaaagaagcatatctcgagatggagtttaaagaggccatcacagccatcatgaagtacatcgagacgacacccttaacgattaagggcaagagcgtgaaaatttgcgtacccgggaaaaagaaggcacagaataaggaagtaaaaaaaaagacccttgagagcaaaaaggtttcggcctctacgttaaagagggatgccgacgcctccaaggccgtagaaattgtgacatctacatcagccgccaagacaggacaggctaaggcctcagtggccaaagtaaacaaatctacgggtaaaagcgcatcctccgtgaagtctgtagtgaccgtggccgtcaaagggaataaagcttccatcaaaaccgccaaatctggcggcaagaaatctctcgaggcaaaaaagacgggaaatgtgaaaaataaagactccaataagcccgtgactatacccgaaaactctgagatcaaaacttccatcgaggtgaaggccactgagaattgcgccaaagaggccatttcagatgcggccctggaggcgacagagaatgaaccactgaataaggaaacagaggagatgtgcgttatgttggtgtctaatctccctaataagggatattccgttgaagaagtgtatgacctcgcgaagccatttggtggacttaaagacatcctgatcctgagcagccacaagaaggcttacatcgaaatcaatcggaaggccgccgaatccatggtgaaattctatacatgctttcccgtcctcatggacgggaatcaactgtcaatcagtatggcacccgagaacatgaatatcaaggacgaggaggcgatcttcatcacactggtgaaagaaaatgaccccgaagctaatattgacactatttatgatagatttgtgcacctggataatctgccagaggacggcttgcagtgtgtgctttgtgtggggctgcagttcggtaaggtggatcatcacgtgttcatatccaacaggaacaaagcaatcctccagctggactctccagagagcgcccagagtatgtattcattccttaagcaaaacccccagaacatcggcgaccatatgcttacgtgttctctgtctccaaagattgatctccccgaggtccagatcgaacacgatcccgaactggaaaaggagtcaccggggttgaaaaattcacctattgatgagtcagaagttcagaccgcaaccgacagcccttcagtcaagcctaatgaactcgaggaagaaagtacaccttccattcagaccgagacccttgtccagcaggaggaaccatgcgaagaagaagccgagaaagccacctgtgactccgacttcgccgtggaaaccttagaactggaaacacagggagaggaagttaaggaggagatccccctggtggcctcagctagcgtttcgatcgagcagttcaccgaaaatgctgaagaatgcgccctcaaccagcagatgttcaattctgatctagagaagaaaggggctgagattatcaaccctaagactgccctgctgccatctgattccgtcttcgcagaagagcgcaatctcaaaggaatactggaagagagtccttctgaggccgaggattttatcagtggtatcacgcaaacgatggtcgaagcagtggcggaggtcgaaaaaaatgaaacagttagcgagatcctccccagcacatgtattgtcaccctcgtccctgggatccctaccggcgacgaaaagactgtggacaagaagaatatttccgaaaagaagggcaatatggatgaaaaggaggaaaaggaatttaacactaaagaaacccgcatggaccttcaaatcggtactgagaaggcagagaaaaacgagggcaggatggatgccgagaaggtggaaaaaatggcggccatgaaggagaagccggctgaaaatacccttttcaaagcctacccaaacaaaggggtaggacaggcaaataagccagacgaaacctcaaagacctccatactggcagtgtctgatgtgtcttccagcaaaccttctattaaggctgtgatcgtgagtagccctaaggctaaggcgaccgtttccaaaaccgagaaccagaaatccttccccaaatccgtcccaagggatcagattaacgccgagaagaaactgagtgccaaagaattcggcctgctgaaaccgacatctgcacgtagcggcttggccgagtcttccagcaagttcaagccgacccagtccagcctgacgagggggggcagcggcagaatcagcgctttgcagggcaaactgagtaaacttgactacagggacatcactaagcagtctcaggagaccgaagcgagaccctcaattatgaaaagggatgatagcaacaacaaaaccttggctgaacagaacacaaaaaacccaaagagtactaccggacggtctagcaaaagcaaggaagagccactgtttccatttaacctggacgagttcgtaaccgttgacgaggtcattgaagaggtgaatccctcacaagccaagcagaacccactgaaaggaaagagaaaagagactctcaaaaacgtccctttcagtgaactgaaccttaagaaaaagaaggggaaaacctccacccctcggggtgtggagggagagttgagttttgtgaccttggacgaaatcggtgaagaggaagatgctgccgcgcatctggcccaggcgctagtgactgttgatgaggtcattgacgaggaggagttgaacatggaggagatggtcaaaaactcaaactccctgtttactctggacgaattgatcgaccaggacgattgtatttctcacagcgaaccaaaagatgtcaccgtactctccgtggcagaggaacaggatctcctcaaacaggagcgcttggttacagtcgatgagatcggcgaggtcgaggaactccctctgaacgagtcagcagatattacattcgccaccttaaacacaaaaggcaatgaaggggacacggttagggactccattggctttatcagcagtcaggtgcctgaggatccgtcgacacttgtgacagtggacgagattcaggatgactcctccgatcttcatctagtcaccctggacgaggtcacggaggaggatgaagattccctcgccgactttaacaacttgaaagaggaactcaacttcgtgaccgtcgacgaagtcggcgaggaggaggacggcgataatgaccttaaagtagagctggcgcagtctaaaaacgaccaccctacggataaaaaagggaataggaaaaagcgtgctgtggacactaagaagacaaagttagagtcgctgagtcaggtgggacccgttaatgagaacgtcatggaagaggacctcaagacaatgatagagcgccatcttacagcgaaaacccctacgaaaagagttcggattggaaagaccctgccgagtgagaaggccgtggtgaccgagcctgcaaaaggcgaggaagcctttcagatgagtgaggtggatgaagagtccgggctcaaggacagcgagcccgagcggaaacggaagaagaccgaggacagctcaagtggcaaatcggtggccagcgacgtgccagaagaacttgattttctcgttcccaaggcagggttcttttgtcccatttgtagcctattttactccggggagaaggcaatgacaaatcactgtaagtcaaccaggcacaagcagaataccgaaaagttcatggcaaaacagcggaaggagaaggaacagaacgaagccgaggagcgatccagccgctag

SEQ ID NO: 141543 - DNA, 3420 bp, Artificial Sequence
  Description of Artificial Sequence: Synthetic coding sequence
atgtcccgtccgcgctttaaccccagaggtgattttccactgcaacgtccaagggcgccaaacccttccgggatgcgacctcctgggccatttatgcggccaggttcaatggggttacctcggttctacccggctggcagggccagggggattccacatagattcgcaggacacgaaagttaccagaatatgggcccccagcgcatgaatgtacaggtcacacagcacaggaccgacccccgcctgaccaaggaaaaattggacttccacgaggcgcaacaaaagaaaggaaaaccacatggctcgcgctgggatgacgaaccccatatttccgcttcagttgcagtgaagcaatcttctgtaacacaggtaaccgagcagtcaccaaaggttcagagccggtacactaaggagtcagcctcctccatcttggccagcttcggtctgtccaatgaggatttggaagaacttagtcgatatcctgatgagcagctgacgcccgagaacatgcccctcatactcagagacatcaggatgaggaagatgggtcgaagactccctaatctgccctcacagagcaggaacaaagagactctgggttcagaagcggtgtcctctaacgtgattgattatggacatgcctcgaaatacggctataccgaagaccctctggaggtgcgtatttacgatcccgagatccctacagatgaggttgagaacgagttccaaagccagcagaacataagcgccagtgtacccaatcctaacgttatttgtaatagcatgtttccggtcgaggatgtcttcagacagatggattttcccggggagtctagtaataatcgttcctttttcagcgttgaatccggaaccaaaatgtccggtctgcacatatctggcgggcagagtgtacttgagcctataaagagcgttaatcagtctattaatcagacagtatcccaaactatgtctcagagcctgatccccccctccatgaaccagcagccgttttcgtcagagctgattagctccgtcagccagcaagaacgcattcctcacgagcccgtcatcaactccagtaatgtccacgtggggagccgggggtctaagaaaaattatcagtctcaggcggatatcccaattcgcagcccctttggtattgttaaggcatcatggctccccaaattctcacacgcggatgcacaaaagatgaagcgactgccaacaccatccatgatgaatgactactatgctgcttcgcccagaatctttccccacctttgcagtctctgtaatgtagaatgctctcacctgaaagattggatccagcatcagaataccagtacacacattgagtcgtgcaggcagctgcggcaacagtaccccgattggaatccagagatattaccttctcggagaaatgagggcaatcggaaagaaaacgaaaccccccgaaggcgatcccacagcccttcaccgcggcgcagcagacgaagttcaagttcgcaccgcttccgccggtcgcggtcccctatgcattacatgtacagacccagaagtcggtcacctcggatctgccacagattcatttctagataccgaagccgtagtcggtcgcggtcaccctaccggatccgtaacccttttcgtgggagcccaaagtgttttcgctctgtttctccggaaagaatgagccgtcggtcagtgaggtctagcgaccggaagaaggcactagaggacgttgtacagcgttccgggcacggaacagagttcaataaacagaagcacttggaagcagctgacaaaggccatagtcctgcccagaagccaaagacaagcagtggcactaagccttctgtgaaacccacatcagccactaaatccgattccaatctcggcggtcacagcattagatgtaaatcaaagaacctcgaagacgacaccctcagcgagtgcaagcaggtctctgataaggcagtaagtctgcagcggaaactgcgaaaagagcagagtctgcactacgggtctgttcttttaatcaccgagttacctgaggacggatgtactgaggaggatgtccggaaattgttccagccctttggtaaggtgaacgatgtgctgatcgtcccgtaccggaaagaagcttaccttgagatggagtttaaggaggcaatcactgcaattatgaagtacatcgagaccacccctctgacaattaaggggaagtctgtgaagatttgcgtccctgggaaaaaaaaggcccaaaacaaagaggtgaaaaagaaaacactcgagtccaagaaagtgtctgcatctactctgaagagggatgctgacgcttccaaagccgtggaaattgtcaccagcacctccgcagctaagactgggcaggctaaagcgtctgtcgcgaaggttaacaaatctacagggaaaagcgcttcatccgtgaagagcgtcgtgacggtagctgtgaagggcaataaggcaagtatcaaaaccgcaaagtctggcggcaaaaagtcactcgaggcaaagaagactgggaatgtcaaaaataaagattctaacaagcccgtcaccatccccgaaaatagcgagatcaagacgagcatagaagtgaaggctaccgagaactgcgccaaagaagcaatttcagatgctgcacttgaagctactgaaaatgagccactgaacaaggagaccgaagagatgtgtgtcatgctggtctctaatttaccgaacaagggatactctgtagaggaagtgtacgatctcgcaaaaccttttggcggcctaaaggatattctgatacttagtagccataaaaaggcctatatagaaattaaccgaaaggctgccgaaagcatggtgaaattttatacatgtttcccagttctaatggacggtaatcagctctcaattagcatggctcccgagaatatgaacattaaggatgaggaggccatatttattactctcgtcaaagaaaatgatcctgaggccaacattgataccatctatgaccgctttgtgcacctggacaatctgccagaagacgggctgcagtgtgtgttgtgtgtcgggcttcagttcggaaaagtcgatcatcacgtgttcatctcaaatagaaacaaggccatcctacagctggattctcccgagtccgcccagtctatgtattctttccttaagcagaacccgcaaaatatcggcgaccacatgctgacctgtagtctaagtccgaaaatcgacctccctgaggtacaaatagagcacgatccagaactggagaaagaacgtctgtggctgagcaaaacactccgtatcttgaaagccctcctggtggaggtcccaaaccttaaaaggtcacactactttcacctgatatggatgaacctccttctgtggatgagactgtag

SEQ ID NO: 141544 - DNA, 2445 bp, Artificial Sequence
  Description of Artificial Sequence: Synthetic coding sequence
atgtcccgcccccggtttaatcctcgcggcgattttccgctgcaaagacctcgggcacccaaccccagtggaatgagaccccccggtcctttcatgcgacctggttctatgggtttgcctaggttttaccctgctggaagggctaggggtatcccccatagattcgctggccatgaatcttaccagaacatgggaccgcagcggatgaacgtgcaggtcacacagcaccggaccgacccgaggctaacgaaggagaagcttgatttccatgaggcgcagcaaaagaagggaaaaccccacggcagtaggtgggatgatgaaccccatatctcagcgagcgttgccgtgaagcagtcttcagtgactcaggtgaccgagcagagtccaaaggtccagtccaggtacactaaggaaagcgctagcagcatccttgcaagtttcggcctgtccaatgaggatcttgaagagctgtcgcgctacccggatgagcagctcacaccggaaaatatgcccctaatccttagggacatccgcatgcgcaaaatggggagaagattgccaaacttgccttcccagtcacgtaacaaggaaaccctgggaagcgaagcagtctcttccaacgtcattgattatggccacgcctccaagtatgggtacacggaagatccactcgaagtcaggatttacgatcctgaaatccccactgatgaagtggaaaacgagtttcagtcccagcagaatatcagtgcaagtgtccctaatcctaacgtgatctgcaactccatgttccccgtcgaggatgtgttccggcagatggatttccccggagagagcagcaacaataggtcctttttctctgtggagagtggaacaaaaatgagcggactgcatattagcggggggcagtccgtcttggaaccaatcaaaagcgtgaaccagtccatcaatcagactgttagtcaaacaatgtcgcaatcactcattccacctagcatgaatcagcaaccgttctcctccgaactcatttctagcgtgagccagcaggagagaatcccccatgaaccggtcatcaacagttcaaatgtgcatgtgggaagtcggggtagtaagaagaactaccagtctcaggcagacattcccattcggtcccctttcggcattgttaaggcaagttggctccccaagttctcccacgctgacgcccagaagatgaagcgcttgccaaccccatccatgatgaatgattattacgctgcctcgccaaggatctttccccatctgtgctccttgtgtaacgtggagtgtagccacctgaaggactggattcagcaccagaacacttcgacacatatcgaatcgtgcaggcagctcaggcagcaatatcctgattggaatcccgagatcttgccatcaaggaggaacgagggcaatcggaaagaaaacgagacccctcgccggagaagccactccccctcccccagaagaagccgccgaagttccagctctcaccggttccgtaggtcccggtcaccaatgcactacatgtatagacccaggagccgtagtcctcgcatttgtcacagattcatatctaggtatagatccaggtcacgcagtcgaagcccatatcgcattaggaacccgttccgaggctctccaaaatgcttccgcagtgtaagtcctgaacgaatgagccgccggagtgttagaagcagcgaccggaagaaagctctcgaagatgtggtccagcgctctggacacggcaccgagttcaataaacagaagcatttggaagcagccgacaaaggccactccccagcccagaaacccaagacatctagtggtaccaagccctctgtcaagccaaccagcgctacaaagagtgacagtaacctcggcggacactcaattaggtgtaaaagcaaaaacctcgaggacgatacactatcagaatgtaagcaggtatctgataaggcagtgtctctccagcgaaaattaaggaaggaacagtccctgcactatggatctgtgttgctaattaccgagctgcccgaagatggatgtaccgaagaagacgtgcgcaagctttttcagcctttcggcaaagtgaacgatgttctcattgtaccttaccggaaagaagcatatctggaaatggagtttaaggaggcaatcacagccattatgaaatacatcgaaacaactccactgactataaaggggaagagtgtaaagatatgtgtgcctggaaaaaaaaaagcccagaacaaagaggttaaaaagaagaccctcgagtcaaagaaggtgagcgcatccaccctgaagcgggatgctgatgcgtccaaagctgttgagatcgtaacatccacatccgcaggtctgttgccaacaggcggagggaacaattacccgcagatcgtgctcgccccaggcttgtgtcactag

SEQ ID NO: 141545 - DNA, 2643 bp, Artificial Sequence
  Description of Artificial Sequence: Synthetic coding sequence
atgcctcgggatggagtacctgctggcaacactacacctgccgctgcacaggcagcggcacagtcaccggactctgcaactgcaggggcacctcaggtcctcgactctctgaagagataccctgattggaaccctgagatactcccatcgcgtaggaatgaggggaaccgcaaggagaacgaaacaccgaggcgaaggtcccatagcccctccccaaggcggagcaggagaagttcttcttcccacagatttcgtaggtctagaagtcccatgcattatatgtaccgcccccgatcgaggtcgccgcgcatctgtcatagattcatcagcaggtaccgctcccgctcccggagccgctccccttatcggataagaaatccatttagaggtagtcctaagtgctttcgctccgtaagccctgagcggatgagtcgtcggtccgtgagatcttctgaccggaagaaggcgctggaggatgtcgtgcagcggagcggtcacggcaccgagttcaacaaacagaagcacctggaggctgccgataaagggcatagtccagctcagaagcccaagaccagcagcggaacaaaaccaagcgtaaagcccacctctgcaaccaagtcagactccaaccttggtggacactctataaggtgcaaaagcaaaaatcttgaagacgacacgctctccgagtgtaaacaggtgagcgataaagcagtctccttgcaaagaaagttacgcaaagagcaatcactgcactatggatccgttctgctgataacagagctgccggaggatgggtgtaccgaagaggacgttcgcaagctgtttcagccattcggaaaggtcaacgatgtcctgatagtaccataccggaaggaggcataccttgaaatggagttcaaggaagccattactgcaattatgaagtacattgaaaccacaccgttgacaatcaaagggaagtctgtaaagatatgtgttcccggtaagaagaaagcccaaaacaaagaagttaaaaaaaagaccctggaaagcaagaaggtctcagcctctaccctgaaacgggatgctgatgcttctaaggccgtggagatcgtaacatctacatcagcagccaaaacgggccaggctaaggcctcagtggcaaaggtgaacaagtcgacagggaagtcagcaagttccgtcaagtctgttgtgaccgtggccgtgaaggggaacaaggctagcattaagactgcgaaatccgggggaaagaaaagtctggaggccaagaagacagggaatgtgaagaacaaagacagcaataagccagtgacgattcctgagaactctgagatcaagacaagcatcgaagttaaggccactgagaactgcgctaaggaagctatctcagacgcagctctggaggccacggagaacgagccactcaataaagagacggaggagatgtgcgtaatgttggtttccaatctgccaaacaagggctattctgtagaagaggtttacgacctggctaagcctttcggcgggcttaaggatatcctgattctgagttcccataaaaaagcttacattgagatcaatcgcaaggcagccgagtccatggttaaattttacacatgcttccctgtcctgatggacggtaatcagctcagtattagcatggcaccagagaatatgaacattaaagatgaggaggcaatcttcatcaccctcgtgaaggaaaatgacccggaagctaatatcgacaccatatatgatcgattcgtgcatctggataatctgcctgaggatggtttgcagtgcgtgctttgtgtgggcctgcagtttggcaaagtggaccaccacgtttttatcagcaataggaacaaggctattctgcagctcgactctccagaatctgcccaatccatgtacagtttcctcaaacagaatccacagaatatcggcgaccacatgttgacatgtagtctctcccccaagattgacctgcccgaggtccagatcgagcacgatcctgagctggagaaggaatccccaggcctgaagaattcccctattgatgagagcgaagtacagacagctaccgactctcccagcgtgaagcctaacgaattagaagaagagagtacccctagcattcagaccgaaactctagtgcagcaggaagagccgtgcgaagaagaagcggagaaagctacttgtgattcagactttgccgtggaaaccctggaattagaaactcagggcgaggaggtcaaggaggaaatacctctggtcgcctctgcgagcgtgagtatagagcagtttacagagaacgccgaggagtgtgctctgaaccaacaaatgtttaactccgacttggagaaaaagggggctgagatcattaaccctaagactgccttgctgccctccgattcagtattcgcagaggaaagaaatctgaaaggtatcctcgaagagtctccctcggaagctgaagattttatcagcggtataacacagactatggtggaggctgtggcagaagttgaaaaaaacgaaacagtttcagagattctccccagcacctgcatcgttacactggtgccaggaatcccaaccggcgatgaaaaaacagtcgataagaaaaatatcagctag

SEQ ID NO: 141546 - DNA, 2757 bp, Artificial Sequence
  Description of Artificial Sequence: Synthetic coding sequence
atggacagccccccacttaaagccctcaactcaaactccatttacttccttctgttgtttcattgtatgctcatcagcgaagtgcagattgagcatgatcctgagctcgagaaagaatctccaggactgaaaaacagtcctatagatgaatccgaagtgcagacagctaccgacagcccatctgtgaaacccaatgaactagaagaggaaagcacaccatcaattcagaccgagacgcttgtccagcaggaagaaccttgtgaagaggaggcagaaaaagctacatgtgattctgattttgcggttgagacactagagttggagacccagggggaagaagtcaaggaagaaattcctctggttgcgagcgcatccgtgagcatcgagcagttcacagagaacgccgaagaatgcgcacttaaccagcagatgtttaactccgatctcgaaaagaaaggcgccgagatcataaacccgaaaaccgccctcttacctagtgacagcgtgtttgcggaggaacgcaacttgaagggcatcctggaggaaagccctagcgaggccgaggactttataagtggtattactcagacgatggttgaggcggtggctgaggtcgagaagaatgaaactgtttctgaaatcttgccaagtacatgtatcgtgacattagtcccagggattccgactggagatgagaaaacagtggacaagaaaaatataagcgagaagaaaggaaacatggatgagaaagaagagaaggaattcaacactaaagagaccaggatggatcttcagatcgggacagaaaaggccgagaagaatgaaggccgaatggacgcggagaaggtggaaaaaatggcagccatgaaagaaaaacccgccgagaatactttgttcaaagcctaccctaataaaggggtgggccaggcaaataagcctgacgagacctcaaaaaccagtatcctagcggtgtcagacgtgtcctcatcaaaaccgtccattaaggctgttatagtgagctcccctaaagccaaggccacagtgagtaagacagaaaatcagaaatcattcccaaagtccgtgccccgcgatcagatcaatgcagaaaaaaagctctctgcgaaggaatttggactcttaaagcctacctccgccaggtctggattagctgaaagcagctccaaattcaaaccgacacaatcctctcttactcgtggtggctcaggaagaatctctgcccttcaaggaaaattgagcaaacttgactaccgcgacattactaagcagagccaggagaccgaggcccgcccctccattatgaagcgggatgattctaataacaagaccctggccgagcaaaacacaaagaatcccaagtcaaccaccgggagatcttcgaaatcgaaagaggagccccttttccctttcaacctggatgagttcgtcacagtcgacgaggttatcgaagaagtcaatcctagtcaagccaaacaaaaccccctgaaaggtaagcgaaaggagactctaaagaacgtcccattctcagagctgaatctgaagaagaagaagggaaagactagtactccacgaggtgtggagggcgaattgtcgtttgtgaccttggacgagattggcgaggaagaggatgccgctgcgcatctggcccaagcactggtgacggtggacgaggtgatcgacgaggaggaacttaatatggaggagatggtgaagaatagcaacagcttgttcactctggatgagctcattgatcaggatgactgcatctcacactctgagccgaaagatgttactgtgctgtcggtagctgaagagcaggaccttctgaagcaggaacgtctcgtgacggtcgacgaaattggcgaggttgaagaactgcccctcaatgagtcagcagacatcacgttcgcgacactgaatacaaaaggaaacgaaggcgataccgtacgtgattctattggcttcatctctagtcaggtccccgaagaccccagtacactcgtgaccgttgatgaaatccaggacgactcttctgacctacatttggtgactctggacgaagttacagaagaggacgaggactctttggcagactttaacaatctgaaagaggaactgaatttcgtcacagttgatgaagtgggagaggaagaagacggggacaacgatctgaaggttgagcttgcacagagcaagaatgatcacccaacggataagaaaggcaaccgaaaaaaacgggcagtggataccaaaaagacgaagctcgagagcctgtcacaggtggggcctgtcaatgaaaatgtgatggaggaggatcttaaaactatgattgaacggcatctgaccgctaagaccccaacgaaacgcgtgcgaatcggcaagacacttccatctgaaaaggcggttgtgactgaacctgcaaagggggaagaggcattccaaatgagcgaggttgatgaggaatccggactaaaggactccgagccagagcgcaagcgcaaaaaaactgaggattcatcatcgggcaagtccgtggcttctgacgtgcccgaggagctggacttcttagtacccaaagccggttttttctgtcctatttgctccttattctactctggcgagaaggctatgaccaatcactgtaagtcaaccagacacaagcagaacacagaaaaattcatggctaagcagaggaaggagaaggaacaaaacgaggctgaggagaggtcctcccggtag

SEQ ID NO: 141547 - DNA, 5937 bp, Artificial Sequence
  Description of Artificial Sequence: Synthetic coding sequence
atgtcgaggccccgattcaacccccgcggggatttcccattacagaggccacgtgcgcctaatccctcgggcatgaggccgcccggcccgttcatgcgaccagggtccatgggcctgccaagattctaccccgctggacgcgcccgcggaattccccaccggtttgctggacacgaaagctaccaaaacatgggtccccagcgcatgaatgttcaggtaactcagcaccggactgatccaagattaaccaaagaaaagctggattttcacgaggcacagcagaagaagggcaaaccacatggatctcggtgggacgacgagccgcacatctcagcctccgtagccgttaaacagtcaagtgtgacacaggtgaccgaacagtcccccaaggtgcagtctaggtacaccaaggagtcagcttcctcgatactcgcgtcgtttgggctttccaatgaagatttagaagaattgtctcgctaccccgatgagcaactgacccctgaaaacatgccactgatccttagagacattcggatgcggaagatggggcggcgcctccccaacctgccttcacagtccagaaacaaagagaccttgggttcagaagctgttagctcgaacgtcatagactatgggcacgccagcaaatacggatacaccgaggatccgctggaagtgaggatctacgaccccgaaattccgacagacgaggttgagaatgaatttcagtcacagcagaacattagtgcaagcgtcccaaaccctaacgtgatttgcaactccatgtttccagtagaggacgtgttccgccaaatggattttcccggcgagtcatctaataacagatccttcttcagtgtggagtctgggacaaaaatgtctggtttacacatttcaggcggccaatctgtgctagaacccattaaatcagtcaaccagtctatcaaccagactgtaagccagaccatgagtcagtctctgatcccaccaagtatgaaccagcagccgttcagcagtgagctgatttcctccgtgagccaacaggagagaattccacacgaacccgtcattaattcttcaaacgtgcatgtcggatcccggggttccaaaaaaaattaccagagtcaggccgacattcctatcaggtcccccttcggaatcgtcaaagccagctggctgccaaaatttagccatgcagatgcccagaagatgaaaagactacctacaccctctatgatgaatgactattacgccgccagccccagaatctttccccatctgtgcagcctgtgcaatgtggagtgcagccatcttaaagattggatacagcaccaaaacacttctactcacattgaaagttgcagacagttgcggcagcagtaccctgactggaaccctgagattctgccttccaggaggaacgaaggaaataggaaagagaacgaaaccccacggagacgaagccattctccttctccgagaaggtctcgacggtcctctagcagccaccgtttccgccgctccaggagcccaatgcattatatgtaccgacctcgaagccgctcccctcggatctgtcatcgctttatttcaagataccgctcacggtcgcgctccaggagcccctatagaattaggaaccccttccgaggaagtcccaaatgttttcgtagtgtaagcccagaacgcatgagccgtagaagtgtccgctctagcgataggaaaaaagccctcgaggatgtggtgcagcgctcggggcacggcactgagtttaacaagcaaaagcacctcgaggccgctgacaagggccactccccagcccagaagcctaagaccagctcaggaactaagccttcagtcaaacctacaagcgcaacaaaaagtgactctaacctggggggacatagcattcggtgcaagtcgaaaaacttggaagatgacactctcagcgagtgcaagcaggtcagtgataaagcagtatcccttcagcgaaaactgcgcaaggagcagagtttgcactatggctctgtacttcttattacggagctccccgaagacggttgtactgaggaggatgtgcggaaacttttccagcctttcggcaaagtgaatgatgtcctgatcgttccttaccggaaagaggcatatctggaaatggagtttaaggaggccatcactgctattatgaaatacatcgagaccacccctttgaccataaagggtaagtctgtaaagatctgcgtgccagggaaaaaaaaggctcagaacaaagaggtaaaaaagaagactttggagtctaagaaggtgtctgcctcaactcttaagcgggatgcagatgcgtcgaaagccgtagaaattgtgacatccaccagcgccgccaagaccggacaagccaaagcaagcgttgccaaagtgaataaatcgactggaaagtccgcctcctctgtgaagagcgtggtgacggtggcggtgaagggaaacaaagcctctattaagaccgccaaatccgggggtaagaaatctctggaagcgaaaaaaacagggaacgttaaaaacaaggattcaaacaagccagtcacaatcccagaaaatagtgaaatcaaaacctctatcgaggtcaaagcaaccgaaaattgcgcaaaagaagcaatttcggatgcagcgctggaagctacagagaatgagccactgaacaaggaaactgaggaaatgtgtgtcatgctcgtgagtaacctgcccaacaaaggttacagcgttgaagaggtttatgatcttgccaaaccttttggcggcttgaaagatattcttattctcagcagccacaagaaagcatacatcgaaattaatcgcaaagcggcggagtcaatggtgaagttttatacatgtttccctgtccttatggatggaaatcaactctctatcagcatggctcctgagaacatgaatattaaggacgaggaggccatcttcataaccctggtgaaggagaacgatcccgaagctaacatcgataccatctacgaccggttcgtacatctcgataatctgccagaggacggactccaatgtgttctctgcgtcggacttcaatttgggaaggtggaccaccacgtctttatttcaaatagaaacaaggcgatcctgcagctcgattcacctgagagtgcccaatccatgtacagttttctgaaacagaacccacaaaatatcggggaccatatgctgacatgctccttgtctcccaaaattgatctgccagaagtgcagattgagcacgaccccgaactggagaaggaatcccccggactcaagaatagtcctatcgacgagagtgaggtgcagacagctactgatagcccctcagtgaagcccaacgaacttgaggaggagtccactccctcaatccagaccgaaaccctagtgcaacaggaggagccttgtgaagaggaagcagagaaggcgacctgcgattccgattttgcagtggaaacgttggagctggaaacccaaggcgaagaggtcaaagaggagattcccctcgtagcgtctgctagcgtttctattgagcaatttacggagaacgcagaagaatgcgctttgaatcaacagatgttcaatagtgaccttgagaaaaaaggcgcggaaattatcaatccaaaaacagcactgttgcctagcgactccgtctttgcagaggagagaaacctgaagggcatcctcgaagagagcccctctgaagccgaggatttcattagcggaatcacccagacaatggtggaggcggtggccgaggtggagaagaacgagacagtttccgagatcctgccttccacttgtatcgtaacgctggtgcctggaattcccacaggcgacgaaaagacggtagacaagaagaacatctctgagaaaaaaggaaatatggacgagaaggaagaaaaggaattcaatactaaggagactcgtatggaccttcagattggtactgagaaggccgagaaaaacgaggggcgcatggatgcggagaaggtggagaagatggcagccatgaaagagaagcctgccgaaaacacactgtttaaggcttaccctaataaaggcgtcggtcaggcaaataaacctgacgagacatcaaaaacgagcatcctcgccgttagcgacgtctcaagcagcaagcctagcatcaaagcagtgatagtgtcaagcccaaaggctaaggcaaccgtctcaaagacagagaatcagaagtcattccccaagtctgtgcccagagatcagattaatgctgagaagaaacttagtgcaaaagaattcgggctcctcaaaccgacctccgctcgatcaggcttggcagaatctagttccaaatttaagccaacgcaatccagcctcacgcgtggtggatctggccggatttccgcccttcagggtaaactgagcaagttggactaccgggatatcacaaagcagagtcaggaaactgaggccagaccgagtatcatgaagcgggacgattccaacaataagaccctagccgaacagaatacaaagaatccgaagagtactaccggcagaagtagcaagtccaaggaggagcctctctttcccttcaacctcgatgagttcgtgaccgtggatgaggtcatagaggaggtgaacccttctcaagcaaaacaaaatccactcaaggggaaaagaaaagagactttaaagaatgttcccttttcagaactcaacctgaagaaaaaaaaggggaagacaagtacgccgcgaggggtggagggcgaactaagctttgttacccttgacgagatcggcgaagaagaagacgctgccgctcatctggcccaggctcttgtgactgtggacgaggtgatcgatgaagaagagttgaatatggaggagatggtgaagaacagcaattccctgtttacactagacgagctcatagatcaggacgattgcatcagccatagcgagccgaaggacgtgacagtactctcagtcgcagaggagcaagacctcctgaaacaagagagactcgtgacagttgatgagattggcgaggtagaagaattgccgctgaacgagagtgcagacatcacttttgcaaccctaaatacaaagggcaatgagggcgacaccgtacgtgactccattggattcatctcgtctcaggtgcccgaagacccctctacgttagtgaccgtcgacgaaatacaggacgactcctccgacctgcatctggttacgctggatgaagtcaccgaggaagatgaagacagcctcgctgatttcaataacttgaaagaagagttgaactttgttacagtcgatgaggtgggcgaggaggaggacggcgacaatgacctgaaggtggagctggctcagagtaaaaatgaccaccccactgataagaagggaaatcgcaaaaagcgggctgtcgacaccaagaagaccaaattggaatctctgtcccaagtaggaccagtgaacgagaatgttatggaggaggacttgaagaccatgatcgaacgacatctcactgctaagacaccgacgaaaagggtgcgaatcgggaaaactctgccctccgaaaaggccgttgtcactgagccagcgaaaggggaggaggccttccaaatgtccgaagtggacgaagagtcagggctgaaagatagcgaaccagagcgtaaaagaaaaaagaccgaggactcaagcagcggtaagagcgtggcctctgacgtccctgaggagctggactttctcgttcctaaagccggatttttttgcccgatctgctccctgttctactcaggcgagaaggctatgacgaatcattgtaaatcaaccagacacaagcagaataccgaaaaattcatggcaaaacagcggaaggaaaaagaacagaatgaggctgaggagcgcagcagcagatag

SEQ ID NO: 141548 - DNA, 90 bp, Artificial Sequence
  Description of Artificial Sequence: Synthetic coding sequence
atgtctaggcctaggtttaaccccaggggggactttcctctgcaaaggccacgggccccaaacccttccggaatgaggccacccggttag

SEQ ID NO: 141549 - DNA, 594 bp, Artificial Sequence
  Description of Artificial Sequence: Synthetic coding sequence
atgagcagacctagatttaacccccgcggcgatttccctttgcagcggcccagggctccgaacccgtccggtatgcgtccccccggacctttcatgcgacctggaagcatggggctgcctcgattctaccctgctggtagagctcgaggaataccccacagatttgcaggccatgagtcctaccaaaatatgggtccacagcgaatgaatgtccaggtcacccagcaccgaactgatcccaggctgacgaaggaaaagcttgatttccatgaggcccagcagaagaaggggaaaccccacggcagccgctgggatgacgaaccccacatctcagcttctgtggcagtgaaacagtccagtgtaacccaggtcacggagcagagtccaaaagtgcagagtcgctacactaaggaaagcgcttcatccatcttagcatctttcggtctcagtaatgaggacttggaagaactgagcaggtatcctgacgaacagctgaccccggagaatatgcccctgatactgcgggatatcagaatgcgaaaaatggggcggaggctgcctaacctgccatcccagtctagaaacaaggaatag

SEQ ID NO: 141550 - DNA, 111 bp, Artificial Sequence
  Description of Artificial Sequence: Synthetic coding sequence
atgagcaggccaaggtttaatccccgtggagattttccattacaacgccccagggcccctaacccctctgggatgagacccccaggcccatttatgcgccccggaagctag

SEQ ID NO: 141551 - DNA, 189 bp, Artificial Sequence
  Description of Artificial Sequence: Synthetic coding sequence
atgagcagaccccggtttaacccacgcggtgatttccctctgcagagacctagagctcccaatccatctgggatgaggccacccggcccgttcatgaggccaggctctatggggctccctcgattttacccagccggcagagctcgtggcatcccacaccgattcgcgggacatgaatcgtaccagtag

SEQ ID NO: 141552 - DNA, 189 bp, Artificial Sequence
  Description of Artificial Sequence: Synthetic coding sequence
atgtcgcggcccaggtttaatcctcggggcgactttccgctgcagaggccaagagctcctaacccttccggcatgagaccccctggtccttttatgagacctggctccatggggctgccacgcttctatccggccggcagggcccgggggataccgcatcgtttcgctggccatgagagctatcagtag

SEQ ID NO: 141553 - DNA, 1758 bp, Artificial Sequence
  Description of Artificial Sequence: Synthetic coding sequence
atggacagccctccgcttaaggccttgaacagcaattctatctacttcctgctcctgtttcactgcatgctgattagcgaggtgcagattgaacatgatccggagctcgagaaagagtccccagggctgaagaattcacccattgatgagagcgaggtgcagacagctacagactctcccagcgtcaaacccaatgagctcgaggaggaatctacaccctccatccagacggagacactcgtacagcaggaagagccttgtgaagaagaggctgaaaaggccacttgcgattccgattttgctgtcgagaccctcgagctggaaacacagggggaggaggtgaaggaggaaatccctctagtggcaagcgcaagcgtctctattgaacagttcactgagaatgctgaggagtgcgccttgaatcagcagatgttcaactccgaccttgaaaaaaagggagctgagataattaatcctaaaaccgcactgctgccatccgattcggtcttcgccgaggagcgcaacctgaaaggaatcttagaggagtccccttctgaggcggaagatttcataagcggcattacacagactatggtagaggcggttgctgaggttgagaagaacgagactgtgtcagagattttgcctagcacctgcattgttacattagtacccggtatccctacaggcgacgaaaaaactgtggataagaagaatataagtgaaaagaaaggaaacatggacgaaaaagaggaaaaggaattcaacacaaaggagaccagaatggacctgcaaatcgggaccgaaaaggcagaaaagaatgagggccgtatggatgctgaaaaggtggaaaaaatggctgccatgaaagagaaaccagccgagaacacactattcaaagcctacccgaacaaaggggtcgggcaggctaataagccagatgagactagtaagacgtcgatcctggccgtgtccgatgtgtcaagctccaagcctagcatcaaagctgtcatcgtgtctagccccaaagctaaggctactgtttctaaaacagaaaaccagaagtcctttcctaagagtgtccctcgagatcaaattaatgccgagaaaaaactgtccgcgaaggaatttggcctgcttaagccaacatcagctcggagtggtcttgcagagtcctcgtcaaaatttaaaccaacccaaagcagtctgacgcgtggggggagtggacgcatttccgctttgcaaggtaagctcagcaaactggattatcgcgacatcaccaagcagagtcaggagaccgaagccaggcccagtatcatgaagcgcgatgacagtaataacaaaaccctagcagaacagaacacaaaaaatccaaaaagcacaactgggcgctcttctaagtctaaggaagagccgctttttccttttaacctggacgaatttgttacagtcgatgaggtgatcgaggaagtaaatccctcccaggctaagcagaaccctctcaagggcaagagaaaagagactctgaaaaatgtgccatttagcgagttgaacttgaaaaaaaagaaggggaagacaagtacccccaggggggttgaaggggagctgtccttcgtcacacttgatgagatcggggaggaggaagacgccgcagctcatctggcccaagcccttgttaccgtcgacgaggtcatcgacgaagaggagctgaatatggaagagatggtaaagtttaaatttaccttttatataaggtag

SEQ ID NO: 141554 - DNA, 3075 bp, Artificial Sequence
  Description of Artificial Sequence: Synthetic coding sequence
atgcctcgggacggcgtaccagcaggcaacactactccggccgctgcacaagctgccgcacagtcacccgacagtgcgaccgccggagccccccaggtattggactcactgaagcggtttgtgctgttccttgagaactttgcccccctggtcaattctctgaatttaggcatcgctaacccactcctgctgggcccgagtccgctgcactttgcacaaatcaagacacagttggccctgcaacagctgaacgccgtagcctcgcatggctccactcccccatacactcttcttaaccaagccttcttgaaaattgccatgtccaggcctcgttttaacccccgtggagacttcccgttgcagcggccgagagctcctaacccgtccggcatgcggcctcccggacctttcatgaggcccgggtcgatgggacttcctaggttttaccccgccggaagagcaagagggatcccacaccggttcgccgggcacgaatcctatcagaacatgggcccgcagaggatgaacgttcaggtgacgcagcacaggacagacccaaggttgacaaaagaaaagctggactttcacgaagcccaacaaaagaaaggcaaaccccatggcagccgctgggacgatgagccacacattagtgccagtgtggccgtgaagcaatcgtctgtaactcaggtcaccgagcagtcgccaaaggtgcaatcccggtatacaaaggagtcggccagcagcattctggcctctttcggcctatcaaacgaggatcttgaagagttaagccgttatcccgacgagcagcttacaccggagaacatgccactaattcttagagatattaggatgagaaagatgggccgaagactccctaatctccctagccaatctaggaataaagaaactctggggtcagaggctgtgagttcaaacgtgattgactatggacatgcgagtaaatatggctatactgaagatcccctggaagtaagaatatatgacccagagattcctaccgacgaggtcgagaacgagtttcaaagccagcagaacatatcagcatctgttcccaaccctaatgttatctgcaactctatgtttcctgtggaagacgtgtttcgccaaatggattttcccggggaaagcagtaataaccgcagtttcttttccgtggagtccggcactaagatgtcggggttgcatatttcgggaggtcagtcagtgctggagcccattaagtccgtgaatcagagcataaaccagactgtgagtcagactatgagccaaagcctgataccaccttccatgaatcagcaaccattcagtagcgagctgatctcaagtgtcagccaacaggagagaatcccacacgagcctgtgataaattctagcaacgtgcacgttgggtcacgcggttccaaaaaaaattaccagtctcaagctgacatacccattcggtctccttttggcatcgtgaaagcctcttggctgcccaagttttcacacgcagacgcacagaaaatgaagcgcctgcccacacccagcatgatgaacgattattacgccgccagccctagaatttttccacacctgtgctcgctgtgcaacgtggagtgttcccacttgaaggactggatacagcaccagaacaccagcacacatattgaatcctgccgacagttgcgtcagcagtacccggattggaatcctgaaattcttccgtccaggcggaatgagggaaatcgtaaggagaatgagacaccccggcggcgctcccactccccgagcccccgtcgctctagacgtagctcaagcagtcatcgttttcgcagatccagaagccctatgcattacatgtatagaccgcgctctcggagtcctaggatctgccatcgtttcatcagccggtacaggtctcggtcgcggtcgcgcagcccttaccgaatccgcaaccctttcagagggagccccaagtgcttccgctctgtttctcccgagcggatgtctaggcggagtgtccgctcaagtgaccgaaagaaggccctagaagacgtcgtccagaggagcggccacgggacagaatttaacaagcagaaacacctagaagcagccgataaaggccactctcctgctcagaagccaaagacaagttcaggcaccaagccttcagtcaagcccacctctgccacaaaatccgactccaatctgggcggccactccattcggtgcaagtctaagaacttagaagatgataccctttctgagtgtaaacaggtttctgacaaggctgtctcccttcagcgcaagttgcgcaaagagcagtcacttcactatggaagcgtcttgctgatcacggagctgcctgaagacggttgcacagaggaggacgtccgaaaactcttccaaccattcggtaaggtcaatgacgtgctgatcgtcccatatcggaaggaggcatatctggagatggagtttaaggaagccattacagcaatcatgaagtatatagagacaacgccactaaccattaagggcaaaagcgtgaaaatatgtgtccctggaaaaaaaaaagcccagaacaaagaggttaagaagaagactctcgagtcaaagaaagtcagtgcaagcaccctgaagcgagatgcagacgcatcaaaggctgtggagatcgtgacctccacatctgcagaaagtgtggaccagacccagcagcttgtaccgctggttcgtaatactgctcgcgaccatgacgggactcctgagaacgagggggaggagacggtacagtctgccctgttcggttttcagtatgacgcaagcgaccataccatggcttggcttggcccgaacacagtcccagaagtcaaagaaatgattctgcaggatccgcagctccagactacacagctgcctcagactacacaggctcccgacataacatggggcatgctgaagaagactacatataaggcagagcagatccttctgcagacacagaaacccttcacacccgacaatctgttcctagcgctgcttagcggggatgcaaagcctgagtatgagcagtag

SEQ ID NO: 141555 - DNA, 1317 bp, Artificial Sequence
  Description of Artificial Sequence: Synthetic coding sequence
atgcaagctgaagacaggagccagtttggaagtgctgccgagatgctgagcgaacagacagcagcattgggtactggctgggagagcatgaacgtgcagctcgatggagccgagccacaggtggaaaggggttctcaggaagaacgcccatggagaacagttccaggccccctggaacacctctgctgcgacttagaggaggaaccgcagtctctacaagaaaaggctcagagtgctccgtgggtgcctgccattccccaggaaggcaataccggtgactgggagatggccgccgccttgctggccgcaggctcgcagggtttggtcaccataaaagacgtatctttgtgcttttctcaggaggagtggcgcagcctggacccttcacaaaccgacttctacggcgaatacgtaatgcaggaaaactgcggcattgtcgtcagcctgagattccctatccctaagctcgacatgctatctcagctggagggcggggaagaacaatgggtgcccgacccccaagaccttgaggagcgtgatatcttaagagtgacttacacgggtgatgggagcgagcacgagggcgacacccccgaactggaggcagagccacctcgaatgctcagctcagttagcgaagatacagtcttgtggaatcccgagcatgacgaatcatgggactccatgccatcttctagccgcggcatgctgttgggccctccttttcttcaggaagactccttctccaatctcctctgtagtactgaaatggattccttattgcgcccgcacacctgtccccagtgtggaaagcagttcgtatggggctctcacctcgctaggcaccaacagacccacacaggcgagcggccctactcctgcctgaaatgtgagaaaacattcgggagacgacatcatctaatcagacaccagaagacccacctgcatgacaaaacgtccagatgctcagaatgtggcaagaacttccgctgtaactctcatctagcgtctcatcagcgcgtccatgccgagggcaagagctgcaagggacaggaagttggagaatcacctggcacccgaaaaagacaacgagctccgcctgtgcccaaatgtcatgtgtgtacagaatgtggtaagtctttcgggcgtaggcaccatctagtgcggcactggttgacacatactggggagaaaccgttccagtgccctcgatgcgagaaaagcttcggcagaaagcaccaccttgacaggcacctattgacgcaccagggacaatcacctcggaacagctgggacaggggaacttcagtgttttag

SEQ ID NO: 141556 - DNA, 1248 bp, Artificial Sequence
  Description of Artificial Sequence: Synthetic coding sequence
atgctgagtgagcagacagccgctctcggaaccggctgggagagcatgaacgtccagctcgatggagccgagccgcaggtggagcgtggctctcaggaagagcgcccctggagaacggtccctggcccattggaacatctgtgctgcgacctcgaggaagaaccccagtccttgcaggagaaggcgcaaagtgctccttgggtgcctgccatcccacaggaagggaacacgggcgattgggagatggcggcagccctcctcgccgcaggttctcaggtgtcctcggcttcactgggcgtgtcatgtggacccattacagctgcctttgtcctgctgagccaccagcccattgacgagctcgcccatatgataatcaatggcttcccaatccctaagctcgatatgctaagtcaattggaaggaggcgaagagcaatgggtgccagatccacaggacctcgaggagcgggacatcctgcgcgtcacatataccggcgacggcagcgaacacgaaggtgatacaccagaactagaggccgaaccaccaaggatgctgtcctctgtgagcgaggataccgttctgtggaatcctgaacacgatgagtcctgggatagtatgcccagttcatctcgaggaatgctgctgggcccaccatttctgcaggaagacagcttctcgaatttgctgtgcagcacagaaatggactccctcctccgtcctcacacatgcccccaatgcggcaagcagttcgtctggggttcacatctggcgcggcatcagcaaacccatactggcgagagaccttattcctgtttgaaatgcgaaaaaaccttcgggagacgacaccacctgatcagacatcaaaaaacgcatctacacgacaagaccagccgctgcagcgaatgcggtaaaaattttcggtgcaatagtcaccttgccagccaccagagagtgcatgctgaaggcaaaagttgcaaaggccaagaggtcggtgaatcacctggtaccagaaaacgacagcgagctccaccggttccaaagtgtcacgtttgcacagaatgtggcaagtccttcggtcggcggcatcatctggtgaggcactggctgactcacaccggggagaagcctttccagtgcccacggtgtgaaaaaagcttcggcagaaagcatcatttagaccgccacctgcttactcaccaaggccagtcaccccgcaatagctgggaccggggaacgtcagtgttctag

SEQ ID NO: 141557 - DNA, 1317 bp, Artificial Sequence
  Description of Artificial Sequence: Synthetic coding sequence
atgcaggctgaggaccgatcccaatttggaagcgcagccgaaatgctctcagaacagaccgccgctctaggcaccggatgggagagtatgaatgtgcagctcgatggcgccgagcctcaggtggagcggggatcacaggaggagagaccatggagaactgtccctggccccctcgagcacctatgttgtgacctggaagaagagccccagagcctccaggaaaaggcccagagtgctccatgggttccagcaattccccaggagggaaatactggcgactgggagatggctgctgccctccttgctgccggcagccagggcctggtgaccattaaggatgtgagcctctgttttagccaggaggaatggaggtcactggacccgtcacagaccgatttttatggggagtacgtgatgcaggagaactgcggaattgtcgtgtcgctgcgctttcccattcctaagctggatatgctgtcacagctggaaggtggcgaggagcaatgggtaccagatccacaggacctggaggaacgggatatcctgagggtgacatacacaggtgatggctcggagcatgagggagatacccctgagctggaagcggaaccaccgcggatgctatctagcgtgtcagaggacactgtgctgtggaaccctgaacacgacgaatcctgggatagcatgcccagcagtagtcggggcatgctactgggacccccctttttgcaggaagactctttcagtaatttactgtgctccacggaaatggattcactgcttcgaccacacacctgccctcagtgcgggaagcagttcgtgtggggctcgcatctcgcgagacaccagcaaacccacacgggagaacgtccgtacagctgtctcaaatgcgagaaaacttttggtcggaggcatcatttgatccggcatcaaaaaacacacctgcacgataagacatcccgatgcagcgaatgtgggaaaaatttccggtgtaactcccatcttgcctcccatcagagggtccacgccgagggtaaatcctgtaaagggcaggaagttggggagtcccctggcacccgaaagaggcagcgcgctccaccagtgccgaaatgccatgtctgcactgaatgcggcaaaagttttggacgccgtcaccaccttgtgcggcattggttgacccacaccggggaaaaaccattccaatgtccccggtgcgagaaatctttcggtcgcaagcaccatcttgaccggcacctgttgacacaccagggccagtcgcctcgaaacagctgggaccgaggaacctccgtgttttag

SEQ ID NO: 141558 - DNA, 1275 bp, Artificial Sequence
  Description of Artificial Sequence: Synthetic coding sequence
atgctcagtgaacaaacagctgcactgggaaccggatgggaaagcatgaatgtgcagctcgacggagccgaaccacaggttgaaaggggtagccaggaagagagaccttggaggactgtgccaggccccctggaacacctctgttgcgacctcgaggaagaacctcagagtctccaagagaaagcccagagtgccccgtgggtaccagccatccctcaagaaggcaacactggggactgggaaatggcagccgccctgctggccgccgggtcgcaaggactcgtgactatcaaagacgtttccttgtgtttttcacaggaagaatggagaagtctcgacccctcacagacagacttttacggagaatacgtgatgcaggagaactgtggcatagtagtcagcctgcggttccccatcccaaaactggacatgctttcccagctcgaaggaggggaagagcaatgggtgccggaccctcaggacctggaggagagagatattcttcgagtcacctataccggcgatggctccgagcatgagggagatacacctgagttagaagctgagccacctcggatgttgtcctcggtgtccgaagacaccgtgttgtggaaccccgaacatgacgagtcctgggacagcatgcccagttccagcagaggaatgctattggggccccccttcctgcaggaggactcattttcaaatctcttatgctctactgagatggattctttattgcgcccacatacctgcccccaatgcgggaaacagttcgtgtggggcagccacctggccaggcaccagcagacacatactggtgagcgtccttacagttgcctgaagtgcgaaaagacctttggaaggcgacatcatctcattaggcatcaaaaaacgcatctccatgacaagaccagtcgctgttctgaatgcggaaagaattttaggtgtaacagtcaccttgcctctcatcagagagtccacgcagaaggcaagagctgcaaaggccaggaggtcggtgaatctccggggacccgcaaacgccagcgtgcccctcccgtgcctaagtgccatgtatgtaccgaatgtggcaagtcctttggacgacggcatcacctggtccgtcactggctgactcacacaggtgagaagccattccagtgtcctcgatgtgaaaaatcgtttgggaggaagcatcacttggaccgccatcttctgacgcatcagggccaaagcccccgaaattcatgggacaggggaaccagtgttttttag

SEQ ID NO: 141559 - DNA, 411 bp, Artificial Sequence
  Description of Artificial Sequence: Synthetic coding sequence
atgcaggctgaggaccgatcacaattcggttccgccgccgaaatgctgagcgagcaaactgctgcactagggactggctgggagagtatgaacgtccagttagatggggccgagccccaggtggaacgcggcagtcaggaggagaggccgtggcggactgtccccggccccctggaacacctttgctgcgatctggaggaggagcctcaatccctgcaagaaaaggcacagagcgctccatgggtcccagctattccacaagagggcaacactggtgattgggaaatggccgctgccctcctggcagccggttcccagggactggtcacgatcaaagacgtaagtctatgttttagccaagaagaatggagaagtttggatccctcacagactgacttctacggggaatag

SEQ ID NO: 141560 - DNA, 324 bp, Artificial Sequence
  Description of Artificial Sequence: Synthetic coding sequence
atgctatcagaacagaccgcagccttaggcactgggtgggagtctatgaatgtccagctggatggagctgagccacaggtggagcgcggctcacaggaggagagaccatggcgcacggtgcctggaccattggagcatctctgttgcgatctggaggaagagccacagagcctgcaggagaaggcgcagagcgcgccttgggtgcctgccatccctcaggagggaaataccggagactgggaaatggctgctgctctgctcgcggcaggctcccagggactggtgacaattaaagacgtttccttgtgctttagccaggagtag

SEQ ID NO: 141561 - DNA, 234 bp, Artificial Sequence
  Description of Artificial Sequence: Synthetic coding sequence
atgctctctgaacaaacagcggccctaggcaccggttgggaaagtatgaacgtccagttagacggggctgaaccccaggtcgaaaggggatcacaggaagagcggccatggcgtactgttccaggccctcttgagcatttgtgttgtgatctggaggaggagccccagtccctgcaagaaaaggcccaaagtgcaccctgggtccccgccatccctcaagagggtaacacttag

SEQ ID NO: 141562 - DNA, 3984 bp, Artificial Sequence
  Description of Artificial Sequence: Synthetic coding sequence
atgagatcttttctgcaacaggacgttaataagactaaatccaggctaaatgttctgaacggcctggccaacaatatggatgatctgaaaatcaataccgacattaccggcgcaaaagaagaactgttggatgacaataacttcatttcagataaggagtctggagtgcataaacccaaggattgccaaacatcgttccagaaaaacaacaccctgacactgcccgaagagctgtccaaagacaagagtgagaacgcactttcaggcggtcagagttccttgttcatccatgcaggcgctcccactgtctctagtgagaacttcatcttgcccaaaggagccgccgttaatgggcccgtctcccatagctcactcactaaaacatctaatatgaacaagggctccgtctctctgacaactggccagcctgtagatcaacccacgacagaatcgtgtagtaccctgaaagtggcagcagatctgcagctttctacgccacagaaggcatcgcagcatcaagtgcttttcctcctgagcgatgttgcccacgcaaagaatccaactcatagtaataagaagcttccaacgagcgctagcgttggctgcgacatacagaattccgtggggagcaatataaaaagcgacggaaccttgatcaatcaggtggaggtaggggaggatggcgaggatctgctggtgaaggacgactgcgtgaacacagtgaccggcattagcagcggaacagacggcttcagaagcgagaacgacaccaactgggacccacagaaggagtttattcaatttctgatgaccaatgaggaaaccgtggacaaggcacctccacactccaagatcggactagagaagaagagaaaacgcaagatggatgtttcaaaaattacacgatacaccgaagactgcttctccgatagtaattgcgtgcctaacaagagcaagatgcaggaggtggattttcttgaacaaaatgaggagctccaagcggtcgatagccaaaaatacgctctctccaaggttaagccagaaagcaccgacgaggatctggaaagtgtggacgctttccagcacctcatctataatcctgataaatgtggtgaggaaagcagtccagttcacacatcaacgtttttgagcaacactttgaagaaaaaatgcgaagagagtgactcagaatcgccggccacgttctcaaccgaagaaccatccttctacccttgcacgaaatgtaacgtgaatttccgggagaagaaacacctacaccggcacatgatgtaccacctcgacggaaatagccacttccgacacctgaacgttccccgcccttatgcatgtagagaatgtggccgaacttttcgcgaccggaactcgttgttgaagcacatgattatccaccaggagcgccgccagaagttaatggaggaaatcagagaactgaaggaattgcaggatgaaggacggagcgcgagactacaatgtccacagtgcgttttcggtacgaactgtcctaagacctttgtccagcacgctaaaacacacgaaaaagataaacgctattattgttgtgaggagtgtaatttcatggctgtgacagaaaatgaactagaatgtcatcgtggaatagctcacggggccgtagtgaagtgtccgatggtcacgtccgacattgcacaaagaaagacacagaaaaagactttcatgaaagacagcgtggtgggcagctccaaaaagtctgccacttacatctgcaaaatgtgcccgttcacaacatcggctaagagcgttctaaagaagcatactgaatacctgcacagctcctcttgcgtagattcctttggatctccattagggctggataaacgcaagaatgacatcctcgaggaacccgttgatagtgatagtaccaagactctgactaagcaacagtccactaccttcccgaagaattctgcccttaaacaagatgtgaaacgtaccttcggcagcacatcccagagttctagcttttctaaaatccataagcgcccccatagaattcagaaggccaggaaaagcatcgcacagtccggagttaatatgtgtaatcagaattccagccctcacaagaatgtgaccataaagtcttcagtcgaccagaaacctaaatattttcaccaggcggccaaggagaagtccaatgcgaaggcaaatagccactacctatatcgccacaaatacgagaattacaggatgattaagaagagtggcgagtcttatcctgtgcacttcaagaaggaagaggcctctagccttaactccctccatctgttttctagctccagcaatagtcacaataacttcatttctgacccacataaacctgatgctaagagaccagaaagtttcaaggaccaccgcagagtggccgtaaaaagagttattaaggagtcgaagaaggagtcttcagttggtggggaggatcttgacagttatcctgactttcttcacaaaatgaccgtcgtggtgcttcagaaattaaatagcgctgagaagaaggatagttacgagactgaagatgagtcctcttgggataatgtggagctcggtgattacactacacaggccatcgaggatgaaacctactcagacatcaaccaggaacatgtgaatctgtttccactctttaaatccaaggttgaaggtcaggaacccggagaaaacgctacgctgagctacgaccaaaatgacggattttacttcgaatattatgaagatacgggttccaataactttcttcacgagattcacgatccccagcaccttgaaacagcggatgcttccctgagtaaacacagtagcgtgtttcactggaccgacctctcactggagaagaagagttgcccttattgcccagccacattcgaaaccggggtcggattgagcaatcacgtcaggggccatttacaccgggcaggcctcagctatgaagcccggcacgtggtgtcccccgaacagatcgcgacctccgataagatgcaacacttcaaacgcactgggaccggcaccccagttaaaagagtgcggaaggcgattgaaaaaagtgagaccactagtgaacacacttgccagttatgcggcggctggttcgacactaagattggactttctaatcatgtcaggggacacttgaagcgtttggggaaaaccaagtgggatgctcacaaatctccaatatgtgtgctgaatgaaatgatgcagaacgaggaaaagtacgaaaagattctgaaagccctcaattccaggcgtataatcccacggccctttgttgctcagaaacttgcctcctcagatgacttcataagccagaacgtaattccactggaggcttatagaaacgggctaaagacagaagccttgagcgtttctgctagcgaggaggagggcctgaactttctcaacgagtacgacgaaaccaagccggagctccctagtggaaagaagaatcagagcttaaccctcatagaactgctgaaaaataagcggatgggcgaggagcggaactcagccattagcccccaaaagatccacaaccagaccgcgcgcaagcgctttgtgcagaaatgtgtgctgcctctaaatgaggactccccacttatgtaccaaccacagaagatggacctcaccatgcatagcgctctggattgtaaacaaaaaaagtcgaggtctcgctctggtagtaaaaagaagatgctgaccctaccccatggcgccgacgaagtatacattctgagatgtcgattttgcggcctggtgtttcgtggtcccctctctgtacaagaggactggattaagcatttacaacggcacatcgttaatgcgaatctgccacggactggcgctggcatggtggaggtcacctcgctcctgaaaaagcctgcttcgataactgaaacaagcttttcccttctgatggcagaggccgcaagttag

SEQ ID NO: 141563 - DNA, 318 bp, Artificial Sequence
  Description of Artificial Sequence: Synthetic coding sequence
atgttaattaggcagaacctcgctctggattgtaagcagaaaaagtcccgcagtcgcagtgggagcaagaagaagatgttgacactgccgcacggagccgatgaggtctacatactgcgatgtaggttctgcggccttgtgtttcgaggaccactgtcagtacaggaagactggattaagcaccttcagaggcacatcgtgaacgccaacctcccacgcaccggtgccggaatggtggaagtgaccagcctcctcaagaagccggcctctattacagagacctctttcagcttgctgatggctgaggcagctagttag

SEQ ID NO: 141564 - DNA, 318 bp, Artificial Sequence
  Description of Artificial Sequence: Synthetic coding sequence
atgctcattcgtcagaacctagccctggattgcaaacagaaaaagtctagatcacggtctggctcaaaaaagaagatgttaacactcccccacggcgcggatgaggtttacatccttcggtgtagattctgcggcctggtctttagaggtccactgtctgtgcaggaggactggattaaacatctccagagacacatcgttaacgccaacttgcctcgcactggcgcaggtatggtcgaggttacttccctcctgaagaagccggcatcaatcacagaaacctcattcagcttgctgatggccgaggctgccagttag

SEQ ID NO: 141565 - DNA, 3984 bp, Artificial Sequence
  Description of Artificial Sequence: Synthetic coding sequence
atgcgcagctttctccagcaagatgtcaacaaaaccaagtccagattgaacgtcctcaacggactggccaacaacatggatgacctcaaaatcaatactgatatcaccggggccaaggaagagcttttagacgataataattttatctccgacaaggagtccggggtgcacaaaccgaaggattgccagacatccttccagaagaataacacccttacactccctgaggagctatctaaggacaaatctgagaacgctctgtccggcgggcagagcagcctgttcatccacgctggcgctccaacagttagtagtgagaatttcatcctaccaaagggcgccgccgtgaatggccccgttagtcatagcagtttgacaaaaacgtcgaacatgaacaaaggtagcgtgtccctgaccacgggtcaacctgtggatcagcctaccacggaaagctgcagcaccctaaaagtggccgccgatctgcagctgagtacccctcagaaagcaagccagcaccaggtactctttctactgtcggatgtagcacatgcaaagaatcccactcacagcaataaaaagctccccaccagcgcgagtgtgggctgtgatatccagaattctgtgggatcgaatataaagtccgacggcactttaattaaccaggttgaggtgggcgaggatggggaagatctgctagttaaggacgactgcgttaacacagtgactggcatctcttccggtaccgacggctttagatctgagaatgacacaaactgggaccctcaaaaggaatttatacaatttctcatgacgaacgaagaaacggtggacaaggcacccccccattccaaaatcggactggagaagaaaagaaagcggaagatggacgtttcaaagattacacggtacaccgaggactgtttctccgacagcaactgcgttcccaacaagtccaaaatgcaggaagtcgattttctggaacaaaacgaggagttgcaggccgtggactcacagaagtatgctttatcaaaggtgaaaccggagtcaaccgacgaagacctggagtcagtcgatgcatttcagcatcttatttataatcctgacaagtgtggagaggaatcctcccccgtccatacttccactttccttagcaacacactgaagaaaaagtgcgaggagtcagattcagaatctccggccaccttctctaccgaggagcctagtttttacccgtgtacaaaatgcaacgtgaacttccgtgaaaaaaaacacctgcaccggcatatgatgtaccaccttgatgggaactcccactttaggcacctgaatgtccctcggccctatgcctgtcgggaatgcggcagaaccttcagagacagaaactctctcctgaaacacatgatcattcaccaggagaggaggcagaaactgatggaggagatcagggagctaaaagagctccaggatgagggcagatcggctcgtttgcagtgtccacagtgcgtctttggcacgaactgcccaaagaccttcgtgcagcacgctaaaactcacgagaaagacaagcggtattactgttgcgaggagtgtaatttcatggctgtgaccgagaatgaactggagtgccatcgcggaatcgctcacggtgcagtggtgaaatgtccaatggtgacctctgacatcgcacagagaaaaactcagaaaaaaactttcatgaaagatagtgttgtcggctcatccaaaaagtccgcgacgtatatctgtaagatgtgtccattcacgaccagcgccaagagcgtcctcaagaagcacacagagtatctacattcctcttcttgcgtcgacagctttggcagtcctctagggctggacaagcgaaagaacgatatcttggaggaaccagttgactccgattctaccaagactctgactaaacaacagagtactacttttccgaagaactccgcactgaagcaggacgtgaaaagaaccttcgggtcgacaagtcagtcttccagttttagcaagatccataagagaccacacaggattcagaaagctcgcaaatccattgcccaaagcggcgtcaacatgtgcaatcagaattcatcccctcacaagaacgtaactatcaagtctagtgtcgaccagaagcctaagtacttccatcaggctgccaaagagaagtcgaacgctaaagccaattcacactacctgtaccggcacaagtatgagaattacagaatgatcaaaaagtctggcgagagctatcccgtgcacttcaagaaggaggaagcaagctctctcaatagccttcacctgttctcatcctcctctaacagtcataacaatttcattagcgacccacataagccggatgccaaacgccccgagtctttcaaggaccacaggagggtggccgttaagcgagtgattaaagagtccaagaaagaaagtagcgtgggcggcgaggatctagactcatatcctgacttcctgcataaaatgaccgtggtggtgctgcagaaattgaatagcgccgaaaagaaagattcctacgagacagaggacgagtctagctgggataatgtggagctgggtgactacacaacccaggcaatcgaggatgagacctacagcgacataaaccaggagcacgttaacctatttcctctattcaaatccaaagtggaaggccaggagccaggcgaaaatgctaccttgtcgtacgatcagaatgacggattttactttgaatactacgaggataccggttcgaacaacttcctgcacgagattcacgatcctcagcatctggaaactgcagacgcctccctcagtaagcactcctccgtatttcactggaccgatcttagcctagagaaaaagagttgtccgtactgccccgccactttcgagaccggagtgggtctgtcaaaccacgtgagaggccatctacacagggctgggttgtcatacgaagctaggcatgtggtttctcctgagcagattgccacctcggacaagatgcagcacttcaaacggactggtactggtacacccgtgaagcgggtccgtaaggccatagagaaaagtgaaaccacatccgaacacacgtgtcagttgtgcggaggctggtttgacactaagataggactttctaaccatgtacgaggccatctcaagcgactgggcaaaacgaaatgggacgcccataagagtcctatttgcgttctgaatgagatgatgcagaatgaggaaaaatacgagaagatcttgaaagctctaaactcccgtcgcattattccccggccattcgtggcccagaagttagcatcttcagatgatttcatatctcaaaacgtaattccacttgaggcataccggaatgggctcaagaccgaagccctctccgtatccgccagtgaagaggaagggctaaattttctgaatgagtacgacgaaactaagccagagctgcctagtggcaagaaaaaccagtccctgaccctcatcgagttgctgaaaaataagcgaatgggcgaagaacgaaacagtgcgattagtcctcagaagattcacaaccagaccgcccggaagcgctttgtgcagaaatgtgtgctgcccctaaacgaagattccccacttatgtatcagccacagaagatggaccttacgatgcacagcgccctcgactgcaaacagaaaaagtctcggagcagaagcggatctaagaaaaagatgttgactctgcctcacggggcagatgaggtatatattctgcggtgtcgattctgtgggctggtttttagagggccattgtctgtgcaggaggactggattaaacatctccagagacatatcgtgaacgctaacttgcccagaactggcgctggaatggtggaggtgacatcccttctgaagaagccagcttccattaccgagacctcattttcattactgatggcagaagctgcttcatag

SEQ ID NO: 141566 - DNA, 1953 bp, Artificial Sequence
  Description of Artificial Sequence: Synthetic coding sequence
atgatgtaccacctggacggaaactcacattttcggcacctgaacgtacccagaccctacgcttgccgagaatgcggccggacgtttagggataggaactccctgctgaagcatatgattatccatcaagagcgccggcaaaaattaatggaggaaatccgcgaactgaaagaattacaggacgaaggtcgctctgctcggctccagtgtccccagtgcgtttttgggaccaactgcccaaaaacattcgtacaacacgccaaaacacacgagaaagacaagcgctattattgttgtgaagaatgcaatttcatggccgttacggaaaatgagctcgagtgtcaccgagggatcgcccatggcgcggtcgtgaagtgtccaatggtgacctctgacatagcccagcggaagacacaaaagaagacgttcatgaaggacagtgtggtggggagcagtaaaaagagcgccacatacatctgcaagatgtgcccattcacaacttccgccaaatccgttttgaagaagcacactgaatacctgcactccagctcctgcgtcgattcatttgggtcacctcttggactggataaaaggaagaacgacatactcgaggagcctgtagattccgacagtactaagacactgacaaagcagcagagcaccaccttccccaagaactcagcactgaaacaggacgtgaagcgaaccttcgggagcaccagtcagtcttcatccttcagtaagatccacaagcggcctcaccgtattcaaaaggccagaaaatcaatagctcaaagcggcgtaaacatgtgcaaccagaattcttccccccataaaaatgtcacaatcaagtcttctgtggaccagaaacctaaatacttccaccaggccgcaaaggagaagagtaatgccaaggctaacagccactacctgtataggcataagtacgaaaactatagaatgattaaaaaaagcggtgaaagctacccagtgcatttcaaaaaggaggaggcgtcttcactgaatagcctccatctgttttcatccagctccaactctcacaataactttataagtgacccgcacaagcccgacgcaaagcggccggagtccttcaaagaccatcgtagggtggccgtgaagcgagtgatcaaagaatcaaagaaggagtcgtctgtggggggcgaggacttggacagttacccagatttcttacataaaatgacggtggtagtcttgcaaaagctgaactctgccgagaaaaaggactcctatgaaaccgaggacgagtcaagttgggacaacgtggagctcggcgactacacaactcaagcgatagaggatgagacctattctgacataaaccaagaacatgttaacctgtttcccctgttcaaatcaaaggtcgaaggacaggagccaggcgagaatgccactctgagttacgaccagaatgacgggttttacttcgagtactatgaggacactggcagcaataattttctgcacgagatccacgatccccagcatctcgagacagctgatgctagtctgtctaagcatagttccgtgttccactggactgaccttagcctagagaaaaaatcatgtccctattgcccagctaccttcgagacaggcgtgggactgagtaatcatgtccgggggcacctgcaccgagccggactaagctatgaggcccgtcacgtcgtgagcccggagcaaattgccacctccgataaaatgcagcacttcaagcgtaccggcaccggaactcccgtgaaacgcgtgagaaaggccattgagaaatctgagacgacgtctgaacatacgtgccagctatgtggaggctggttcgacactaaaatcggattgtcaaaccacgtcaggggccaccttaagagactcggtaaaactaaatgggacgcccacaagtcgcctatctgcgtatag

SEQ ID NO: 141567 - DNA, 924 bp, Artificial Sequence
  Description of Artificial Sequence: Synthetic coding sequence
atgcggagtttcctgcagcaagacgtcaataagacaaaatccagactgaacgtattgaatggccttgccaacaatatggatgatctcaagataaatacagatattacgggcgctaaggaggaactgctcgatgataataactttatctccgataaagaaagcggcgtgcataaaccgaaggactgccagacaagtttccagaagaataataccctaacactgcccgaggaactgtccaaggacaaaagtgaaaatgctctgtctggtggtcagtcaagccttttcatccatgccggagctcccacagtgtcaagtgagaattttatactccctaagggcgcagcagtcaacggaccagtaagtcactcgagcctgacaaagacaagtaacatgaacaaaggcagtgtctctctcacaaccggacaacctgtggaccagccaacgaccgaatcatgctccaccctaaaagtggctgctgacctgcagctgtctacgcctcagaaagcttctcagcaccaggtcctgtttcttctgtctgacgtggcgcatgcaaagaacccaacccactccaacaaaaaactgccaacatccgcatcggtcggctgtgatatccagaactctgtaggctctaatatcaagtcagacggtacactaatcaatcaggtcgaggtgggggaggatggagaggacctgctcgttaaagatgattgcgtgaatacagtgaccggaattagctccggaaccgatggcttccgaagcgaaaatgacacgaactgggacccccagaaagaattcatccagtttcttatgacaaacgaggagacagttgacaaggcccctcctcactcaaagatcggcttggaaaagaagaaagctaagaatggttgcaaacaagacaattctctctaccggggccttttgtag

SEQ ID NO: 141568 - DNA, 1518 bp, Artificial Sequence
  Description of Artificial Sequence: Synthetic coding sequence
atgactaaggcccaggaatccctcaccctcgaagacgtagctgtggacttcacctgggaggaatggcagttcttgtctccagcccagaaagatctgtacagagacgtgatgctggagaactacagtaatctggttagtgtggggtatcaagcggggaagcccgacgctctaactaagttagagcagggggagccactctggaccctggaagatgaaatacactctcccgctcatcctgaaatcgagaaggctgatgatcacctgcaacagccacttcagaatcagaaaatcctcaagagaacgggccaacggtatgagcacggcagaacactaaaatcctatctcgggctaaccaaccagagccgacgatacaatcggaaggaacctgccgagttcaatggcgacggtgcatttctgcatgataatcacgagcaaatgcctactgaaattgaattccctgagtccaggaagcctatatccacaaaatctcagttcctaaagcaccaacagacccacaatatagagaaggcccacgagtgcacagactgcggcaaagcctttctcaagaagtctcagcttacagaacataagaggattcacacaggaaagaagccgcacgtctgcagtctgtgcggaaaggctttctacaaaaagtacaggctgaccgaacatgagagagcacataggggagagaagcctcatgggtgctctttatgtgggaaagccttttacaagcgataccgtctgacagaacacgagcgggcccacaaaggcgagaaaccatacggatgtagcgagtgtgggaaagctttccccaggaagagtgagctcactgaacatcagcggattcacactggtattaagccccatcagtgctccgagtgcggacgtgcgtttagtcgaaagtctctgctcgtggtccatcaacgaacacataccggagaaaagccccatacgtgttccgagtgcggtaaaggcttcatccagaaaggcaatcttaatattcaccagcgcacccacactggagaaaagccatacggatgcattgactgtggcaaggcattcagccagaagagttgcctggtggctcatcagcgctaccacacagggaaaactcccttcgtgtgcccagagtgcggacagccttgttcccagaagtctggcctgatcaggcaccaaaaaatccatagcggcgaaaaaccgtacaaatgttccgactgcggcaaagcgtttttaacaaagacaatgttgatcgtacatcacagaacgcatactggggaaagaccatacggatgcgatgaatgtgagaaggcctacttctacatgtcttgcctggttaagcacaagcgtatccacagccgcgaaaaacgcggggactcagtgaaggtcgagaatcctagcacagcgtcacatagcctgagtccttcagaacacgtgcaggggaaatcccctgtgaatatggtgaccgtggccatggtggcaggacaatgtgaatttgcacacatcttacactcgtag

SEQ ID NO: 141569 - DNA, 1833 bp, Artificial Sequence
  Description of Artificial Sequence: Synthetic coding sequence
atgccctcggccagagggaagagtaagtcaaaagccccaatcacatttggcgaccttgccatctacttttcccaggaagagtgggaatggctgtcgcccatacaaaaggatctttatgaagatgtgatgctggaaaattatcgcaacctggtgagtttaggtctgtcttttcggaggccgaacgtgatcactctcctggaaaaggggaaggcaccatggatggtggaaccagtacggaggcggcgtgccccagactcggggtccaagtgcgaaacaaaaaaactgccccccaaccagtgtaacaagagtgggcagtcgatatgccaaaagttggtgtcagctcagcagaaagctcccactcggaagtccggatgtaacaagaattccgtgctcgtaaagccgaaaaaaggacacagtggcaagaagccactgaagtgtaacgattgtgggaagacattctctcgttccttttctctgaagctgcatcagaacatccatacaggcgaaaagccatttgaatgttctaattgccgaaaggcatttcgccagataagcagtattttgctacaccagcgtattcattccggcaaaaaatcccatgagtgtaataaatgtggcgaaagttttaatcaaagaaccacactgatactgcacatgcgaatacacgatgggaaggagattctggattgcgggaaagcattgtcccaatgtcagtcttttaacatccaccagaagatccacgtggtgggcaatgtctgccagtgtcgcaagtgtggcaaggcatttaaccaaatgtcgtccctgctacttcacaagaaaattcataacggcaagaaaacacacaaatataataaatgcgggagaggatttaaaaagaagtcagtcttcgtcgtccataagcgtatacacgcgggggaaaaaattccggagaatgctaaagccctgagtcagagccttcagcagaggtctcatcacctcgaaaacccctttaaatgcagaaagtgtggaaaacttttcaatcggatctctccattaatgctacaccaacggatccacaccagcgaaaaaccatacaaatgtgataagtgcgataagttcttcagaagacttagcaccctgatccttcatctgaggattcacaacggcgagaaactctaccgctgtaataagtgtgagaaggtgtgcaacagacactcctctctgattcaacatcaaaaggtgcacacgaaaaagaaaaaactctttgagtgtaaggagtgtggcaagatgttttctggaactgctaatctgaagatccatcaaaacatccactccgaggaaaaaccattcaaatgtaataaatgctccaaagtgttcggccgacagtcatttctcattgagcatcagagaattcacactggtgagaagccatatcagtgtgaggaatgtggaaaagccttttcccacagaatttcactcacaaggcataagcgcattcacaccgaggatcggccatacgaatgtgaccagtgtggaaaagccttctctcagtcagcccatctggcgcagcacgaaaggattcacacaggagaaaaaccttatacatgcaaaacctgcggcaaagccttctctcagcgaactagcctcatcttacacgagcggagccatacgggagagaaaccctacgagtgcaacgaatgcgggaaagccttttctagcggttcagacttgatcaggcaccaacgctcccactcaagtgagaagccctatgaatgctcaaaatgtgggaaggcttattctagatccagcagcctgattcggcatcaaaacacccatagcgaggagaaggcgtag

SEQ ID NO: 141570 - DNA, 2217 bp, Artificial Sequence
  Description of Artificial Sequence: Synthetic coding sequence
atgaggactcttgtcaatgctcttagtggcggcgggcaggagattaagcccgaagggaaatgcgctcataatggaatgtgttttagatgtgaggaggtggccccagatacttgcgaggcttacccatacccaggtcttgttgtgtcggtggcgggcaaggaggggccgaatcctgaccacaaacgcgggtttctcgacctcgctcaggagggcatccaggccctcccataccagctgtcagcacatctttcggtctggactttaaagggagaggagcgaatgcctagtgcccgaggtaaatcaaaaagcaaggcacccattacctttggggatttggccatatatttctcgcaagaagagtgggagtggttatcccctattcagaaagatttatacgaggacgtaatgcttgaaaattatcgtaaccttgtttctctgggcctgagttttcggagacctaatgttataactttgctggaaaaaggcaaggctccttggatggtcgagcctgtgcgcagacggagagcccctgaacttgtcaccgtggccctcttttcctcgttcggtgaggtcatgttcagccggatggtgcttatgctgatggatgtgtgccagtacctggtgatagacgaattggacagcggcagcaaatgcgagaccaaaaagttgccccctaatcaatgtaataagagcggtcagagtatttgtcaaaagctggtgtccgcccagcagaaggcgcccacaagaaagagtggttgtaataaaaatagcgtgcttgtcaaaccaaaaaaggggcactccggcaaaaaaccgctaaaatgcaacgactgtggaaagacctttagcagaagcttcagcctcaaactgcatcaaaatatacatacgggggaaaagccgtttgaatgctctaactgccgcaaggccttccggcagatatcatccatcttgctccatcagaggatccatagtggtaagaagtcacatgagtgcaacaagtgcggagaatcctttaaccagcgtaccactcttatcttacacatgcgcattcacgatgggaaagagatactggactgcggcaaggctttgtcccagtgccagagcttcaatatacatcagaagattcacgtagttggaaatgtgtgtcagtgcagaaagtgcggcaaggcttttaaccagatgtcaagcttattgctgcataagaagattcacaacggaaagaagacccacaaatacaacaagtgtggacgcggatttaagaagaagtccgtatttgtggtgcacaaacggatccacgctggcgagaaaattcctgagaacgccaaggctctaagccagtctctccagcagcgatcccaccacctggagaacccctttaagtgcaggaagtgcggtaaactgttcaatcgtatctccccactgatgcttcaccagcggattcatacaagtgagaaaccttacaagtgcgataagtgtgacaagttcttccgcaggttatccaccttaattctgcatctgcgtattcacaatggcgagaagctttacaggtgcaacaaatgcgagaaagtatgcaaccgtcacagttcactgatacagcaccagaaggtacacaccaagaagaagaaacttttcgagtgtaaggagtgtggtaaaatgttttctggcactgcgaatctcaaaattcaccagaatatccacagcgaagagaaaccgtttaaatgcaacaagtgctccaaagtgttcggccgacaatcctttctgatagaacatcagcggatccacacaggagagaaaccttaccagtgcgaggaatgtgggaaagctttttcccatagaatcagcctcactcgacacaaaaggattcataccgaagacagaccttacgaatgcgatcagtgcggcaaggcatttagtcagagcgcgcacctcgcacagcatgaacggatccatacgggggagaaaccctatacctgcaagacatgcggcaaggcattctcccagagaacctctctgattctgcacgagcgaagccacacaggcgaaaaaccttacgagtgcaacgagtgtggtaaggcattctcaagcggctccgatctcatcagacatcaacggagccattcctctgagaagccttacgaatgttctaagtgcggtaaggcctactcaagatcgtcctccctgattaggcaccaaaacacccattccgaagagaaggcctag

SEQ ID NO: 141571 - DNA, 975 bp, Artificial Sequence
  Description of Artificial Sequence: Synthetic coding sequence
aagaatagcgtgctggtgaagcctaaaaagggacactctggcaagaaaccactcaagtgtaatgactgcggtaagacattttccaggagcttttccttaaagctgcatcagaacatccacactggcgagaagccgtttgaatgctcgaactgtagaaaggccttccgacagattagctctatattgcttcaccagcgtatacactctggaaaaaaaagccatgagtgcaataaatgtggtgagagtttcaatcagcgcaccactctcattttgcatatgagaattcatgacggaaagaatccttttaagtgcagaaaatgcggcaaactgttcaataggatatcccctctcatgctccaccaaaggattcacacgtctgagaaaccatacaagtgtgaggaatgcggcaagatgttttcaggcactgcaaatctcaagattcaccagaatatccacagcgaggagaagccttttaagtgcaataagtgtagcaaggtgttcggaagacagagtttcctaatcgagcatcagagaatacatacaggcgaaaaaccataccagtgtgaagagtgtgggaaagcgtttagccatcgtatcagccttacccgacataaacggattcacactgaggacagaccctatgaatgcgatcagtgtggtaaggccttcagccagtctgcccatctcgcacaacatgagcgaatccacaccggagaaaaaccctatacctgcaagacctgcggcaaagcctttagtcagagaacaagtctgattctgcacgaacgttctcacaccggcgaaaagccctatgaatgtaacgaatgcggcaaggcttttagctccggctcagacctgatcaggcaccagagatcacacagcagtgaaaagccatacgagtgcagtaaatgtggcaaagcctactctagaagctcctcactcatccgccaccagaatactcacagcgaggagaagtag

SEQ ID NO: 141572 - DNA, 1179 bp, Artificial Sequence
  Description of Artificial Sequence: Synthetic coding sequence
atgcgcatacacgatggaaaagaaattcttgattgtggtaaagcactctcccagtgccagagcttcaatattcatcagaagatccacgtggttggcaacgtttgccagtgccggaagtgtgggaaagctttcaaccagatgtcatcgctcctcctgcacaagaagattcacaacggaaagaagacgcacaagtataataagtgcggccgggggttcaagaaaaagtcagttttcgtagtccacaagcggattcacgccggcgagaagatccctgagaatgctaaagcactgtcacagtcactccagcagagatctcatcatctggagaaccctttcaagtgtcgaaagtgtgggaagttgtttaatagaatttcgcctctgatgttgcaccagcgcattcatacatctgagaagccgtacaagtgcgataagtgtgataagttttttcggaggctttctaccttgatacttcacctgagaatccataacggagagaaactttataggtgtaataagtgcgagaaggtgtgcaatagacattcgtccttgatccagcatcagaaggtacacaccaagaagaagaagcttttcgaatgtaaagaatgtgggaaaatgttcagtggtacagccaatttgaaaattcatcagaacatacactccgaagaaaagccgtttaagtgtaacaagtgcagtaaggtatttggacgccagtcttttctaatcgaacatcaacgcatccatactggcgagaagccctaccaatgcgaagagtgcgggaaagccttctcccaccggattagtctcacacgccataagagaatccatactgaagacagaccctacgagtgcgaccagtgcggcaaggctttctctcagtctgcacatctggcacaacatgagcgtatccatacaggggagaaaccttacacttgcaaaacatgtggcaaggcattctcccagaggaccagtcttattcttcatgagcgcagtcatacaggggaaaagccctatgaatgtaacgaatgcgggaaagccttttcaagcggtagcgacttgattcgtcaccagaggagtcactcaagtgaaaagccctacgagtgtagtaaatgtgggaaggcttattctagaagcagctccttaattcggcaccagaacacgcatagtgaagagaaagcctag

SEQ ID NO: 141573 - DNA, 1833 bp, Artificial Sequence
  Description of Artificial Sequence: Synthetic coding sequence
atgccgagcgcaagaggaaaatctaaaagtaaagctccaatcacctttggcgatttagccatctacttttcacaggaagagtgggagtggctttcccctattcagaaagacctgtacgaggatgttatgttagagaactatcggaatctcgtgagtctggggctgtctttccggagacccaacgttattaccctgctggagaaaggaaaggctccctggatggtcgaaccagtgcgtagaagacgagccccagatagcggatcgaaatgcgaaacaaaaaaactgccccctaatcagtgtaacaagtccggccagtcaatatgtcagaaactggtgagtgctcagcaaaaggccccaacccggaagagcgggtgcaataagaatagcgtcctggtaaagccgaagaaggggcactctgggaagaaaccactcaagtgcaatgattgtggaaaaacattttcgcgatctttttctctcaagttgcaccaaaatatccatacaggcgagaagcctttcgaatgctcaaactgcaggaaggcctttcgacagatctcgtctattctactgcaccagagaattcactctgggaagaagagtcatgaatgtaacaagtgtggcgagtctttcaatcaaagaactacactaattctgcacatgaggattcacgatggcaaggaaatcctggactgcgggaaagccctctctcagtgtcagtcttttaacatccaccagaaaatccacgtcgtcgggaacgtgtgtcagtgtaggaaatgtggaaaagcttttaatcagatgtcttctctactgttacacaagaagattcataacgggaagaaaactcataaatacaataagtgtggcagagggtttaaaaagaaaagcgttttcgtcgtgcacaaaaggattcacgctggggaaaaaattccggaaaacgccaaagctttaagccaatcactccagcagcggagtcaccacctggaaaatccctttaagtgcagaaaatgcggcaagctattcaacagaatctctccgctaatgctgcaccaaagaatccacacatctgaaaagccttataagtgcgacaaatgtgataagtttttccgtagattgagtacactaatcctgcatctgcggatccacaacggcgagaagctgtatagatgtaacaagtgtgagaaggtatgtaaccgccactcttctctcatccaacaccagaaagtgcacactaagaaaaagaagctcttcgaatgtaaggagtgtggtaaaatgttcagtggaaccgctaatctgaagatccatcagaatatacactctgaggaaaagcccttcaagtgcaacaagtgctccaaggttttcggccggcagtcttttttgatcgaacaccagcggattcatacgggcgaaaaaccttaccagtgtgaagaatgtggaaaagccttctctcatagaatatcgctcacccgccacaagcggattcacactgaggacagaccttacgagtgtgatcagtgtgggaaggcctttagccaatccgctcacttggctcagcatgaacggattcacacaggcgagaagccctacacttgtaagacgtgcggtaaggcgttttcacagcgcacttccctgattcttcacgaacggagtcacacaggcgaaaagccttatgagtgcaatgaatgcggaaaagcattcagctctggttccgacctgattaggcatcagcgatctcactcaagcgaaaagccatacgaatgtagcaaatgcggtaaggcatactcccgctcgtccagtctgattcggcaccagaacacacactcagaggagaaggcatag

SEQ ID NO: 141574 - DNA, 1728 bp, Artificial Sequence
  Description of Artificial Sequence: Synthetic coding sequence
atggccatgtcccaggagtctctaacctttaaagacgtgtttgtcgatttcaccctggaggaatggcagcagctcgactctgcgcagaaaaatctgtaccgagacgtgatgctggaaaattactcacacctcgtcagcgtgggccaccttgtgggcaaacctgatgttatcttccgactgggcccaggggacgagagttggatggccgatggcggaacaccggttcggacgtgcgcagtgtgggaagttgacgaacagatcgatcattacaaggaaagccaggacaaatttctgtggcaggccgcgtttatcggcaaggaaactctcaaggacgaatcaggccaggaatgtaagatctgccgcaagataatttacctcaacacggacttcgtgtccgtgaaacagcggctgcctaaatattactcttgggaaagatgcagcaaacatcatctgaacttcctcgggcagaaccggtcttacgtaaggaagaaagatgatgggtgcaaggcctactggaaggtgtgtttgcattacaatctgcacaaagcccaacctgccgaacgctttttcgatcccaaccagcgggggaaggcgctgcatcagaaacaggcactgcggaaaagccagcgctcacaaacaggcgaaaaactctacaagtgcacggaatgcggcaaagtcttcattcaaaaagccaatttggtcgtacaccaacggacccataccggagagaagccctacgagtgctgtgagtgcgcaaaagcctttagccaaaaaagcaccctcattgcccatcagcgaacgcacacaggcgaaaaaccctacgagtgcagcgaatgcgggaaaacattcatccaaaaaagcacactcattaagcaccagaggacacacaccggcgaaaaaccctttgtctgcgacaaatgtccaaaagcctttaaaagtagttatcaccttattaggcacgaaaaaacccacatacgccaggccttctacaaggggatcaagtgcacaaccagctcactaatttaccagcggattcatacctctgagaagcctcagtgctccgagcatgggaaagcttccgacgagaagccttcacccacgaagcactggaggacgcacacaaaagaaaacatctatgagtgctctaagtgtggaaagagctttaggggcaaatctcatctttcggtacatcagaggattcacactggagaaaagccatatgaatgttctatctgtgggaaaaccttctcaggcaagagccatctgagtgttcatcacaggactcataccggcgaaaaaccttacgagtgcaggcggtgtggcaaagcctttggggagaagtccacactgatcgtgcaccagcggatgcacactggcgagaagccctataaatgcaatgagtgcggaaaggcctttagcgaaaaaagcccactcattaagcaccagcggattcataccggggaacgcccttacgagtgcacagattgcaagaaggccttctccaggaaatccaccttaatcaagcaccagagaatccatacgggagagaaaccctacaagtgctctgaatgcggtaaagcattttccgtgaaatcaacactcatagttcaccatagaactcacactggagagaaaccctatgaatgccgtgattgcgggaaggccttttctgggaaatccactttgatcaaacaccagcgatcccacactggggataagaatctgtag

SEQ ID NO: 141575 - DNA, 1746 bp, Artificial Sequence
  Description of Artificial Sequence: Synthetic coding sequence
atggctatgagccaggaatccctgaccttcaaggacgtttttgtggactttactctggaggagtggcaacagctggatagcgcacagaaaaatctgtatcgggacgtaatgctggaaaactacagtcacctcgtctcagtgggtcacttggtgggaaaacctgacgtgattttcagactgggcccaggcgacgaaagctggatggcggacggggggactccagtcagaacctgtgctggcgaggatagaccagaggtttgggaagttgatgagcagatcgatcactacaaggagagccaagacaagttcctgtggcaggcagcctttatcggcaaggaaactctcaaggacgagagcggtcaggaatgcaagatatgcagaaaaattatctatctcaacacagacttcgtttctgtgaagcaacgccttccaaaatattatagctgggagcgctgctcgaagcaccatctcaattttctcggtcaaaaccgctcctacgtgagaaagaaagatgatggctgtaaagcgtactggaaggtttgtctacactacaacctgcacaaggcccagcctgccgagcgcttttttgacccaaatcagcggggtaaagctctgcaccagaaacaggcactgcggaagagccagagatctcagactggcgaaaaactgtataagtgtacagaatgcggaaaggtgttcattcaaaaggccaatctggtggtgcatcagaggactcataccggggagaagccatatgagtgctgcgagtgcgccaaggctttctcccagaagagcacactgattgctcatcagagaacccataccggcgagaaaccctatgagtgttccgaatgcggaaaaactttcatacagaagagcaccttaattaagcatcagaggactcacaccggagaaaagccgtttgtgtgcgacaagtgccctaaggcattcaagtcctcctaccaccttatccggcatgaaaagacccatatccggcaggctttttacaaaggcatcaaatgtacaactagcagcctgatttatcagagaatacatacgtcggaaaaacctcagtgcagtgaacatggaaaagcaagcgatgagaagccctctccaactaaacactggagaacccatactaaggaaaatatctatgaatgtagcaaatgcggaaagtcattccggggtaaaagtcatttgtcagtccatcaacgcatccataccggcgaaaaaccgtatgaatgttccatttgcggcaagaccttctcaggcaagtcccatctctctgttcatcaccgaacccatactggcgaaaaaccctacgagtgccgaaggtgcggcaaagcattcggcgagaaatctacattaatcgtgcatcagcgcatgcacactggcgagaagccctacaaatgcaacgaatgtggaaaggctttctcagaaaagagtcctctaatcaaacaccagcgcatccacactggcgagaggccctatgagtgcaccgattgtaagaaggcctttagtagaaagagcactctcatcaagcaccaacgcattcacaccggagaaaaaccttataaatgtagcgagtgcggcaaggccttctcagtgaaaagcaccctcatagtgcaccaccggactcacacaggggaaaagccatatgagtgtcgtgattgcggaaaggcattcagtgggaagtccacccttatcaaacaccagagatcgcatacaggtgacaagaacttatag

SEQ ID NO: 141576 - DNA, 3714 bp, Artificial Sequence
  Description of Artificial Sequence: Synthetic coding sequence
atgggagacatgaagaccccagacttcgacgacctgctggctgctttcgatatccccgatatcgacgccaacgaggcgatccactccggcccagaagagaatgaggggcccggaggtccaggtaaaccagagcccggcgtcggaagcgagtcagaggacaccgccgccgcttccgcaggtgacggcccgggtgtccctgcccaggcgtctgaccacggactcccaccacccgacattagcgtggtatctgtgattgtgaaaaatacggtgtgtcccgagcaatctgaagctttggcaggaggaagtgccggcgacggcgctcaggcagccggagtgactaaagagggcccagttggaccacatcgtatgcaaaatggattcgggtccccagaaccctcactgccgggaacacctcattcgcccgcaccaccaagcggggggacttggaaggaaaaaggcatggaaggaaaaactcccctggatttattcgcccactttggaccagagcccggagaccattctgatcccctccccccttccgccccatctcccactcgagagggagctctcacgcctcccccatttccatcaagctttgagttagcacaggagaacgggccagggatgcaaccacctgtttccagcccacccttaggggccctgaagcaagagtcatgttcaccacaccatcctcaggtgctggcccagcagggaagtgggtcatcaccaaaggcaactgacataccagcctccgcctcgcctccacccgtcgctggagtgccgttctttaaacagagccccggtcatcagtcccctctcgcctcacccaaggtcccggtatgtcagcccttgaaagaggaggatgatgacgaggggccagtcgataaaagctctcctgggagtccccagtctccctcgagtggggcagaggctgccgacgaggactcaaatgacagcccggcctcttcctcaagtcggcccctcaaagtccggattaagaccatcaagactagttgcgggaacattacccgcacagttacgcaggtcccctccgacccagatcccccagctccgctcgcagagggcgccttccttgcagaagcctccctgctgaaactcagccctgccacccccacctcagagggacctaaggtggtttcagttcaactcggtgacggcacccgcttgaaggggaccgtattgccagtcgccactattcagaatgcctccacggccatgctgatggccgcgagtgtcgcccggaaggctgtagtgttaccgggaggaactgcaacatcacccaaaatgattgctaaaaacgtgctgggcctcgtgccccaggcactgcccaaagctgacggaagagctggccttggcactggcggacagaaggtgaacggggctagcgttgtgatggtgcagccaagcaagactgctactggcccttcgacggggggcggaaccgtgatttcccggacacagagctctctcgtggaagcatttaacaagatccttaattccaagaacctgctccctgcatatcgtcctaatctgtctccgccagcagaagccggactagccttaccccccacagggtaccgctgcctcgagtgcggtgatgcattttccctggaaaaatcacttgctaggcattacgaccgccggagcatgcgaatcgaggtcacctgcaatcactgtgcacggcggctggtcttcttcaataaatgttctttactgttgcacgcccgcgaacataaagacaaaggattggtcatgcagtgtagtcacctcgtaatgagacctgtcgctctggatcagatggttggtcagccagacatcacaccactgctgcctgtcgccgttccccccgtttccggacctctagctctgccggctctcgggaaaggcgaaggcgcaataacctcctccgctatcacaaccgtggcagccgaagcacctgtgctccccttatcaacggagcctcctgccgctccagccacctccgcctacacatgttttaggtgcctcgaatgtaaggagcagtgtcgtgataaagcaggtatggcagctcactttcaacagctcggacctcctgcacctggtgccacttccaatgtctgcccgacatgtccgatgatgctgccaaacagatgttctttcagtgcacatcaacgaatgcacaagaatcgaccccctcacgtctgccccgagtgtggaggcaacttcctgcaggccaatttccagactcacctgcgcgaggcatgcctccatgtctcaaggcgagtcgggtaccgctgcccaagctgctccgttgtgttcggtggcgtcaattccatcaagtctcacatccagacttctcactgtgaggtgttccacaagtgtcctatctgcccaatggcgttcaagagcggcccctctgcccacgcccacctgtactcacagcatccaagctttcagacccaacaagccaagcttatttataaatgcgccatgtgcgatactgtgtttacacacaagcctctcctgagctcccattttgatcagcaccttctgccacagagagtatccgttttcaaatgcccctcatgtcctctgcttttcgctcagaagagaactatgctggaacacctgaaaaacacccaccagtcagggcggttggaggaaactgctggcaaaggagcagggggggccctgctcacaccaaagaccgagcctgaggagctggccgtgtcacagggaggagccgcccccgctaccgaggaatcatcttcttctagtgaagaggaagaggtgcccagttcccctgaaccccctcgaccagctaagagaccaagaagagagctgggaagtaagggtctcaaggggggtggcggaggccctggtggatggacatgtggactgtgccattcctggtttcccgaaagggacgagtacgtcgcacacatgaagaaagagcatggaaaatctgtcaaaaagtttccatgcagactctgtgaaaggagcttctgtagtgccccctctcttagacgccatgtgagagtaaaccatgagggcattaagagagtgtacccctgccgatactgcactgaggggaaacgaacattctctagtcggctgatcctggagaagcatgtacaggtccgtcacggactccagctaggtgcccaaagtcccgggagggggacaaccttggcacgagggagctccgctcgcgctcagggaccgggccgaaagcggaggcagtcttccgacagttgctcagaggagccagactcaactacaccgcctgcaaagagtccaagaggagggcctggaagcgggggacacgggccattaaggtataggtccagcagtagtaccgagcaaagccttatgatgggtctacgcgtggaggacggagctcagcagtgtctcgactgcggactctgtttcgcttctcctggctcattgtcaaggcaccggttcatcagtcataaaaaacgaaggggcgtgggcaaggccagtgctctgggcctgggcgatggagaggaggaggccccccccagcagaagcgacccagatggtggagattccccactgcccgcttccggcggaccactcacttgcaaggtgtgtggaaagtcctgtgactccccattaaacctcaaaactcacttcagaacacacggaatggccttcatcagagcgaggcagggcgctgtgggcgacaattag

SEQ ID NO: 141577 - DNA, 3714 bp, Artificial Sequence
  Description of Artificial Sequence: Synthetic coding sequence
atgggggatatgaaaactcccgacttcgacgatttgttagccgcttttgatatcccagacatcgatgccaacgaagcaatccacagcggacctgaggaaaatgagggacctgggggccctggcaaacctgaaccaggtgtcgggtcagaatccgaagacaccgctgcagcaagcgccggcgacggaccgggagtgccggcacaggcttccgatcacgggctgccgccccccgatatatctgtggtgagcgtgatcgtgaagaacactgtgtgtcccgaacaatctgaagcacttgctggaggctccgctggcgacggggctcaggccgccggcgttaccaaagaagggcctgtgggtcctcatagaatgcaaaacggttttggaagtccagagccctccctgcccggcaccccccattctcctgccccaccgtccggcggtacgtggaaagagaaaggcatggagggcaagactcccctggacctgtttgcccactttggccctgagcctggagaccacagtgaccccctccccccaagtgcgccctcacccactagagagggtgcacttacccccccgccattcccaagtagtttcgagttagcacaggagaatggccctggcatgcagccccccgtcagtagccccccattgggtgccctcaagcaggagagctgctctcctcatcacccacaggtgttggcacagcaggggtcaggttcaagcccaaaagctaccgatattccagctagtgcatcaccacccccagtggctggcgtgccgttctttaaacagagcccaggacatcagagccctctcgcttctccgaaagtgcccgtctgtcaacctctgaaggaggaggatgatgacgagggacctgtcgataagtcttcccccggctccccccagtctcctagctctggtgctgaagccgctgacgaagactccaacgattctcctgcgtccagcagctctagacccttgaaggtgcgcattaaaaccattaagaccagctgtgggaatatcacccgcacagtgacgcaggtaccttccgatcctgatccaccggctcctctggcagagggcgcatttctggcagaagcctccctccttaaactctcaccggcaacgcccacctcagagggtcccaaagtggtgagcgtgcaactcggagacggcacccgtctgaaggggactgtgttgcctgttgccacgatccagaacgcctccaccgccatgctaatggccgcctctgtggccaggaaggcagtggtgctccccggcggaaccgccactagtccaaagatgatcgccaaaaacgtgttgggcctagtgccccaagctctgcccaaagcggatggccgagcggggctgggcacaggcgggcagaaagtgaatggggctagcgtcgtcatggtgcagcccagtaagacagcgaccggcccaagtacaggaggcggcacagtgatctcaaggactcaaagctctctcgtggaggcgttcaacaaaatcctcaacagcaaaaatctgctgcccgcctacagaccaaacctgtcaccaccagcagaggccggcctcgctctgccacctacaggatatcgctgccttgaatgcggcgacgccttttctctggagaaatcactggctaggcactacgatcgcaggagtatgagaattgaggtaacctgcaaccactgcgccaggagactagtcttttttaataagtgtagcctgctacttcatgctcgagaacataaggataagggtttagtgatgcagtgttcccacttagtgatgcgacccgtagcactcgatcaaatggtcgggcagccagacattactccactcttgccggtcgccgtccccccagtgagcggtccactagctctgcctgctttgggcaagggagaaggcgcaattacttcatctgccatcacaactgtggcggcagaagccccagtactgcctctatcaacagagccgccagcagccccggccacaagcgcttatacatgcttcagatgccttgagtgtaaggagcagtgcagggacaaagcaggcatggcagcgcactttcaacagcttggccctcccgcacctggtgcaacctccaatgtgtgccccacttgtcccatgatgctgcctaatcgctgctcatttagcgcacatcagcggatgcataagaaccggccacctcatgtttgcccagagtgtggaggcaatttcttgcaggccaattttcagacacatctgagagaggcttgcctacacgtgagcagaagagttggctacagatgtcccagctgttctgtggtgtttggtggtgtgaactctataaagagtcacatacagacttctcactgtgaggttttccacaagtgtccaatttgtcctatggcctttaaaagcggaccgagcgcccacgcacacctgtactctcaacacccttccttccaaacccagcaggcgaaactgatttacaaatgcgcgatgtgtgacaccgtgttcactcacaagcccctgctaagttcacattttgatcagcaccttctcccacagcgggtgtctgtatttaaatgcccaagctgcccacttcttttcgcccagaaacgcacgatgctggaacacctcaaaaatactcatcagtcgggacgtttggaggagacagctggaaagggggccggaggcgcactcctcaccccgaaaaccgagcctgaggaactggcagtttctcaaggcggcgcagcacccgcaactgaagagagtagtagtagttccgaagaggaagaggtgcctagctcccctgagcctccaagaccagcgaaacggcctaggagggagctcgggagcaaaggtcttaaaggcggaggaggcgggccaggtggctggacatgtggtctatgtcacagttggttcccagagcgggatgaatacgtggcacacatgaagaaagagcacggcaaatctgtaaagaagtttccgtgccgcttgtgtgaacgcagcttttgctcagctccgagtctccgaaggcatgttagggtcaatcacgagggtatcaaacgagtgtatccctgtcgatattgcacagaaggcaaaagaactttctccagcagactaattctcgaaaagcatgtgcaagttcgccacggtctgcagctgggcgcacagtctcctggccgaggtaccacactagccagggggagctcggctcgcgcccagggacctggtaggaaacggcggcagagctccgacagttgttcagaggagcctgactccacaactccgcccgccaaatcaccccgcggtggcccgggttcaggggggcacggtcccctgaggtatagatcaagcagctctacagaacagtccctcatgatgggattgagagtcgaagacggagcccagcagtgcttagattgtggcctgtgcttcgcatcgcccggcagcttgagtcgccacagatttattagtcacaaaaagcgccggggggtgggcaaggcgagtgcattgggcttaggcgacggcgaggaagaggctcctccttcccggagcgatccagatggaggagacagcccgttgcctgcctctggtggtcctctgacatgcaaggtgtgtggaaaaagctgcgactctcctctgaatttgaagactcacttccggacccacggaatggcatttatccgggcccgccagggcgcagtaggagacaactag

SEQ ID NO: 141578 - DNA, 3312 bp, Artificial Sequence
  Description of Artificial Sequence: Synthetic coding sequence
atgggagatatgaaaactcctgattttgacgacctccttgctgctttcgacatccccgatatcgacgccaacgaagcaattcactcaggtcctgaggagaatgagggccccggcggcccgggcaaacccgaacctggggtcggtagtgaatccgaagacactgccgccgcctcagccggagacggtccaggcgtgcctgcacaagccagcgaccacggtctgccccctcctgacataagtgttgtgagtgtcattgtgaaaaatacagtgtgtcccgagcagagcgaagccctggctggaggatccgccggcgatggagcgcaggccgcgggtgtgacaaaggaaggtcctgtgggaccacaccgtatgcagaatgggtttggctcccccgagccttccctaccaggcaccccccacagtccagcaccgccatccggaggaacatggaaagaaaaagggatggagggaaaaacccccttagacttatttgctcattttggtcctgagccaggagatcactcagatcctctgcccccatccgcccctagccctacacgggagggagccctgacaccaccccctttcccctcttcctttgagctggcacaagagaacggacctggcatgcagccgccagtcagctctccaccacttggggctctgaagcaggagagctgttcccctcatcacccccaagtgctggcccagcagggcagcggcagcagcccaaaggcgacagacataccagccagtgctagcccaccccctgtcgcgggagttccatttttcaaacaaagccctggccatcagtcaccccttgcttcacccaaggtgcctgtctgtcagccactgaaagaggaggatgacgatgaaggtccggtcgacaagagcagtccaggctccccacagagccccagttctggtgcagaggccgccgatgaggactcgaatgacagtcccgccagcagcagctccagacccctgaaggtgcgcatcaaaacgatcaaaaccagctgtggaaacatcacaagaacagtcactcaagtgccctccgatcctgatccacccgcaccgttggcagagggcgccttcctggccgaggctagtctcttaaaactgagtcctgcaacccctacatccgagggccccaaggtggtgagtgtccaactgggagacggcacaagattgaagggaaccgtcctaccggtggccactatccaaaacgccagcacagccatgctcatggccgctagcgtggcccggaaagcagtcgtgctcccaggtggcaccgctacgagtccaaaaatgattgcaaagaatgtgctgggactcgtaccacaggcactaccaaaggcagacggcagggcgggtcttggcactggaggtcagaaagttaacggggcttcagtcgtgatggtacagccatccaagaccgccacaggccctagcacaggcgggggaacggtaatatcccgaacccagagctctctagttgaagccttcaataagattctgaacagcaagaatctgctgcctgcttatcggcctaacctgtctccccctgccgaagctggactggccttgcccccaactggctatagatgtcttgaatgtggcgatgcctttagcctggagaagagcctggcaagacattacgacaggagatcaatgcgcatcgaagtcacatgcaaccactgtgcccggcggcttgttttctttaataaatgctccttactgttgcacgcgagggaacacaaggacaaaggtctagtgatgcagtgtagtcacctggtaatgcgtccagtagccttggaccagatggtgggtcagcccgatatcacgcctcttctccctgtagccgttcctcccgtttctggccctctggccctgccagcacttggaaagggcgaaggcgccattacaagcagcgcgatcaccaccgttgcagcagaagccccagtgctgccactgtctacggagccacctgcggctcccgccacatctgcctacacttgttttagatgcctagagtgcaaggaacagtgccgcgacaaggccgggatggcggcccatttccagcagctcggcccccccgcacctggcgccactagtaacgtttgtcctacctgcccaatgatgcttccaaacaggtgctccttctccgcacatcagagaatgcacaagaaccgtccgcctcatgtttgtcctgaatgtggtggcaactttttgcaggccaatttccaaacccacctaagagaggcttgtctgcatgttagtaggcgggtgggatataggtgtccatcttgtagtgtggtgttcggcggagtcaatagtattaagagtcacattcagacatcccactgtgaggtcttccataagtgtcccatctgcccaatggcatttaagtctggcccaagtgctcatgctcatctgtactctcagcacccatcatttcagacccagcaagccaaactcatctacaagtgtgctatgtgtgacacggtttttactcataaacctctgctcagtagtcattttgatcagcatctcctgccacagagagtgtctgtcttcaaatgcccctcctgtcccctgctttttgctcagaaaagaacaatgttggagcacctaaaaaacactcatcagagcggtcggctggaggaaaccgctgggaaaggagctgggggagcactgctaacccctaaaactgaacctgaggagctagccgtgtctcagggcggggcagcacctgcgactgaagagtccagtagttcgtcggaggaagaggaggttccgtcatctccagagccaccccggccagctaagcgaccaaggcgtgagctgggaagcaagggcctgaagggaggtgggggtggacctgggggttggacctgtggactgtgccactcctggtttccagaacgcgatgagtatgtggcacacatgaagaaagaacatgggaaaagtgtgaaaaaattcccttgccgactctgtgagcgttcattctgctccgctccctccctacggaggcacgtgagagtgaaccatgaagggatcaaacgcgtatacccatgccggtccaaaggcccaggactacgcgcagtgcccttgctcccctcctgccctcttcccttccaggtgcttcatagaggtaaaacacacctgcagcaaccaccagatccccgagaaacctgtccgggaccggctcgtctggccgcctgggggccggtgccatggccaggggaccacctcggaagtgggttccaatgccagtcccccggggccaggtccgaaacccccccggtgttctag

SEQ ID NO: 141579 - DNA, 2121 bp, Artificial Sequence
  Description of Artificial Sequence: Synthetic coding sequence
tgaaccgtactaccggtggcgaccatccagaatgccagtacagcaatgttgatggccgccagtgtggcacggaaagccgtcgtgttgcctggcggaaccgcaactagccctaagatgatcgctaaaaacgtgttagggctagtcccccaagccctccctaaggccgacggacgggcgggccttggtacgggcgggcaaaaggtaaacggggcatccgtagttatggtccagccttctaagaccgcaacaggacccagcactggaggaggaacagtcattagccgaacccaaagttcactcgttgaagcattcaataagatactgaatagtaaaaaccttctgcccgcctatcgccctaatctaagtccacctgccgaggcaggactggcactgccccccacaggctatcgttgtctcgagtgcggcgacgcgttttccctggaaaaatccctggcacgtcattatgatcgaaggtctatgagaatcgaggtgacttgcaatcactgcgctagacggcttgtgttctttaacaaatgtagcctgctcctgcacgcccgagagcacaaggacaagggcctcgtgatgcagtgctcccacttggtgatgagacccgtggctctcgaccagatggtaggacaacctgatatcactccactgctgcccgtggctgtgcctccagtaagtggacccttggcacttcctgctcttgggaaaggggaaggggccatcacaagttcagccatcactaccgttgctgcggaggcacccgtcctacctcttagcacggagcccccagctgctccggctaccagtgcttatacgtgtttcagatgtctggagtgtaaagaacagtgtagagacaaggctggaatggcagcccatttccagcagttaggaccccctgccccaggcgcaacttccaatgtctgcccaacatgccctatgatgctacctaacagatgctctttctccgcccaccagcgcatgcacaaaaacagacctccccacgtgtgtcccgagtgcggcggaaatttcctgcaggccaattttcagacccatctccgcgaggcttgcctgcacgtctctaggcgggttgggtataggtgtccgtcgtgttccgttgtgtttgggggggtcaacagcataaaatcccatatccaaacatcccactgcgaggtattccacaagtgtcccatttgtcctatggcctttaagagcggcccttccgcacatgcacatctctacagccagcatccgtcattccaaacacagcaggcgaagttaatatataagtgcgcaatgtgtgacacggtgttcacacacaaacccctgctttcaagtcactttgatcagcacctcctacctcagagggtttcagtttttaaatgtccctcatgccccctgttgttcgcacagaaacgcaccatgttagagcatctcaagaatactcaccagagcggaagactcgaggagaccgctggcaaaggcgcgggtggggctctgcttacgccaaagactgaacccgaagaacttgccgtcagccaagggggcgccgccccagcgactgaggagagctcatccagcagcgaagaggaggaggtacccagtagtcctgagccccccaggccagccaaacgccctcgccgggagctcgggtcgaaaggcttgaaaggcggcgggggagggccaggagggtggacatgtggtctctgccatagttggttcccagagagagacgagtatgtggctcatatgaaaaaggaacacgggaaaagcgtgaaaaaatttccctgtcggctttgtgagagaagcttttgcagtgctccctcacttaggagacacgtgcgggtgaatcatgagggaattaaacgcgtgtacccatgtcgatctaaggggccaggcctgcgagccgtgccgctgctaccgtcgtgtccgctcccctttcaggttcttcatcgtggaaagacacatctgcagcagccacccgatcctcgcgaaacctgcccagggccggcccgactagccgcatgggggcctgtgccatggccgggcgatcatctgggctcaggcttccagtgccagagtcctggcgccagaagcgagacacctcccgtcttttag

SEQ ID NO: 141580 - DNA, 450 bp, Artificial Sequence
  Description of Artificial Sequence: Synthetic coding sequence
atgccctgctgtagccacaggcggtgcagagaggatcccggtactagcgaaagtcaagaaatggaggagtgggccctcctggatatctctcagcgaaaactgtacaaggaggtcatgctggagacgttccggaatctcacgtccgtcggtaaaagctggaaagatcagaacattgagtacgaatatcagaatccccggcgaaactttcggtcccttattgaaaagaaagtcaacgagattaaagatgactcccactgcggtgaaactttcactcaagtgccagatgaccggcttaattttcaggagaagaaggcgtcacccgaaattaaatcttgtgactctttcgtttgtggtgaggtaggccttggcaactctagtttcaatatgaacatccgcggcgacattggacataaggcttatgaataccaggaatatggccctaagccatag

SEQ ID NO: 141581 - DNA, 1701 bp, Artificial Sequence
  Description of Artificial Sequence: Synthetic coding sequence
atgccttgctgttcccaccgacgatgcagagaagaccctgggacttctgagagccaggaaatggacccagtcgcctttgatgatgttgctgttaatttcactcaagaggagtgggccctgttagatatctcccaacgcaaactgtacaaggaggtgatgctggagaccttcagaaatcttacttcagtgggaaagtcttggaaggatcagaatatcgagtacgagtatcagaacccacggcgcaacttcaggtccctgatagagaaaaaagtcaacgaaataaaggatgacagccattgcggtgagaccttcacacaggtgcctgacgaccgtctcaactttcaggagaagaaggcaagcccggagataaaatcctgcgattccttcgtgtgtggcgaggtgggtctggggaatagttctttcaatatgaatatacgcggggatataggccacaaagcctatgagtatcaggagtacgggccgaagccatgcaaatgccaacagcctaaaaaagcattccgctatcatccatcgttccggacccctcagcgggatcacaccggcgagaaaccttacgcttgcaaggagtgtggtaagacgtttatcagccactcgagtatccaaagacatgtagtaatgcattccggagacgggccctataaatgtaagttctgcgggaaggctttccactgcctttcactgtacctgatccacgaacggattcacacgggtgagaaaccatacgaatgtaagcagtgcggcaaatccttttcctacagcgctaccctacgtattcacgagcggacccataccggcgagaaaccctacgaatgtcaacaatgtggcaaagcgttccatagccctaggtgttacagacggcacgagcgcatccatactggggaaaaagcataccagtgtaaggagtgcggaaaggcattcacctgtcctcagtacgtgcgcatacatgaacgaactcacagtcggaaaaagccttatgaatgcacacagtgtggaaaggcactgtccagcctcacctctttccaaacgcatattcgaatgcacagcggggagagaccgtatgagtgtaaaatctgcggaaaggggttctgttccgcaaactccttccagcgccacgaaaagacacacagtggagaaaagccatacaagtgcaagcaatgtggcaaagcgtttatacacagctccagccttcgttatcatgagaggatccatactggtgagaaaccgtatgagtgtaagcagtgcggcaaggcgttccgcagttcctcgcacttgcagttgcacggacgaacacacacaggcgaaaagccctatgagtgccaagaatgcgggaaagctttccgctcaatgaaaaacctccagagtcacgagcgcacccagacacatgtgaggattcatagcggtgagaggccatacaagtgcaaattgtgcggcaagggtttctattgccccaaaagcctacagcgacacgaaaagacacataccggtgaaaaattatatgagtgtaagcagtgcggagaggccttttcttcgtcttccagtttccgctatcacgaacgcactcacacaggtgagaaaccatacaagtgcaagcagtgcggcaaggccttccgagctgcatccgttttaaggatgcacggccgcactcaccctgaagacaagccgtacgaatgtaaacagtag

SEQ ID NO: 141582 - DNA, 2061 bp, Artificial Sequence
  Description of Artificial Sequence: Synthetic coding sequence
atggaagtggttacttttggcgacgtggccgtgcattttagcagagaggagtggcagtgcctggaccctggccaacgcgccctgtatcgggaggttatgctggagaaccatagcagcgttgctgggctggcagggtttctcgttttcaagcctgagcttatcagccgcctagagcagggggaagagccttgggtgttagatctgcagggcgccgaggggaccgaggcgccccgtacttccaagacagacagtacaattcgtacagagaacgaacaggcctgtgaggacatggatattttaaaaagtgagtcttacggaacggtagtgcgaatctctccccaggacttccctcagaatcccgggtttggggacgtatcagacagcgaggtttggcttgattctcacctcggcagtcccggtctaaaagtgacggggttcactttccagaataactgcttgaatgaggagacggtggtgccaaagactttcaccaaggacgcccctcaaggctgtaaggagctcggtagctcaggactggattgccagcctcttgagagtcagggtgaaagcgcagaaggaatgtcgcaacgctgtgaagagtgtgggaaagggatccgcgccacctccgacatcgctttgcattgggagatcaatacgcagaaaatctcaagatgccaagaatgtcagaaaaagcttagcgactgcttgcaaggtaagcatacaaataactgccacggtgagaaaccttatgaatgcgccgagtgcgggaaggttttcagactctgctcccagctgaaccagcatcaacgcatccatacaggcgaaaagccttttaaatgtacagaatgcgggaaagcttttcgactgtcttctaagctcatccagcaccagcgaatccataccggagaaaaaccctaccgctgtgaagagtgcggcaaggcattcggacaatcttcaagtcttattcaccaccaacgaattcacaccggggagcggccctacggctgtagagaatgtggcaaagcctttagccagcaaagtcagttggtccgccatcagcgaacccacaccggagagaggccttacccctgtaaagaatgcggaaaagcattcagccagagctcaacattagcccagcaccagcgtatgcatactggcgagaaggcacagattcttaaggcctccgattcgcccagtctcgtggcccaccagaggatccacgcggtcgagaagccctttaaatgcgacgaatgtggcaaggctttcagatggatttcccgcctctcacagcatcaactgattcacactggggagaaaccttataaatgcaataagtgtacgaaggccttcggctgctcttcacgtctgatcagacaccaacggacacacactggcgagaaaccctttaagtgtgatgagtgtggaaaagggttcgtgcaaggcagccacctgatccagcaccagcgcatacatacgggggagaagccatacgtatgtaacgactgtggaaaagccttcagtcagtcttcatctcttatctaccaccagaggatacacaaaggcgagaaaccttacgagtgtctgcaatgcgggaaagcattcagcatgtccacccagctgaccatccatcagagagtgcacacgggggaacgaccatacaaatgcaacgaatgcgggaaggccttcagtcaaaacagtacactgtttcagcaccaaattattcacgctggcgtcaagccatacgagtgctctgaatgtggtaaggctttcagtcggagctcttacctgattgagcatcagcggatccatactcgagctcagtggttctatgagtatggtaatgctctggagggttctacgttcgtttctcgcaagaaggtgaacaccataaagaagctgcatcagtgtgaagattgcgaaaaaatctttcggtggcgatctcacctaattattcaccaacgtatccatacgggtgagaaaccttataagtgtaacgattgcgggaaggcattcaatagaagtagtcggttaacacaacaccagaagatccatatgggctag

SEQ ID NO: 141583 - DNA, 2094 bp, Artificial Sequence
  Description of Artificial Sequence: Synthetic coding sequence
atgggcttcctgggctgctggtgtgtctcatttcaggaggtcgtgacattcggagatgtggctgtgcacttctcccgggaggagtggcaatgcctagatccggggcaacgtgctctgtatcgtgaggtcatgcttgaaaatcattccagtgttgccgggttggccgggttcctcgtgtttaaaccagagttaatcagtcgattggagcagggggaagaaccctgggttctggacctgcaaggggccgaaggtaccgaagcgccacgcacctcaaaaactgatagtacgatacgcacggaaaatgagcaggcatgcgaagacatggacatcctgaaatctgaaagctacggtaccgtggtccgcatctctccacaggattttccacaaaatcctggcttcggagatgtgtctgatagtgaggtgtggctggactcccacctggggtcaccagggctgaaggtcacaggctttacatttcaaaacaattgcctaaatgaggagaccgtggtccctaaaacatttaccaaggacgccccccagggatgcaaggagttaggcagtagcgggctggactgccagcccctggaatcccagggcgagtcggccgagggcatgagtcaacgatgtgaagagtgtggtaagggcatcagagcaactagtgacatcgcattacattgggaaatcaacacccaaaagattagcagatgccaggagtgtcagaaaaaactatcagattgcttgcagggcaagcacaccaataattgtcacggcgagaaaccgtacgaatgcgccgagtgtgggaaagtctttagactatgctcccaattgaaccagcaccagaggattcacaccggcgagaagcccttcaagtgcaccgagtgtggaaaagcgtttcgactcagctccaagctgatccaacatcagcgcattcatacaggtgagaagccgtaccgatgcgaagagtgtgggaaggcatttggtcagagtagctcccttatccatcaccagaggatacacactggcgagcgaccatacgggtgcagagaatgcgggaaggccttttctcaacagtcccaactagtgcggcatcaacggacccacacaggggagcggccctatccctgcaaggagtgcggaaaggcctttagtcagtcatcaaccttggcacagcaccagcggatgcatacaggcgaaaaggctcagatactgaaagcatccgattctccaagtttagtggcccaccagagaattcacgctgtggagaaacctttcaaatgcgacgaatgtggaaaggccttccgatggattagtcgattgtctcagcatcagctgatccacaccggcgagaagccctacaaatgtaacaagtgcacgaaggcgttcggttgcagctcaaggcttatcagacaccagcgtacccataccggtgagaaaccattcaaatgcgacgagtgcggaaagggttttgtgcagggtagccatcttatccagcaccagcgtatacacacaggcgaaaaaccatacgtatgtaacgattgtggcaaggccttctcgcagtcctctagtctgatttatcaccaaagaatccataaaggggagaaaccgtatgagtgcctccagtgcggtaaggcctttagcatgtccacacagctgactatccaccagcgggtgcacaccggcgaaaggccatataagtgtaacgagtgtggaaaagccttctcacagaatagcaccctctttcaacaccagatcattcacgcaggcgtgaagccttacgagtgctctgaatgcggcaaagccttctcacgaagctcatacttaatcgaacatcagagaatccatacaagggcccagtggttttacgaatacggcaacgccctcgaggggtctacttttgttagccgcaagaaggtaaatactatcaagaagctgcaccagtgcgaagattgtgagaagatcttcaggtggcggtctcacctgataattcaccaacgcatccataccggggaaaagccctataaatgtaatgactgtggcaaggctttcaacaggagcagtagactgacacagcaccagaaaatccatatggggtag

SEQ ID NO: 141584 - DNA, 447 bp, Artificial Sequence
  Description of Artificial Sequence: Synthetic coding sequence
atggaagttgttacttttggcgacgtggcagtgcatttcagccgtgaagaatggcagtgtcttgacccagggcagcgggcactctaccgggaagtgatgctggaaaaccacagttccgtcgctggcttagctgggtttctggtgtttaagccggagctgatctccaggctagagcagggcgaggagccctgggtcttggacctgcaaggcgccgaaggtacagaggcaccccgcactagcaaaactggcttcttagggcgaccgaccatgggtcaggaaccgaggcacccacacgctccccctgccacacccgtccccggcttgcccaaacattgctctcaacggctcacgcttcctccacccggtctcagctcctcccctctgggtcactttctggttcacgatcaggacagaagacggggaacctcggcaatatggatggtttag

SEQ ID NO: 141585 - DNA, 2061 bp, Artificial Sequence
  Description of Artificial Sequence: Synthetic coding sequence
atggaagttgtgacattcggcgacgtcgccgtgcatttttccagggaagaatggcagtgtctggatccaggccagagggctctctaccgggaggtgatgctagagaatcattcttctgttgccggcctcgccggattcctagtgtttaaacccgaactgatttctagattggaacagggagaggagccttgggttctggatctgcagggagctgaaggcacagaagcgccccgaacatcgaagacagacagtaccattcgtacagaaaatgaacaggcctgcgaagacatggacatcctgaaaagcgaatcatatggaaccgtggtgagaatcagcccacaggattttcctcagaaccccggatttggggatgtgagtgattctgaggtctggcttgactcccacttgggcagtccagggctaaaggtgacgggattcacctttcagaacaattgtctcaatgaagagacagtcgtacctaaaactttcaccaaagatgctccacagggctgtaaagagctaggcagtagcggattggattgccagcctttagagtctcagggcgaatcagcggaaggcatgtctcaaagatgcgaggagtgtggaaaagggatcagggccacctcggatattgcactgcattgggagatcaacacccagaaaatctctcggtgccaggaatgccaaaagaaactgtcagattgtctgcaagggaagcatactaataattgccatggcgagaaaccctacgagtgcgctgaatgcggaaaggtgtttagactttgcagtcagctcaaccaacatcagagaatacacaccggcgaaaaaccatttaagtgtacggaatgcggtaaggccttccgtttgagctcaaagctcatacagcatcagagaatccacaccggggaaaagccctataggtgtgaagagtgcgggaaagcctttgggcagtcctcttccctgatccaccatcaacggatacacacaggtgagaggccttatggttgtagggagtgtggtaaggccttctcacagcagagccagttagtgaggcatcagaggacccacactggagagcgaccctacccctgtaaagagtgtggcaaagcattcagccagtcctctactttagcacagcaccagagaatgcacacgggcgaaaaggcccagattttgaaagcatcagactcaccgagcctggtggctcatcaacgcatccatgccgtggagaagccttttaagtgtgacgaatgcggcaaggcctttcggtggatttcccgtttgtctcagcatcaactcatccataccggagagaagccctataagtgcaacaaatgcaccaaggcttttgggtgctctagccggctgatccgacaccagagaacccataccggcgagaagccatttaaatgtgatgaatgtggcaaggggttcgtgcagggatcccatctcattcagcaccagcgtatccacactggggagaagccttatgtgtgtaatgactgcgggaaggcattcagccagtcctcaagtctcatataccaccagcgaattcacaagggagagaagccatacgaatgtctccagtgtggcaaggcatttagcatgagtacacagctcactatccatcagagagtacacacgggagaacgcccatacaagtgcaatgagtgtgggaaggcatttagtcagaacagtacattgttccagcatcagatcattcacgctggggtgaagccctacgagtgcagcgagtgtggcaaggccttcagtcggtcctcctaccttattgaacatcaacggatccacacccgggcccagtggttttatgagtacggaaacgccctcgagggctccacgttcgtaagcagaaaaaaagtcaacacgataaagaagctgcaccagtgtgaggactgcgaaaagatctttaggtggaggtctcatctgattatccaccagagaatccataccggagaaaagccctataagtgcaatgactgcggcaaagcctttaatcgtagctccaggctgacccagcatcagaagattcacatgggctag

SEQ ID NO: 141586 - DNA, 1773 bp, Artificial Sequence
  Description of Artificial Sequence: Synthetic coding sequence
atggacatcttgaagagtgagagttatgggaccgtagtgcgcatctctccacaggactttccccagaacccaggattcggcgacgtgtctgactctgaggtctggctcgatagtcatctcggcagccccggcctgaaagtaaccgggtttaccttccagaacaactgcctgaatgaggagacagtggtgcctaagacctttacaaaagatgctccacaaggatgcaaggaactcggctccagtggactcgactgccaacctcttgaatcacagggcgagtccgccgaaggaatgtcccagagatgtgaggagtgcggaaaaggaatacgggccaccagtgatatcgcactccactgggaaattaacactcagaagatctctaggtgtcaggaatgtcaaaaaaaattgtctgactgcctgcagggcaaacacacgaataattgtcatggggaaaaaccatacgagtgtgccgagtgtggaaaggtgtttaggctttgctcccaactaaaccagcaccagagaattcataccggcgagaagccatttaagtgcaccgagtgtgggaaagctttccgtctttcgtctaaactgattcagcatcagcgaatccatacaggcgaaaagccatacagatgcgaggagtgtggcaaagcctttgggcaatcatctagtctaatacaccatcaaagaatccacacgggggaaagaccttatggatgcagggagtgtggaaaggcgttctcccaacagagtcagctcgtgcggcaccagcgaacacatacgggtgaacggccctatccgtgcaaagaatgcggaaaagctttctctcaatccagcacactggcgcagcaccagaggatgcacaccggtgaaaaggcccagatcttgaaggcaagtgattccccaagcctggtggcccaccagagaatccacgccgtggaaaagccctttaaatgtgacgagtgtggcaaagcgtttcgctggataagccgtcttagtcagcaccaactgattcacaccggtgaaaagccctataagtgtaacaaatgcaccaaggccttcggctgttcttcacggctcatccgacaccagagaacccacacgggcgaaaaacctttcaagtgcgacgaatgtggtaagggatttgtgcagggatctcatttaattcagcaccaaaggatacacacaggagaaaagccgtatgtgtgtaacgattgtggtaaggctttctctcagtcaagttcactgatttaccatcaacggatacacaagggggagaagccttacgagtgtctgcagtgcgggaaagcttttagcatgagtacacaacttaccattcaccagcgcgtgcatactggtgaaagaccatacaagtgtaacgagtgtgggaaggcctttagccaaaattccacactttttcagcaccagattattcatgctggggtgaagccttacgagtgctctgagtgcggaaaagcttttagtaggtcctcatacctgattgaacatcaaagaatccatacccgggcacagtggttctatgaatacggaaatgcgctggaggggagtacatttgtcagcagaaaaaaggtgaatacgataaagaaactgcaccagtgtgaagattgcgaaaagatctttagatggcgatcccaccttatcattcaccagcgtattcacaccggcgaaaagccatacaaatgcaacgattgcggcaaggcattcaaccgttccagtagattaacacagcaccaaaagatccacatgggctag

SEQ ID NO: 141587 - DNA, 1470 bp, Artificial Sequence
  Description of Artificial Sequence: Synthetic coding sequence
atgaaggagctcgaccccaaaaacgacatttcagaggacaaacttagtgtagtgggggaggcaaccgggggtccgaccagaaacggagcaagggggccaggcagcgagggggtctgggaacccggcagttggcccgaacgcccgagaggcgacgctggcgccgagtgggagccacttgggatcccgcaaggcaacaagttgctgggcggttccgtgcccgcttgtcacgaactcaaggcgttcgcgaatcaagggtgtgtgctcgtaccaccaaggctcgatgacccaactgaaaagggggcctgcccgcccgtgagaagaggaaaaaacttttcttccacctctgatttgtcaaaaccccctatgccttgcgaggagaaaaagacgtacgattgttccgagtgtggaaaggccttttctaggtcaagcagtctgataaagcatcagcgcattcatactggcgagaaaccttttgagtgtgacacctgcggtaaacatttcatagaacgatccagtttaacgatccaccagagagtgcacacaggggaaaagccctacgcctgcggggactgcggaaaggccttcagtcaacggatgaatttgacagtgcaccaaagaacacacaccggtgagaagccttacgtgtgcgacgtatgtggcaaagcattccgaaagaccagctccctgacccaacacgagcgtatccacaccggcgagaagccctatgcctgtggcgactgcggcaaggcgttttctcagaatatgcatctgattgtacaccagagaacgcatacaggcgagaaaccttacgtttgccccgaatgcggccgggccttttcccagaatatgcacctgacagaacaccaacgtacgcacactggggaaaaaccatacgcctgtaaggaatgcgggaaagcattcaataagagctcctcgctgactctgcatcagaggaatcataccggggaaaaaccgtacgtctgcggtgaatgtggaaaggccttctcgcagagttcttacctgattcagcatcagagattccacatcggcgttaaaccatttgaatgtagtgagtgcggcaaggctttctcaaaaaattcaagcttgacacagcaccagaggatccatacaggtgagaagccatatgaatgttatatctgcaagaaacactttaccggcagaagcagcttgattgtccaccagatcgtccataccggcgaaaaaccatatgtgtgtggggagtgtggcaaggcgttctcccagagcgcctacctgattgaacatcagcggatccacacgggcgagaaaccctacagatgcggtcagtgtggcaagtcatttatcaagaatagcagcctgacggttcaccagagaattcacactggcgagaaaccctataggtgtggcgagtgcggaaagactttcagccgaaacaccaacttaacacgtcacctgagaatccacacctag

SEQ ID NO: 141588 - DNA, 2286 bp, Artificial Sequence
  Description of Artificial Sequence: Synthetic coding sequence
atggattctgggggcgggagcctgggactacacacccccgacagccgcatggctcataccatgatcatgcaggactttgtggctggtatggcgggaacagctcatatagacggggaccatatcgtcgtttcggtgcctgaagcggtgctggtatccgacgtggtgacagatgatggaattaccctggaccatgggctggcagcagaagtcgtacacggccccgatatcatcactgagacggacgtcgtgactgaaggtgttattgtccccgaggctgtgctggaggcggatgtcgccatcgaggaggatctggaggaagatgacggagatcacatcttgaccagtgagctgattacagagacagtgagggtgcctgaacaggtcttcgtggctgatctcgtgacaggccctaatggccacctcgaacatgtcgtgcaagactgcgtgagtggggtcgattcgcccacaatggtgtccgaagaagtactcgtcacaaacagtgacaccgagaccgttatccaggctgctggtggagtcccgggcagtaccgttactattaaaaccgaggacgatgacgatgacgatgtcaagtcaactagcgaggattacttaatgatcagcctcgatgatgttggcgagaagctggagcacatgggtaacacacctctgaaaataggcagcgatggttcccaagaagatgcaaaggaggacgggttcgggtccgaggtcatcaaggtgtacatctttaaggccgaagccgaggatgatgtagaaatcggaggaaccgaaattgtcaccgaatctgagtatacttccgggcactccgtggcgggtgtactggatcaatcaagaatgcaacgagagaaaatggtgtatatggctgtaaaggatagcagtcaggaagaggacgacattcgcgacgaacgccgggtttcaagaaggtacgaagactgtcaagcaagcggtaatactcttgatagcgcattggagagtcgctcaagtaccgctgctcagtacctccagatatgcgatggcatcaacaccaacaaggttctcaagcagaaggctaagaagcgtaggcggggtgaaacacgacaatggcagacggctgtgatcattgggccagatgggcagccattaaccgtttatccatgtcacatatgtacaaaaaagttcaaatctagggggttcctgaagcgacatatgaaaaatcaccctgaccacctgatgagaaagaagtaccagtgtactgattgtgacttcaccacaaacaaaaaagttagctttcacaatcatctggagtcacataaactgattaataaggtcgataagacccacgagttcacagaatacacgaggcgctatagggaagcttcacccttatcttctaacaagctgatcctgcgggacaaagaaccaaagatgcataagtgtaagtattgcgactacgaaacagctgaacagggattattgaatcgccaccttcttgcagtacatagcaagaatttccctcacgtctgtgtcgaatgcggcaagggatttcgtcatccaagcgagttgaaaaagcacatgcggacgcacaccggcgagaaaccataccaatgtcagtactgtatcttcagatgtgctgatcagagtaatttgaagacccacataaagtcaaagcacggaaataacctaccctacaagtgtgagcattgcccacaagcattcggcgatgaacgagagctccagcggcaccttgaccttttccaggggcacaaaacccaccagtgccctcactgcgatcataaatcaacaaacagcagcgacctgaaaaggcacatcatcagcgtacatacgaaagactttcctcacaagtgcgaagtctgcgacaagggtttccaccggccttccgaactgaaaaaacactcagatatacacaaaggcagaaaaatacaccagtgccgccactgcgatttcaagacttccgacccttttatcctgtcgggccacatattgagtgtgcacaccaaggaccaacccctgaaatgtaaaaggtgcaaacgaggtttcaggcagcaaaacgagttgaaaaaacacatgaagactcatacagggaggaagatttaccagtgtgaatactgtgaatactcaaccacagacgcgtctgggttcaagcggcacgtcataagtatacacacaaaggattatccccatcgctgtgagttttgcaagaagggctttcggagaccttcagaaaagaaccagcacatcatgcgacaccacaaagaggccctaatgtag

SEQ ID NO: 141589 - DNA, 2286 bp, Artificial Sequence
  Description of Artificial Sequence: Synthetic coding sequence
atggactccggtggaggatcgcttggcttacacacaccggactcgagaatggctcataccatgattatgcaggactttgtcgcagggatggccggtaccgcgcacatcgatggtgaccacatcgtcgtatccgtgcccgaagcagtattagtgtctgatgttgtcaccgatgacggaatcaccctggaccacgggctcgcagcagaggttgtgcacggccccgatatcatcaccgaaacagacgtcgttacagagggcgtcattgtccccgaagcagtgctcgaagccgatgtcgcgatcgaggaggatctggaggaggatgatggcgatcacattctgacctcagagctcattaccgagaccgtgagagtaccagagcaagtgtttgttgctgatctagtgactgggccgaacggtcacctggagcatgttgtgcaagattgcgtgagtggcgtcgacagccctacaatggtctctgaggaggtcctagttaccaattctgatactgaaaccgtgatccaggcggctggtggcgtgcccgggtctaccgtcacgatcaagacagaagacgacgatgatgacgatgtgaaatccaccagtgaggattatctcatgatctccctcgatgacgtgggcgaaaagctggagcatatgggcaatacaccattaaagatcggctctgacggctcacaagaggacgctaaagaagacggctttggatccgaggtgataaaggtgtacatttttaaggcagaggccgaagatgacgtagagatcggtggaaccgagattgtcacagagtctgagtacacgtctggccatagcgtggctggcgtccttgaccagtctaggatgcagagagagaaaatggtatatatggcagtcaaggattcctcacaggaggaggacgatatccgggacgagaggagggtcagccgaagatacgaagattgccaggcatccggcaatactctcgatagcgcactcgagtcacgctcttcaacagctgctcagtatctccaaatctgtgacggcatcaatacaaacaaggtgcttaaacagaaggcaaagaaaagaaggcggggagaaactcggcagtggcaaacggctgtgatcattggcccagacggacaaccgctcaccgtgtatccctgtcatatctgcaccaagaaattcaaatccaggggcttcctgaagaggcatatgaaaaatcaccccgaccacctgatgcgcaagaagtatcagtgcactgattgcgacttcacaaccaataagaaggtgtccttccataaccacttggagtcacacaaactgataaacaaggtagacaagacgcatgagtttaccgaatatacccggagatacagagaggcctctcctctgtcatcgaataaactaattttgagggacaaagagcccaaaatgcacaagtgtaagtactgtgattatgaaacagccgagcagggcctgttgaacaggcacctgctagccgtgcacagtaaaaactttcctcatgtgtgcgtggaatgcggcaagggttttcgacatcctagtgagctgaaaaaacacatgagaacacacaccggtgagaaaccttatcagtgtcaatactgtatttttcggtgcgctgaccagtcgaacctcaagacccatataaagagcaaacacgggaataacctgccttataaatgcgaacattgtccacaagcttttggggacgaacgagaactacaaaggcatctagatttgttccagggacataagacacaccagtgcccgcactgcgaccataagagcactaattctagtgacttaaagaggcatataatttccgttcatactaaggactttccccacaagtgcgaagtgtgtgacaaggggtttcatcgaccatcagaactcaagaaacacagcgacatccataaaggaagaaagatacatcagtgtcggcactgcgattttaagacttccgaccccttcatcttgagcggacacattctctcggtacatactaaagatcaaccgcttaagtgcaagcgatgcaagagaggatttaggcaacagaacgagctcaaaaagcacatgaagacccacactggccgcaagatctatcagtgcgagtattgcgaatatagcacaaccgacgcctccggcttcaagcggcatgtcatctctatacacacaaaggattaccctcatcgatgtgagttctgcaaaaagggctttaggcggccgagcgagaaaaaccagcatattatgcggcatcacaaagaagcccttatgtag

SEQ ID NO: 141590 - DNA, 2310 bp, Artificial Sequence
  Description of Artificial Sequence: Synthetic coding sequence
atgcaagactttgtggctggcatggctggaaccgctcacattgatggagaccatatcgtggtgtccgttcctgaagcagtgttggtgagcgacgtagtgacagacgatggaattactttggatcatggcctggcagccgaggtcgtgcatggccctgatatcatcacggaaactgatgttgtgacagagggagtcatcgtcccagaggctgttcttgaagcggacgtggcgattgaggaggacctggaagaggatgatggggaccacattttgactagcgaactgatcactgagactgttcgggtgcctgagcaagtgtttgtcgccgacttagtaaccggccctaacggacatctggaacatgtggtgcaggattgcgtaagcggcgtggactcccccaccatggtgagcgaagaggtgttggtcacaaatagcgacacagagacagtgattcaggcggcaggcggggtccccggatctaccgtgacgattaagaccgaagacgatgatgatgatgacgttaaatcgactagcgaggactaccttatgatatctttagacgacgtgggcgaaaaactggaacacatgggcaacacacccctgaagattgggtctgatgggtcacaggaggatgcgaaagaggacgggttcggtagtgaggtcattaaagtgtatatctttaaagctgaggcggaggatgacgtcgaaatcggcggcaccgagatcgtaactgaatctgaatatacatctggccattctgtcgcaggagtcttagaccagagtagaatgcagcgcgaaaagatggtctatatggctgtaaaagatagtagccaggaagaggacgacattagctgtgcagagattgccgacgaggtctatatggaagtaattgtaggtgaagaagaggggaccagtttacccgagattcagctggaggactctgatgttaacaaaacggtggtccccgtggtctgggcagccgcttatggaaacactctggactccgccttagagagcagaagtagtacggccgctcagtacttgcaaatctgcgacggaatcaataccaacaaggtgcttaaacaaaaagctaagaagcgccgccgcggtgaaacaagacagtggcagacagctgtgattattgggcccgacggacagcccctgactgtctacccatgtcacatctgcacgaagaaattcaagagtcgcgggttccttaaacgacatatgaaaaatcatcccgatcacctaatgcgaaagaaatatcagtgcactgactgtgattttaccactaataaaaaggtctcattccacaatcacctggagtctcataaattaataaataaggtggataaaacccacgagtttaccgagtatacgcgccgctaccgggaggcatcacctctgtcgagcaataaattaatacttagggataaggaacctaaaatgcataagtgcaagtattgcgattatgaaaccgccgagcaggggctcctcaacagacatcttcttgctgtccattctaaaaactttcctcacgtatgcgtggaatgcggaaagggtttccgccacccaagtgagctgaagaagcacatgcgcactcataccggtgaaaagccctatcagtgtcagtattgcatcttccgatgtgctgatcagtctaacctcaaaacccatattaaatctaagcacggaaataatttgccctacaagtgtgagcattgcccccaagccttcggcgacgagcgggagctccaaaggcatctggatctgtttcaggggcataaaacccatcagtgcccgcactgtgaccacaagagcactaattctagcgacttaaagagacatatcatatccgtacacactaaggatttcccacacaagtgcgaggtatgcgacaagggatttcaccggccctctgaactgaagaaacactctgacatccacaaggggagaaaaattcatcagtgtaggcactgtgacttcaagacatctgatcccttcattcttagcggacacattctaagcgtgcacaccaaggatcagccactgaaatgtaagcggtgtaaaagggggtttagacagcagaacgaactcaaaaaacacatgaagacgcatacaggacgcaagatttatcagtgcgaatattgtgagtacagcacaactgatgcatccggcttcaagcgtcacgtgatcagcattcacactaaagattatccacatcgctgcgaattttgcaaaaaaggatttagaaggccctcagagaaaaaccagcacatcatgagacatcataaggaggctttgatgtag

SEQ ID NO: 141591 - DNA, 1812 bp, Artificial Sequence
  Description of Artificial Sequence: Synthetic coding sequence
atgatcagtctggatgacgtgggcgagaaacttgaacacatgggaaatacacccctgaagatcggctcagatggaagccaagaggatgccaaagaggatggctttggctcagaagttattaaagtttatattttcaaggccgaggctgaggatgatgtcgagatcggaggaacagagattgtgacagaaagcgagtacacctccggtcactccgtcgccggagtgttagaccagtcgcggatgcagagggagaagatggtatacatggccgtgaaggattcttctcaggaagaggatgacatctcctgtgctgaaatagctgacgaagtctatatggaggtgatcgtgggggaggaggaaggaacatcgctgcccgagatccagcttgaagacagcgatgttaataaaacggtagtcccggtcgtgtgggccgcggcctacggagacgagaggagagtcagcagacggtacgaggactgtcaggcatccggcaacaccttggatagcgcattggagtcacggtcctccactgctgctcagtacctgcaaatctgcgatggcattaatactaataaggtccttaagcagaaagcgaagaagagaagacgcggagagactcggcagtggcagacggcagtcatcattggcccagatggccagccactcaccgtgtatccgtgtcacatttgcactaaaaagtttaaaagccggggcttcctcaaacggcatatgaagaaccaccccgaccatctaatgcgcaaaaagtaccaatgtaccgattgtgacttcacgaccaacaaaaaggtttcatttcacaatcatctagagtcccacaagctgattaataaggttgacaaaacgcacgaatttacggagtacactcgccggtacagagaggctagtcccctcagttccaacaagttgatcctgagggacaaggagccgaaaatgcataaatgtaaatactgcgactatgagactgccgagcagggcctactgaatcgacacctactggcggtccactctaagaatttccctcatgtctgcgtagaatgcgggaaggggtttaggcatcccagcgagctaaagaagcacatgcggacccacaccggcgagaaaccataccagtgtcagtattgtatcttcagatgcgccgaccagtccaatttgaaaactcatatcaagtcaaagcacggcaataaccttccatataagtgcgaacactgcccacaagcttttggcgacgagagggagttacagcgacacctggacctctttcaaggccacaagactcaccaatgcccacactgtgatcataagtccacaaattcttctgacctcaagcggcacattattagcgtgcacacaaaggatttcccccataaatgtgaggtttgcgacaagggattccatcgccctagcgagcttaagaaacacagcgatattcataagggcaggaagatccaccagtgtcgacattgcgactttaaaacaagcgaccctttcatcttgagtggccacatcctctcggtgcacactaaggatcaacctttaaaatgcaagcggtgcaagcgtggctttaggcaacagaatgagctgaaaaagcacatgaagacacacacaggcaggaaaatttaccagtgtgagtactgtgagtacagcacaactgatgcgtctgggttcaaacgccacgttataagtattcacaccaaggattatccacatcggtgtgaattttgtaaaaaaggcttccgacggccgtctgagaagaatcagcacattatgcgacaccacaaagaggctctgatgtag

SEQ ID NO: 141592 - DNA, 1611 bp, Artificial Sequence
  Description of Artificial Sequence: Synthetic coding sequence
atgggccctcttcagttccgggatgtagccatcgagttctcattagaggaatggcactgcttggacaccgcccaacgaaatctatacagaaacgtaatgctggagaactaccggaacctcgtttttctgggcattgttgtctccaagcccgatctgataacctgcctggaacaaggaaagaaaccccttaccatgaaaaaacatgaaatggttgccaacccaagtgtaacatgctcacactttgctagggacctctggccagaacagtccattaaagattcattccagaaagtgactctgaggagatacgaaaattacggacacgataacctacaattcaagaaggggtgtgaaagtgtagatgagtgtaaggtccacaagcgagggtacaatggcctaaatcagtacctcaccacaacccagagcaagatctttcagtgcgataagtatgtcaaggtgatccacaagttctctaactcaaacaggcacaaaattagacatactgggaagaaacctttcaagtgtattgagtgcggaaaggccttcaatcagagtagcaccctgaccacccataagaagattcatacaggcgagaaaccttttaaatgtgaagagtgtggcaaagccttcaattggagctctcatctgaccacacacaaaaggatccatacaggtgagaagcgatacaagtgcgaggactgcggaaaagctttcagcagatttagctacctcactgctcacaaaatcatacacagcggcgagaaaccttataaatgcgaggagtgcggtaaagctttcaaaaggtcctcgaatctgacaacacataaaattatccatactggggagaaaccatataagtgtgaagaatgcggcaaagcatttaagcggagtagcatcttaacagcccataaaataatccacagtggagaaaaaccttacaaatgcgaggagtgtggtaaagcgttcaagcacccttctgtgctcacgacacataaaagaatccacacgggagagaagccatataagtgcgaggagtgcggccgggccttcaagtacttcagttcactgacaacccacaagataattcactctggcgagaaaccttataagtgcgaagaatgtggaaaagcatttaattggtcctcccaccttaccacccacaaaagaatccacaccggggaaaagccgtataaatgcgaggagtgcggggaagctttcaagtacagctcaagcctgacaacccacaagattatccatactgggcagcagcctttcaagtgtgaggagtgtggcaaggcatttaaatgcttctctattttgaccacacacaagcgcattcatacaggtgagaagccctataagtgcgaagagtgcgggaaagccttcaatagttcttcgcacctcaccgcccacaagaggatccacaccggggagaaaccgtacaaatgcgagcgttgcggcaaggcatttaaacggagctttatcctcacacgtcataagcggatacacactggcgagaagccctacaaatgcgaggagtgcggtaaaggcttcaagtgtccatccacactgactacacataaagttatccataccggagaaaagttgtag

SEQ ID NO: 141593 - DNA, 1935 bp, Artificial Sequence
  Description of Artificial Sequence: Synthetic coding sequence
atggagattcccgcacctgaacctgagaagaccgccctgtctagtcaagacccagccctgtccttgaaggaaaacctcgaggatatatctggttgggggttgcccgaagcaaggagcaaggaatccgtgagcttcaaagatgtagcggtcgatttcacgcaggaagaatggggacaactcgacagtccacaaagagctctgtacagggacgtgatgctggagaattaccagaacctgctggcgctcggcccccccctgcacaaaccagacgtcatctcacatcttgaacgcggggaagagccctggagcatgcagagagaagttcctcggggtccatgcccggagtgggagctaaaggcggtaccttcccagcagcagggtatctgcaaagaggaaccagcacaggaacctataatggagcgccccctgggcggggcccaggcttgggggagacaagctggcgctctgcagcggtctcaagctgctccctgggctccagcaccggcaatggtttgggacgtgcccgtggaggaatttccactgcgttgcccactgtttgcccagcagagggtgcccgagggggggcccctgctggatacccgaaaaaacgtgcaggctactgaggggcgtactaaagcacccgccaggttgtgcgcaggtgagaacgccagcacaccatccgaacccgaaaaattccctcaagtgaggagacaacgtggagccggtgccggagaaggggagttcgtgtgcggtgagtgtggaaaagcgttcagacagtccagcagtttgacccttcaccgacggtggcacagtcgcgagaaagcatataagtgtgatgagtgcggtaaagcctttacctggtccactaaccttttagagcaccgacggattcacactggcgagaagccatttttctgtggagaatgcggcaaagcgttttcctgtcactcatcattaaacgtacatcaaagaattcatacaggcgagcggccatacaaatgcagcgcttgcgaaaaggcatttagttgctcctcactgctgtcgatgcacttgcgggtgcatactggcgaaaagccctatcgatgcggcgagtgtggcaaggccttcaaccaacgaacgcatctgacacggcaccaccgcatccatacaggggagaagccttaccaatgtggctcttgcgggaaggcttttacatgccatagctccctcacggtccacgaaaagattcatagcggagataagcccttcaagtgcagcgactgtgagaaggccttcaactcccgttctcggctgacccttcaccaacgtacacacacaggcgaaaagccatttaagtgcgccgactgcggcaaaggtttctcctgtcatgcatatctattggtgcacagaaggatacatagcggggagaagcctttcaagtgtaacgagtgtgggaaagcgttctcttcacacgcatatctaatcgtgcatcgcaggatccacaccggagaaaaaccattcgattgttcccagtgttggaaagcctttagctgtcactcctccttaattgtgcaccagaggatacacaccggcgagaaaccctacaagtgctctgagtgtggacgcgccttcagccaaaatcactgcctgataaaacaccagaaaatccactctggggagaaaagcttcaagtgtgagaagtgtggggaaatgttcaattggtcgtcacatctcaccgagcatcagaggctccatagtgaaggaaagccacttgctattcagtttaacaagcacctgctgagcacctattatgttcccggaagtcttctgggcgcgggggacgccgggctgagggacgttgaccctatcgatgccctcgacgtggccaaacttctctgtgtcgtacctcccagagccgggcggaacttctctctgggctctaaacccaggaattag

SEQ ID NO: 141594 - DNA, 1935 bp, Artificial Sequence
  Description of Artificial Sequence: Synthetic coding sequence
atggagatccctgcccccgagccagagaaaactgccctgtcttctcaggacccagcactctcactgaaagaaaatctggaggacattagtggctgggggctgcctgaggctaggagtaaggaatccgtctcattcaaagatgtggcagtggactttacccaggaggagtggggacagctggactctccgcagagagcactttatcgcgacgttatgctggagaattatcagaacttattggctttagggcctccgctgcacaaaccagacgtgatcagccacctagagcgcggggaagaaccatggtccatgcaaagagaagttccccgaggtccttgcccagagtgggagctcaaggcagtgccctctcagcaacaggggatttgtaaggaggagcccgcccaggaaccgatcatggaacggcccttaggcggcgctcaggcctgggggcggcaggccggagccctccagcgctcccaagctgcaccctgggcccccgccccagccatggtgtgggatgtgccagttgaggagtttccattacgatgtcccctctttgcccagcagagggtgcccgaaggaggcccattactggatacacggaagaacgtgcaggctacagagggcagaacaaaggcccccgcacgactgtgcgctggggaaaacgcctccaccccctcagaaccagagaagttccctcaggtccgccggcagcgcggggcgggagccggtgagggtgagtttgtgtgcggcgagtgcggaaaggcatttcgtcagtctagctccctgaccctgcaccgtcggtggcactcccgggagaaggcatacaagtgtgacgagtgcggtaaggcctttacctggtccacaaatctgttggagcaccgccggattcacaccggcgagaagccattcttttgtggcgaatgcgggaaagcattcagctgtcactctagccttaacgtccaccagaggattcacacaggagaacgtccctacaagtgcagcgcctgtgaaaaagctttttcttgttcgtctctactctcgatgcacctgcgagtccataccggtgagaagccctataggtgcggcgaatgtggcaaagcgtttaatcaaagaacccacctgacccgacaccaccgcattcataccggggagaagccataccagtgtggttcttgtggcaaggcctttacatgtcacagtagtctcacagtgcacgaaaaaatccacagcggcgacaaaccattcaagtgctcagactgtgagaaggcttttaactcaagatccagactaactctgcaccagcgtacacacaccggcgaaaaacctttcaagtgcgctgactgtggaaagggattttcctgtcatgcgtatctgctggtccacagacgcattcattcaggagaaaaaccatttaagtgtaatgaatgtggcaaggcattttccagccacgcatacttaattgttcaccggcggatacacaccggcgaaaagccatttgattgtagccagtgttggaaggctttttcctgtcatagctctcttatcgtgcatcagcggatccacacaggggagaagccttataaatgttctgagtgtgggcgggcgtttagccagaaccattgcctgattaaacaccagaagattcatagtggtgagaagagctttaaatgcgagaagtgtggagagatgtttaattggagcagccatctgacggagcatcagcggttacactcagaaggaaaaccactcgcaatccagttcaataagcatctcctctcaacgtattatgtgcctggttccctactaggcgccggtgacgctggactgcgggatgtggatccaattgatgcactggatgtagcaaaacttttatgtgttgtgcctccccgtgcgggccgcaactttagcttaggctccaaaccccggaactag

SEQ ID NO: 141595 - DNA, 1839 bp, Artificial Sequence
  Description of Artificial Sequence: Synthetic coding sequence
atggaaatccctgctcctgaacccgagaagaccgccctgagcagtcaggaccctgcactttccctgaaagagaacctggaggacatttccggatgggggctacccgaggccaggagcaaagaaagcgtcagtttcaaagacgtagctgtcgatttcactcaggaggagtggggacagctcgacagcccccagagggccctatatagagacgttatgttagagaattatcaaaatctgcttgccctagagtgggaactgaaggccgttccaagtcagcagcaggggatatgtaaagaagaaccagcacaggaaccaattatggagcgacccctaggcggagctcaggcatgggggcggcaagccggcgcattgcagcggtctcaagccgccccatgggccccagctccagctatggtctgggacgtccctgtggaggaattccccttgcggtgccccctgtttgcacagcaacgtgtcccggaaggtggtccgctgctggatactagaaaaaatgtgcaggccaccgaaggcagaaccaaagctcctgcgcgactgtgtgccggcgagaatgcatctacccccagcgagccggagaagtttccacaggtccgtcgtcagcgcggagccggtgccggggaaggggagtttgtctgcggcgaatgcggaaaggcatttagacagagctcgtctcttacgcttcacaggagatggcatagcagggagaaggcctacaagtgcgatgagtgcggcaaggcctttacatggtccacgaacctgctggaacatcgcagaatacacacgggcgaaaaacctttcttttgcggagagtgtggcaaagcattcagctgccactcctctttaaatgtccaccagaggattcataccggggaaaggccgtacaaatgcagcgcgtgcgagaaggccttttcatgtagctctttgttatctatgcacttgagagtgcacactggcgagaagccctatcggtgtggtgaatgcggcaaggcctttaatcagaggacacatctaacccgccaccaccgcatacataccggcgaaaaaccataccagtgcggttcctgtgggaaagcattcacctgtcactcttctcttacagtgcacgaaaagattcatagtggtgataaaccctttaagtgctccgattgtgagaaggcgttcaacagcaggagtaggctgactctgcatcagagaacacatactggcgagaagccttttaagtgcgcagactgcggaaaaggattttcatgccacgcttacctgcttgtacaccggcgaatacactcaggagagaaaccattcaagtgtaacgagtgcggaaaggccttctcctcccatgcctatctaatcgtgcataggcgcatccacaccggcgaaaagcccttcgactgtagccagtgctggaaagccttttcatgccattcctccctcatagtgcaccagcggattcacaccggggagaagccatacaaatgttcagaatgcggaagagcattcagccaaaaccattgccttatcaaacaccaaaagattcactcgggggaaaagtccttcaaatgtgaaaagtgtggcgaaatgtttaactggtcctcccacttgactgagcatcagaggctacattctgaaggtaagcctctggctatacaatttaacaaacacctgctgtcaacctactatgtgccaggatcactcctcggcgccggcgatgcgggcctaagggacgttgaccccattgacgctctcgacgttgccaagctgctgtgcgtggtgccccctagagccgggcggaatttctcactcggatccaagccacgaaattag

SEQ ID NO: 141596 - DNA, 210 bp, Artificial Sequence
  Description of Artificial Sequence: Synthetic coding sequence
atggagatacccgcacccgagcccgagaagactgcactcagctctcaggacccggctctcagcttaaaagaaaatcttgaggacattagtggatggggactgccagaggcccggtccaaatctctggcccttgtgacacaagctggtgtgcaatggaggaacctcgggtcactccagcctcccccgttggggtttaaacagttcagctag

SEQ ID NO: 141597 - DNA, 1935 bp, Artificial Sequence
  Description of Artificial Sequence: Synthetic coding sequence
atggctgaagccgtggccgcgcccatcagtccatggactatggcagcgacaatccaagccatggagaggaaaatcgagtcccaggccgcccggttgcttagtctggaaggtaggactgggatggccgagaaaaagttggccgactgtgaaaagacagctgtcgaatttggtaaccaattagagggcaagtgggccgtcctcggcactttgctgcaggaatacggtcttctgcagcggcgactggagaatgttgaaaacctcctgcgcaataggaatttttggatccttcgcttaccccccggaagtaagggcgagtctcctaaagagtggggcaagctcgaagactggcagaaggaactgtataagcatgtcatgcgtggaaactatgagaccctcgtttctttggattacgctatttcaaagcccgaggtactctctcagatcgaacaaggcaaggagccctgtaattggcggcgcccaggtcccaagattcctgatgtccctgttgacccttctccaggttcaggacctcctgtaccagcgcctgacctgctcatgcagattaagcaggagggcgaattgcaattgcaggagcaacaggcactgggcgtcgaagcttgggccgcaggccagccggatatcggcgaggagccttggggcctgagccaactggatagtggagccggcgacatcagcactgacgctacaagtggcgtacacagtaattttagcacaacaatccctcccacctcctggcagacagacctgccaccacaccatccaagttcagcttgctcggacggcacccttaagctgaacacagccgcttcaaccgaggacgtcaaaatcgtcatcaaaacagaggtccaggaggaggaagtcgtggccactccagtacatccaacagatctcgaagcccacggcacccttttcggccccggtcaagcgactcgtttcttcccttcacctgctcaggagggcgcatgggagtcccagggatcctcattcccctctcaggaccccgtgcttggcctgagagaaccggcccgcccagagagagatatgggagagctgagcccagccgtggcgcaagaggagactccgcccggtgattggctctttggaggagtgaggtggggctggaactttcgatgtaaacccccagtaggtctgaacccgcgcactgggccggaagggctgccttacagcagcccagataatggtgaagccatattggaccctagtcaggcgccgaggccttttaatgagccctgtaaatacccaggccgcacaaaaggctttggccataagccaggtctgaagaaacatcctgcggccccgccaggcggccggccgtttacatgcgccacctgtggtaagtcctttcaactccaagtttcgctatctgctcatcagaggtcctgtggggctcctgacgggagcgggcctggaaccggtggtggcggaagcggttcaggaggcggcggaggtggctccggcggaggctctgccagggatgggtctgcactgcgctgtggagagtgtggcaggtgcttcacccgtcccgctcatttgattagacataggatgctgcatactggagagcgaccctttccatgtaccgagtgcgagaagagattcactgagcgttctaagttaattgaccactataggacacacactggcgtaagaccgttcacatgcacagtctgtggcaaatccttcatcagaaaggaccatctcagaaagcaccaacgaaatcatgccgcaggagctaagactccggccagaggtcagcctctccccacccctcccgcacctcctgacccattcaagagcccagccagcaaaggccctctcgccagcactgatctggttaccgattggacatgtggactctctgtgttgggccccaccgatgggggcgatatgtag

SEQ ID NO: 141598 - DNA, 1938 bp, Artificial Sequence
  Description of Artificial Sequence: Synthetic coding sequence
atggcagaggccgtggcagctccaatttccccatggaccatggctgccactatccaggctatggaaaggaaaatcgaatcacaagccgctcggctgctctctctggagggacgtacagggatggccgaaaaaaagctggccgattgcgagaagactgcagtggagttcggcaaccagcttgaggggaaatgggccgttctggggaccctcctgcaagaatacgggctcctgcaaaggagattggagaacgtagagaatctcctcaggaatcggaatttctggatccttcgccttccacccggatccaagggtgagtcaccgaaagagtgggggaaactcgaggactggcagaaggagctatataagcacgttatgcgagggaattacgagacactcgtgagtctggactacgcaatctccaagccagaagttcttagtcaaattgagcagggtaaggaaccatgcaattggagaaggccaggacctaagattccagacgtccctgtggaccccagtccaggttcaggcccacctgtgcctgctcctgacctgcttatgcagataaaacaggaaggagagctgcagctgcaagagcagcaggcactgggagttgaggcatgggccgcaggtcaacctgatattggtgaggaaccctggggattgagtcagctcgactccggggccggggatattagcacagacgccacttcaggcgttcacagcaatttcagtaccactattccacctactagttggcaaaccgatctccctccacatcacccatcatctgcatgtagcgacggcactctgaaactgaatactgccgcttccaccgaggcagatgtcaagatagtgatcaaaaccgaggtgcaggaggaggaggtcgtagctacacccgttcacccaaccgaccttgaggctcatggtacactttttggccccgggcaggccacaagattcttcccctctccagctcaggaaggtgcatgggaaagccagggtagttctttccccagtcaggatcccgtgctcggtctgagagaaccagctagacccgagcgggacatgggggagctgagccccgctgtggctcaggaggagacacccccaggagattggcttttcgggggagtgcgctggggatggaactttaggtgcaagcctccagtaggactcaaccctcgaacagggcctgagggactaccatatagctcccccgacaatggcgaagcgattctggaccccagccaggccccccgccctttcaatgagccttgcaaataccctgggcggacaaaaggatttgggcacaaaccagggttgaaaaaacaccctgctgcaccaccgggcgggcgacctttcacgtgtgccacttgtgggaagtctttccagcttcaggttagtctttctgctcaccagcgctcttgtggcgcccccgatggctctggtcctgggacagggggcgggggcagtgggagcggcgggggcggggggggcagtggcggcggatctgccagggacggttccgctctgaggtgcggcgagtgcggcaggtgtttcactcggcccgcacacctcattcggcacagaatgctgcatactggggaacgaccattcccctgtactgagtgcgagaagagattcaccgagagatcgaagctgatcgaccattacaggacacacaccggtgtaaggcccttcacctgcactgtgtgcgggaagagcttcataagaaaggatcacctgagaaagcaccaaaggaatcacgcagccggagctaagacccctgcccggggacagcccctcccaacaccacctgcgccgcctgacccctttaagtccccagctagcaaagggccactagcttcaaccgatctggtcactgattggacctgtgggctgtcagtacttggacctacagacggtggcgatatgtag

SEQ ID NO: 141599 - DNA, 2172 bp, Artificial Sequence
  Description of Artificial Sequence: Synthetic coding sequence
atgtctctgctaaaagaacgaaagcctaagaaaccacattacatacctagacctccaggaaagccatttaaatacaaatgcttccagtgtccatttacgtgcaatgagaagtctcatctcttcaaccatatgaagtatggactttgtaaaaactcaatcactttagtctccgaacaggatcgggtaccgaaatgccccaagagcaactccctcgaccccaaacagactaatcagccagatgcaaccgcaaaacccgctagttctaaatccgtcgctaacggtttgtcggcttttgactctaagctgcagcacagctccgctagggaagacattaaggagaatttggagctgcaggccagagggacacaccggtgtctcggacagaaaccggcgctgcacagggcatcaccatgcaagtcacctgccccagaagccgctctgggcgctcagccagctttggaaggagccgctcgaccatctgcatttgtgcccgtgggggagcacagactgaaaggccctgataatgccgaagcccctgagacgctggccctgcataatcctacagcaaaggccgtgtccttccataccaagtctgcattccacactcccgggtacccttggaaagcaggaagtcccttcctacctccggagttccctcataaaatttctagcacgaagggacttggagcaatctcaccatacatgcatccaaccattccggagtacccaccccacttctatactgaacatggcctcgccaccatctattctccctatctgttggccggttcttctcctgagtgcgacgcccctctgctgtctgtatatggcacacaagaccctcgccacttcctgccacaccccggcccaatcccgaagcacctggccccatcccccgccacttacgaccactaccggttttttcagcagtacccctctaatttacctatcccatatgggttttacaggcctgaatcagcatttagctcctatggactccggctgccacctgtcacaggactcacgcgggaccagtcttcccacttgctggaggaggccacactcgtatatcccgccagcagcccttccaggctgaacccttccgaccccaaccggaagcatgtggaattcgagagcccaattcctgaggctaaagatagcagcaaggctggtcagagggatacagagggcagcaaaatgtccccacgcgctgggtctgccgccactgggtctcccggacgccccagtccaacagatttcatgcaaacttcccagacctgcgagggactatatgatcttagtaataaagccgcgtccagcgcgctaggccgcctgtaccctcctgaacagtccctgactgcgttccggccagttaagaagagtaccgagtgcctgcctgcacaagccgccgagactaccgccgaatcaccagtgagcctgaatgtcgtgaacggagaccccccagcaccgacggggtctgcttccctggtgagcgaggccgcaccctcctctcctgatgatagcagtgggatgggccctctgaacctctccaaaaaatcagaaatcaacctggcggcaactcatgagccaacttaccaggggagtccacaggcggaaactgcctccttcagtgaactgcaggacctgccattaaacctgtcagtgaaagacccgtgcaacacccaggcacctaggccagcctttcccggcagacctagggctgccgagcccgccgccgccgtgcctcagaagaccggcaccgagggaagcgaggacggcccctctcaccctgagacaaagcctggttccctagacggggatggcgcaccacccaccggacccggcgaggaagcacccgatgcttgtgccgtggactcaagtgaggaacagaaacagacggctgctgtcgcactgtgtcagcttgctgcctattccccaaggaacatacgggttggtgacggtgatgccgctgcgccggagcccgcctgcagacaggacacccccaccctctcttcaatggaatctcaggaggctcagtgtgaccttcggcctaaggggcaaaaaaggacgtccctccgtgacgctgggaagtcacagcagggcgccaagaaggccaagctccaagacaccgccagagtgttcaccctccggcgccgggccagagtctcgtag

SEQ ID NO: 141600 - DNA, 951 bp, Artificial Sequence
  Description of Artificial Sequence: Synthetic coding sequence
atgtcacccagagccggttccgcagctacagggagtccaggccgaccatcccccactgacttcatgcagactagccagacatgtgaaggactttatgatctgtccaataaagccgcaagtagcgcgctaggtaggctgtacccccctgagcagtcactgacggctttccggcccgtaaagaagagcactgagtgtttgcccgctcaggcggccgagaccacagccgaaagtccagtatcgcttaacgtcgtaaacggcgatccgccggctcccacaggttccgcctccctggtgtcggaagcagccccttcctcacccgatgatagctccggaaaatccgagatcaacctcgcagctactcacgagcccacataccaggggtcgccccaggccgaaaccgcaagttttagcgaactgcaggatttacctctcaacttatcagtaaaggacccgtgcaatacacaggcaccgagacccgccttcccagggagacctagggccgctgaacccgcagctgcagtgcctcagaagaccggcaccgaggggagcgaagatgggcccagccaccccgaaaccaaaccaggtagcctggatggcgacggtgctcccccgacaggacctggggaggaggcaccagatgcctgtgctgtggatagtagcgaggaacaaaaacaaaccgccgccgtggccttgtgccagcttgccgcctattctcctcgaaacattagggtcggtgatggtgatgcagccgctccagaacctgcctgccggcaggacactcccaccctgtcaagtatggagagccaggaagcccaatgtgatttaagacccaaaggccagaagcgaacctcactgagagatgctggaaaatcacaacagggtgctaagaaagccaagctgcaggacacagcgagggtgtttactctgaggcgtagggctagagtcagctag

SEQ ID NO: 141601 - DNA, 891 bp, Artificial Sequence
  Description of Artificial Sequence: Synthetic coding sequence
atgtacttcagccaggaagaatgggagctcctcgatcctacacagaaggcattgtacaatgacgtcatgcaagagaattacgagacagtcattagcctggctctattcgtgcttcctaaacccaaagtgatatcctgtctggagcagggcgaggaaccttgggttcaggtgagccctgagtttaaagactctgccgggaaatcccctactggattgaaactgaagaatgacactgaaaatcaccagcctgtctctctcagcgacctggagatccaggcatctgcaggcgtgatttcaaaaaaagcgaaagttaaggtgccacaaaaaactgccggcaaggagaaccacttcgatatgcacagggtgggcaagtggcaccaagactttccagtgaaaaaaaggaagaagctctcaacatggaagcaggaactgctgaagctgatggatagacataaaaaagactgcgccagagagaagccattcaaatgccaggaatgcggcaagacttttagagtctcttcggacttgatcaaacatcagcggattcacacggaagaaaagccctataaatgccagcagtgcgacaaacggttcagatggagctccgacctcaacaaacacctgacaacccatcaaggaatcaagccatacaagtgctcttggtgtgggaagagcttctcacagaatactaacctgcatactcatcagagaactcacaccggagagaagccgttcacctgtcatgagtgtggcaaaaagttttctcagaattcccatttgattaagcaccggaggacacatactggggagcagccctatacctgctctatttgtagacgaaatttcagtaggagatcatcactcctgagacatcagaagttgcatttatag

SEQ ID NO: 141602 - DNA, 891 bp, Artificial Sequence
  Description of Artificial Sequence: Synthetic coding sequence
atgtatttcagccaggaggaatgggaattgcttgatcctacccagaaagccctctataacgacgtcatgcaagagaactacgagactgtaatatctttggcgctgttcgtgcttcccaagcctaaagtaatatcctgtctggagcaaggcgaggaaccctgggtccaggtctctccagagtttaaggacagcgccgggaagtcacccactgggctgaaactgaaaaatgacacagagaatcatcagcccgtttctttgtccgacctggaaatacaggcttccgccggcgtgatctcaaagaaagcaaaggttaaggtgccacaaaaaaccgccggcaaggagaaccactttgatatgcatcgggtagggaaatggcaccaggactttccagtgaagaagaggaagaaactttcgacatggaagcaagagctgctgaaactaatggacaggcacaaaaaagattgcgcccgagagaagccgtttaaatgccaagagtgtgggaagacattcagagtctcttccgacctaatcaagcaccaacgcatccatacagaagagaagccctacaagtgtcagcagtgcgataagagattcagatggtcttctgacctgaataagcacctcactacacaccaaggcattaagccctataagtgttcgtggtgtggtaaaagttttagtcagaacactaacttgcatacgcatcagcgaacccataccggggaaaagccatttacttgccatgagtgcggcaaaaaattctcccagaattcccacttgattaaacacagacgaacccacaccggcgaacagccatatacgtgcagcatctgtcgtcgaaacttttcccgtaggtccagcctgctgagacatcagaagttgcatctgtag

SEQ ID NO: 141603 - DNA, 1248 bp, Artificial Sequence
  Description of Artificial Sequence: Synthetic coding sequence
atggccatgcgagaattaaacgccgatagctgcagttcgccccaaatgggggccatgtgggaaacatccgggtcggtcaaagagaattcctctcaatccaagaagtatagcaccaaaatcgagaaccttggtccggagtctgcatgcaggcatttctggtccttcaggtatcatgaggcaacaggcccgctggaaaccataagccagctgcaaaaactctgtcaccagtggttgcggccagaaattcattccaaggagcaaatactggagatgctggtgctagagcagtttctgagcattctgccgaaagaaacccagaactgggttcagaaacaccacccccagaacgtgaagcaggccctggtgcttgttgagttcttacaacgggagcccgacggcaccaagaacgagtccctcttaacgtttgaagatgtggctgtctacttctctgaagaggaatggcaattgctgaatccccttgagaagaccttgtacaacgatgtgatgcaggacatttacgagaccgtcatttccttgggcctgaagctgaagaatgacaccggcaatgatcaccctataagtgtgagtacgtctgagattcaaacgtcaggatgtgaggtctccaagaaaacacggatgaagattgcccagaagacaatgggcagagaaaatccaggagatacccattcagtgcagaaatggcacagagcctttccccgcaagaagcgcaagaaaccggcaacttgcaaacaggaactccccaagttaatggatctccatggcaaggggccgactggggaaaagccttttaaatgccaggagtgtggaaagtcatttcgcgtttcatcagacctgattaagcaccatcgaatccacacaggcgaaaaaccctacaaatgccagcagtgcgaccgtaggtttagatggagcagcgatctgaacaaacattttatgacccaccagggaattaagccatataggtgtagctggtgcggaaaatctttcagtcacaacaccaaccttcacacacaccagcgaatacacactggcgaaaaaccattcaaatgtgatgagtgcgggaaacgctttattcagaatagccacctgatcaaacatcaaagaacccatacaggagagcaaccctacacatgcagcctatgtaagaggaacttcagccggcggtcctcccttttgcgtcatcaaaaacttcatcgccgtcgcgaggcgtgtctggtgtctccgaattag

SEQ ID NO: 141604 - DNA, 1533 bp, Artificial Sequence
  Description of Artificial Sequence: Synthetic coding sequence
atggccatgagggaactgaacgccgactcttgttccagtcctcaaatgggtgctatgtgggagacgagcggaagtgtgaaggagaattcctcccagtccaagaaatattccacaaagatcgaaaaccttggacccgaatctgcctgtcggcatttttggtcctttcggtaccacgaagctacagggcccctggagacaatcagccagctgcaaaagttgtgtcaccagtggcttcggcctgagatccattcaaaagagcagatactcgagatgctggttcttgaacaattcctgtccatcctgccgaaggaaactcagaattgggtccagaagcaccacccacaaaacgtcaaacaggcgctggttctcgtagagttccttcagcgagaaccagatggcactaaaaacgaggtcactgctcacgaactgggcaaggaagctgtcctgctaggcggcacggcagtggcaccgggtttcaagtggaaacccgctgagccccagccaatgggcgtgtttcagaaagagtactggaacacctatcgtgtgctccaggagcagctgggctggaatacccacaaggaaacccagcctgtgtacgaacgggccgtccatgaccaacagatgctcgctctgtctgaacagaagcggatcaagcactggaagatggcttccaagctcattctcccagaatcactcagcctgcttaccttcgaagatgtcgcagtgtacttctccgaggaggagtggcagctgttaaaccctctggaaaaaactctgtataatgatgtcatgcaagatatttatgaaaccgtgatctctctcggattaaaattgaaaaacgacacagggaacgaccatcccattagcgtgagcactagcgaaatccaaacctccggctgtgaggtatccaagaaaacaaggatgaagatcgctcagaagacgatgggacgcgaaaacccaggagatacccacagtgtgcagaaatggcatagggcatttccccgcaaaaaaagaaagaagcccgcaacatgtaagcaggaattgcccaagctgatggatctccatgggaagggtcccacgggtgaaaaacccttcaaatgtcaggagtgcggcaagagctttcgggtctcctccgatttgattaagcaccataggatccatacaggcgaaaagccttacaaatgtcagcagtgtgatcgcaggtttcgttggagctccgatctgaacaagcactttatgacccatcaaggaattaagccctaccgctgtagctggtgtggtaagtctttcagccataacacaaacctacatacacaccagcgcatccataccggggagaaaccgtttaagtgcgacgagtgcgggaagaggttcattcagaacagtcacctgataaagcaccagagaacccacaccggagaacaaccctatacttgttccctgtgtaagcggaacttctctcggcggtcttctttgttacggcaccagaaacttcatcggaggcgtgaagcctgcctggtgtcgcctaattag

SEQ ID NO: 141605 - DNA, 1548 bp, Artificial Sequence
  Description of Artificial Sequence: Synthetic coding sequence
atggaaagcctgggcctgcatactgttacattgtctgacggaacaaccgcatacgttcagcaggccgttaagggcgagaaactgctggaaggccaagttatccagctagaagatgggaccacagcttatattcatcaagtaacagtgcagaaggaggccctttccttcgaggacgggcaacccgtccaattggaggacggttccatggcctacatccatcggaccccgagggagggttatgatccaagtacacttgaggccgtccagctcgaggacggaagcacggcctatatccatcatcccgtggccgtgcctagcgagagcacaattctcgccgtccaaactgaagtgggactggaagaccttgctgccgaagatgatgaagggttcagcgccgacgccgtggtggctcttgagcagtatgcttccaaggtgctgcacgattctcagattcctagaaatggtaaaggtcagcaggtgggagaccgagcctttcgatgtggctacaaagggtgtggccgattgtacaccacggcgcatcatttaaaggtccatgagagagcacacaccggagaccgaccgtaccggtgtgatttcccgagttgcggtaaggcattcgcgacagggtacggcctgaaaagtcatgtccgtacgcacaccggagagaagccttacaaatgcccagaagaattgtgttctaaggccttcaagacatcaggggacttgcaaaagcatgtgagaactcataccggcgagcgccctttccagtgcccgtttgagggctgtgggcggtccttcaccacctcgaacattcgcaaggttcacgtcagaactcacacgggagagaggccatacacctgtccagagcctcattgcgggcgagggttcacttctgctaccaactataaaaatcacgtgcggatccacacgggtgagaagccatatgtgtgcacagtgcctggctgcgggaagcggttcacagagtacagctccctttataaacaccatgtggtacacacacactgcaaaccatacacttgttccacttgcgggaagacataccggcaaacctctacactggccatgcataagcggtccgcccacggcgaactagaggccactgaagaaagcgagcaagcgctatatgaacagcagcagcttgaggctgcaagcgctgctgaggagagtccaccgccaaagagaccacggattgcttatttgtccgaggtgaaggaggagagggacgatatccccgcccaggttgccatggtgaccgaggaggacggcgcaccacaggtggctctgatcactcaagacggagcccagcaggtgacgatcataacctccggggctgtagttgcggaggacagctcggtggccagcctgagacatcagcaggttgcccttttggcgaccgcgaacggaactcacattgccgtgcagctggaggaacagcaaacactcgaagaggccattaatgtagcgacggctgccatgcagcaaggtgctgttaccctggaaacaacggtgtctgagagcggttgttag

SEQ ID NO: 141606 - DNA, 1713 bp, Artificial Sequence
  Description of Artificial Sequence: Synthetic coding sequence
atggagtccctaggcctccatactgtgaccctttcagatggtacgacagcctacgtgcagcaggcggtgaaaggagaaaagctccttgaagggcaggtgattcagcttgaggacggcacgactgcgtatatccaccaggtcaccgtgcagaaggaggctctgagcttcgaggatggccagccagtgcagctcgaggacggtagtatggcctacatacatagaacccctagagagggatatgatccatcgacacttgaggccgttcagctcgaagacggctctacagcttatatccaccatcccgtcgccgttccctccgagagcacaatcctggccgtccaaaccgaggtaggcctagaagacctggccgcagaggacgatgagggattcagcgccgacgctgtggtggccctcgaacagtacgcatcaaaggtcctccatgattcacaaatccccaggaacgggaaggggcaacaggtcggggaccgcgcattccgctgtggctacaaagggtgcggacgcctctacacaaccgctcatcacttgaaagtacacgagcgcgcccacacgggcgatcgaccctataggtgcgacttcccatcgtgcggcaaggccttcgccacaggatacggcttgaaatcgcatgttcgtactcatactggggagaagccatataagtgtcccgaggagttatgcagcaaagctttcaaaacatctggcgatcttcaaaagcacgtgcggactcacacaggcgagcgccctttccagtgccctttcgaaggctgcgggcgatccttcactacaagcaatattaggaaggtgcacgtccggactcacactggcgaacggccttacacttgtcctgaacctcactgtggacgggggtttacctcagctaccaattataagaaccatgtgcgcattcataccggagagaagccgtatgtgtgtacagtccctgggtgtgggaagaggtttacagaatacagttcactctataagcaccacgttgtgcatacccactgtaaaccgtacacctgctccacctgcggaaagacttacaggcagacatctacattggccatgcacaagcgctccgcgcatggcgagctcgaggctactgaggaatctgaacaggctctctacgaacagcagcagctggaggccgccagcgccgccgaggagtccccccctcccaagagaccccgcatcgcatacctgagcgaggtcaaggaggagagggacgatattcctgctcaagtcgctatggtcacagaagaggatggggcacctcaagtggcgctgatcacccaggatggagcgcagcaggtgagcctcagcccggaagacctgcaggcccttggcagcgcaatttccatggttacgcagcacggaagtaccacattaaccatcccatctcctgatgccgaccttgcaacgtcaggaacccacaccgtcacgatggtgtctgcggatggaacccagactcagcctgtgacaattatcacaagtggcgccgtggttgcagaggattccagcgtcgcaagtttacgacaccagcaagtggctcttttagcaaccgctaacgggacccacatcgccgtgcagctggaagagcagcaaacattggaggaggccattaacgtcgcgacagccgcaatgcagcagggcgctgtaactttagaaaccaccgtgtccgagtcaggctgctag

SEQ ID NO: 141607 - DNA, 1287 bp, Artificial Sequence
  Description of Artificial Sequence: Synthetic coding sequence
atggagtccctcggcctccatactgtgaccctgagcgacggaactacagcctacgtgcagcaggcggtgaagggcgaaaagctcctcgagggtcaggtgattcagctggaggacggaaccaccgcctatatccaccaagtgaccgttcagaaggaagcacttagcttcgaagacggtcagcccgtgcagctcgaggatggctccatggcttatatccaccgcactccaagggagggctatgacccatccactctggaggccgtccagctcgaggacggttcgactgcctacatccaccacccagttgctgttccttcagagtccacaatattagctgtgcagacggaagtggggcttgaggacttggccgctgaagacgacgaaggcttttcagccgatgcagtggtcgccctggaacaatacgcgagtaaagtgctacacgactcccagattccgagaaacggaaagggccaacaggttggtgatagagctttccggtgcggttataaagggtgtggccgactgtacacgacggcacaccatttgaaagtgcacgaaagggcgcataccggggatagaccataccggtgtgatttccccagctgcggtaaggcctttgccaccggatacgggcttaaatctcatgttaggacacacacaggggaaaagccctacaaatgtcctgaggagctttgctccaaagccttcaagacatccggtgacctacaaaaacacgtcagaactcacactggcgagaggccattccagtgcccatttgagggatgtgggcgttcctttacaaccagtaatattagaaaagtgcatgtgcggacccatactggggaaagaccctacacttgtcccgagcctcactgtggacgcgggttcaccagcgcaacaaattataaaaaccacgtgcgtatccacaccggggagaaaccttacgtgtgcactgtgcctggctgcggcaagaggtttaccgagtactcttcactgtacaagcatcacgttgtgcacacacattgcaagccttacacttgtagcacctgtggtaaaacatatagacaaacttcgactctcgcgatgcacaagcgaagtggtcactgtggtcacgcagccagagggtgcgatccgggggacaatagtgtaggcgagtggctgcttagccctcgagggctcggacctacgccctgctggagaaagtgccatctgcacggccacagttgtccccaaggcccgcgcctgtggttaactcacagaagatggccgcatcgctcacttggatag

SEQ ID NO: 141608 - DNA, 1635 bp, Artificial Sequence
  Description of Artificial Sequence: Synthetic coding sequence
atggagtccttaggattgcacaccgtaactctgtccgacggaactaccgcctacgtgcagcaagcagttaaaggggagaaactgttggaggggcaggtcattcaactagaggatggcacaaccgcctacatacaccaagtcacggtgcagaaagagggatatgaccccagtacactggaggctgtgcaactagaagacggctctaccgcctatattcatcatcctgtggcagtacctagcgagtctacaatcttagccgttcagactgaggtggggctggaagacctggctgccgaggacgacgaaggctttagcgccgatgctgttgtggctctcgagcagtacgcgtctaaggtgttacatgactctcagatacctcgcaacggcaaaggtcagcaggttggagatagagcattcaggtgtggatacaaaggttgtggtcgtctttatacaacggcccaccatctaaaggtgcacgagcgggctcatactggggacagaccttacagatgtgattttccctcttgcggtaaggcgttcgcaacggggtacggccttaaaagccatgtacgtacccataccggggagaaaccctataaatgtccagaggagctctgtagtaaggcttttaaaacatcaggggatctgcagaagcatgtccgcacacataccggagaacggccttttcagtgtccgtttgaggggtgtgggcgaagtttcaccacctcaaatatcagaaaggtgcacgtgagaacccataccggcgaaaggccctacacttgccctgagccccactgcgggagaggcttcacatcagcgactaactataagaatcatgtgcgtatccatacgggagaaaagccctacgtgtgcactgtcccaggatgtgggaagcgtttcacagagtattccagcctatataagcaccatgtagttcacacccactgcaaaccctatacttgcagtacctgcggtaaaacatatcggcagacctcaaccctagctatgcataagcgtagtgcccatggagaactggaagccaccgaagagtcggaacaggcactttacgagcaacaacagctggaggccgccagcgcggcagaggaatcacccccacctaaaagaccccgtatagcgtatcttagtgaggtgaaggaggagcgggacgacatacccgctcaggtcgccatggtgactgaggaggatggagccccccaagtggctttaatcacccaggacggtgctcagcaggtcagcttgagccccgaggatctccaggccctgggctccgctatttccatggtgacccaacacggatctacaactttaacgatcccctccccagatgctgatttggctactagcgggacacacaccgtgacaatggtgtctgcggacggcacccagacacaacctgtgactataatcacctctggtgctgttgtcgcggaagatagcagtgttgcaagtctccgacatcaacaggttgctctgcttgccacagccaatggcacccatatcgccgtgcagcttgaggaacagcagaccctggaggaggctattaacgttgctacggccgcgatgcagcagggcgcagtgacattggaaaccacggtaagtgagagcgggtgctag

SEQ ID NO: 141609 - DNA, 1209 bp, Artificial Sequence
  Description of Artificial Sequence: Synthetic coding sequence
atggaatctctcgggctccataccgttaccctgagcgacgggaccacagcatacgtgcagcaggccgttaagggagaaaagctgctggaggggcaagttattcagctggaagatggtaccacagcatatatccatcaggttaccgtgcaaaaggaggccctctccttcgaagacggccagcccgtgcagctggaggatggcagtatggcttatatccatcggacacctagggaaggatatgaccctagcacacttgaagcagtccagctggaagacggcagtacagcctacatccatcaccccgtcgcagtgccttctgagtctactattctcgctgttcagaccgaggtaggtctagaagatcttgccgcagaagatgacgaaggtttctctgctgacgcagtggtcgccttggaacagtatgcttccaaagtgctccacgactcccagatccccaggaatgggaaaggacagcaggtgggggatcgtgcgtttagatgcgggtacaaagggtgcggacggctgtatactaccgctcaccatctgaaagtacatgaacgcgctcacaccggggataggccataccggtgcgattttccttcctgtgggaaggcctttgccaccggctacgggctgaagagccacgtaagaacccacacaggggaaaagccctataaatgtccggaggaactctgttctaaggcattcaaaactagcggggatctgcagaaacacgtgcgcactcataccggcgagcggccctttcagtgcccattcgagggctgcggtaggtctttcacgacctccaacattcgaaaagtccacgtgcgaacacataccggtgaacgaccttatacttgccccgaaccccattgtggtagaggttttactagtgccaccaattacaagaaccatgtgcgtatacacactggagagaagccatatgtgtgcaccgtccctggatgtggtaagaggttcacagaatactcctccctctataagcatcatgtggttcacacccatcactgtgggcacgcagcaaggggctgcgaccctggcgataattcagttggcgaatggctcctctccccaaggggcttgggtccaactccatgctggcgaaagtgccacttacacgggcacagctgcccgcaaggcccacggctctggctgacacatcggcgatggcctcacaggtctcttggatag

SEQ ID NO: 141610 - DNA, 1023 bp, Artificial Sequence
  Description of Artificial Sequence: Synthetic coding sequence
atggagtccctcggtctgcacacagtcaccctcagtgatgggactactgcatacgtccaacaggctgtcaagggggagaaactcctggaaggccaagtgattcaactggaggacggaaccacggcctatatccatcaggtgacggtgcaaaaggaagctctgtctttcgaagacgggcaacctgtgcagctggaggatgggagcatggcttatatacataggacaccccgggaagggtacgacccttccactcttgaggcggtacaactggaggacggtagtactgcctacattcaccatccggtcgctgtgcccagcgagagcacaattctggccgtccagacggaagtcggcctggaggacctcgccgctgaggacgacgaggggttcagcgctgacgcagtggtggccctcgagcagtatgcatctaaggtactacatgacagccagatccctagaaacggtaagggacaacaggtgggcgaccgcgccttccggtgcggatacaaaggttgtggaaggctgtataccactgcgcaccatttgaaggtacatgaaagggcccataccggcgatcgcccttaccgctgtgacttccccagctgcggtaaagccttcgcgaccggatacggcttgaagagccacgtgcggacccataccggcgaaaagccttataagtgcccagaggagctgtgctcaaaggcatttaagacctcgggagaccttcagaagcatgttcggactcacacgggagagaggccttttcagtgtccctttgagggctgtgggcgatcctttaccacctccaacattagaaaggtgcacgttcggactcacacaggtgaacgcccttatacgtgtccagagccacactgcggtcgcggattcacaagtgccactaactacaaaaaccatgttcgcatccatactggggaaaagccctacgtgtgtaccgtgcccggctgcggaaagagatttaccgagtattcaagcctttacaagcatcacgtggtccatacctag

SEQ ID NO: 141611 - DNA, 1638 bp, Artificial Sequence
  Description of Artificial Sequence: Synthetic coding sequence
atggactgtgttatctttgaagaagtagccgtgaatttcacccccgaggagtgggccctgctggaccacgcacagagatctttgtatcgcgacgttatgctagagacttgtcggaacctcgcttcccttgattgctatatctacgtgagaacaagcggatccagttcccagcgagatgtgtttggaaacggtatcagcaacgacgaagagatcgttaagttcactggctctgatagttggagcatttttggggagaactggagatttgataacacgggagatcagcaccagattccacaaaggcacctccgcagtcaacttggccgactgtgcgagagcaacgaaggacaccagtgcggcgagacactgtcccagaccgccaacttgctggtgcacaagagctaccctaccgaggctaagccatccgagtgtacaaagtgcggtaaagcattcgagaatcggcaacgctcccacacaggccaacggccttgcaaagaatgtggacaagcgtgcagctgtttgtcctgccagagtccccccatgaagactcagaccgtggaaaaaccctgcaattgtcaggatagcaggacagccagcgtaacttacgtcaaaagcctttcttccaagaaatcgtacgagtgtcagaaatgcggcaaggcctttatttgtcccagttcattccgaggtcacgtcaattctcaccatggtcaaaagacccatgcctgcaaagtatgcggcaagacctttatgtactactcatacttaactcgacacgttcggacgcataccggcgaaaaaccatatgagtgcaaagagtgtggaaaagcctttagttgccctagttactttagagagcacgtgcgcactcatacaggcgaaaaaccatacgagtgcaaacattgcggcaagagcttcagctgctactccagcttccgcgaccacgttagaacccacacgggcgaaaaaccttgtcagtgtaagcattgtggtaaggccttcacctgctattcaagtttacgagagcatggccgtactcattccggcgaaaaaccctatgagtgcaaggagtgcggaaaggcttttcgctatccctcatccctacgcgcccacatgagaatgcacacgggcgaaaagccatacgtatgtaagcagtgcggaaaggccttcgggtgtccaacttacttccgaagacatgttaaaactcattccggtgtgaagccctaccagtgcaaggagtgcgggaaagcatactcattttctagtagcctgagaattcacgtgcgcactcatacaggagaaaaaccatttgaatgcaagcactgtggcaaggccttctcctgtcattcatctctgagagagcacgtgagaacccatagcggagagaaaccatacgagtgcaatcaatgtggcaaagccttctcccacgcccagtattttcagaagcacgtgagaagtcattccggggtgaaaccctacgagtgtaccgaatgtggcaaggcgtactcttgcagctccagtctgagggtgcatgtgcgtactcacactggagaacgtccatacgagtgcaagcagtgcggcaagacttttcggtatctggcctcgctgcaggctcatgtcagaacgcatgctggggcctag

SEQ ID NO: 141612 - DNA, 1308 bp, Artificial Sequence
  Description of Artificial Sequence: Synthetic coding sequence
agactctgcgaatctaacgaaggccatcagtgtggagaaaccctctcccaaacggcaaatctgttggtccataagtcctaccccacagaggcaaaaccaagtgaatgcacaaaatgcgggaagacgtttatgtactattcttacttgacaagacacgtccgtactcatacaggcgagaagccatacgagtgcaaagaatgtggaaaggcttttagctgtccgagctactttcgcgaacatgtgcggacgcacacgggcgaaaaaccttacgagtgcaaacactgcggaaagagtttcagctgttactcctccttcagagaccatgttaggacacataccggcgaaaagccttgccaatgtaaacactgcggcaaagcttttacatgttactcctcactaagagaacatggcagaacccattctggagaaaagccctatgagtgcaaggaatgtggaaaggcatttagatatccctcatcgctgagagctcacatgagaatgcacaccggggagaagccctatgtgtgcaagcaatgtggaaaggctttcggctgtccaacgtattttcgaagacacgtgaagacgcacagcggcgtcaaaccttatcaatgtaaagagtgtggtaaagcttactccttctctagttctcttcgcatccacgtgcggacccacacaggagagaagccattcgaatgcaaacattgtggaaaggctttttcttgccactccagtctgagagaacacgtgcgtacgcatagtggcgaaaagccctatgagtgcaaccaatgcggcaaggctttctctcatgcgcagtatttccagaagcacgtgcgttcccattccggcgtcaagccttatgaatgtacagaatgtggaaaggcttattcatgctccagcagtctccgggtgcacgtgaggactcataccggagagcggccctatgaatgcaagcagtgcggaaagacttttagctggccttctgacctgcgggtgcatatgcgaacacactctggagagaaacggtgcggttgcaagcagtgtggtaagtctttctctagtcctagcagcttcaagggccacattaggacccacacaggggaaaagttgtacacctgccgtgaatgcggaaaagtcttttcttccccttcctattttcgcactcaggtgcgcatccacattggcgaaaagccctacgtttgtgagcagcgggggaaggtgttttcatggtcatcatcttttcgagggcatctgagaacccatagccgggagaaaccatatgagtgcaaagagtgcaccaaagcgttctag

SEQ ID NO: 141613 - DNA, 1497 bp, Artificial Sequence
  Description of Artificial Sequence: Synthetic coding sequence
atgctggaagagggcgtgttgccctcccctggcccagctctgccccaggaggaaaacactggcgaggagggcatggccgcaggccttcttactgccggcccaaggggctctacttttttcagtagcgtgaccgtggcttttgctcaagagcggtggcgctgtctggtttctacacccagagaccgatttaaggaaggtatccccggcaaatcccgtagcttagtcttactcgggctgcccgtgagccagccaggcatgaactcccagctcgagcagagagagggagcgtggatgctcgagggtgaggatctgaggtcaccctctcctgggtggaagattatatccggctcaccacctgaacaggctctcagtgaggcatccttccaggacccgtgcgttgagatgccacctggtgattctgatcatggcacctcagacctggagaaatcattcaatctccgccctgtgcttagtcctcaacagagagtcccagttgaggccaggccgaggaagtgtgagacgcacactgaatcttttaaaaactcagagatccttaagcctcatagagctaagccctatgcctgtaatgagtgtggcaaggcattcagctattgtagttccctaagtcagcatcagaagtcgcataccggcgagaagccctacgaatgcagtgaatgcggaaaagctttttcacagtcatccagcctgatccagcaccaaagaatacacactggagaaaaaccctataaatgttccgagtgtggtagagccttctcccagaacgcaaaccttaccaagcatcagagaacccacactggtgaaaagccttaccgatgtagcgagtgtgagaaggcattcagtgactgctccgctttggtacagcaccaacggatccatactggtgagaagccttacgaatgttctgactgcggcaaagcctttagacactcagcaaaccttaccaaccaccagcgtactcatactggcgagaagccctacaagtgctcagaatgcggaaaggcctttagctattgcgctgcttttatccagcatcaacgcatacatactggggagaaaccatatcggtgcgcggcttgcggaaaggccttcagtcagtctgccaacctgactaaccaccagcgaacgcacactggagagaaaccatacaagtgttccgagtgcggaaaagctttttctcagagcaccaacctgatcattcaccaaaagacgcacactggggagaaaccatataagtgcaatgaatgcggaaaattttttagcgaatcctctgccctaattagacatcatattatccataccggcgagaaaccatacgaatgtaatgagtgtggtaaagcctttaaccagtcgtcaagtctgagtcagcatcagaggatacatacaggggtgaagccatacgagtgtagtgaatgcggcaaggcttttcgatgttcgagcgcctttgtgcggcaccagagactccacgctggagagtag

SEQ ID NO: 141614 - DNA, 1425 bp, Artificial Sequence
  Description of Artificial Sequence: Synthetic coding sequence
atggctgccggtctgctgaccgccggtccgcgcggaagcacctttttttcctcggtgacagtcgccttcgcccaggaaaggtggagatgtctggtcagcaccccccgtgatagatttaaggaggggattccaggcaagagccgatccctcgtcctcctgggattgccggtatctcagcctggcatgaattcccagctcgaacagcgggaaggagcttggatgttggagggcgaagacctgcgctccccatcgcctggatggaagatcatctctggcagcccacccgagcaggcgttgtctgaggccagttttcaggacccttgtgttgagatgccaccaggggactccgatcacggcacctcagacctggagaaaagcttcaacctgcggccggtattgtcaccccagcagagggtgcctgtggaagcacgccctcggaaatgtgagacgcataccgagtcattcaaaaatagtgagatcctcaaacctcacagagccaagccatatgcctgcaacgaatgcggaaaggctttctcttattgctccagcctgagccagcatcagaagtcccacaccggggagaagccgtacgagtgcagcgaatgcggcaaggccttcagccaaagctccagcctgatccagcaccagagaatccacaccggcgagaagccctacaaatgctctgagtgtggtcgggctttcagccaaaacgcaaacttgacaaagcaccagagaacccatacaggagaaaaaccatacaggtgctccgaatgtgaaaaggcattcagcgattgctctgccttggtacagcaccaaaggatccacactggggaaaagccttatgagtgttccgattgtggcaaagcctttagacattcagctaatctcaccaatcaccagaggacccacacaggggagaagccctataaatgcagtgaatgcggaaaagcattctcttactgcgccgcctttatccagcatcagcggatccatactggggagaagccttatcgttgtgccgcatgcggtaaggccttcagccaaagcgccaacctaacaaatcatcagaggacccatacaggagagaagccatataaatgttccgagtgcggaaaggccttcagccagagcaccaatctgattatccaccagaaaacccacacgggcgagaagccttacaaatgcaatgaatgcggtaagttcttttccgaatcctccgcacttatcaggcatcacatcatacacacgggtgaaaagccgtatgagtgcaacgagtgcggaaaagcctttaaccagagcagttctctgagccagcatcaacgcatacataccggcgtgaagccgtacgaatgttcagaatgtggcaaagcattccgctgtagctctgcgtttgtacgccaccagcggctgcacgccggagaatag

SEQ ID NO: 141615 - DNA, 1728 bp, Artificial Sequence
  Description of Artificial Sequence: Synthetic coding sequence
atggacccagaggatgaaggcgtcgctggggtgatgagcgtgggcccaccagccgccaggctgcaggagccagtgacattccgcgatgttgcggtggacttcacccaggaagagtggggacaactcgaccctacccagagaatcctctatcgcgacgtaatgctagagacttttggacacctactgtccataggccctgagctgccaaagcccgaagtcatcagccagctcgagcaaggtaccgaactctgggtggctgagagggggacgactcaaggctgccaccccgcttgggagcccaggtctgaatctcaggcctcccggaaagaggaaggtctcccggaagaagagcccagccacgttaccggccgggagggctttccaactgatgccccatacccaaccaccctggggaaggacagggagtgtcagtcccagtctttagctctgaaagagcagaataaccttaaacagcttgagtttggcctcaaggaagccccagtgcaggatcagggctacaagaccttgagattgagagagaattgcgttctcagttcctcaccaaatccgtttcctgaaatctcccgtggcgagtatctatacacatatgactcccagattactgactcagagcacaattcatccctcgtatctcagcagacgggatctcctggcaaacaaccaggcgaaaatagcgattgccaccgcgatagctcccaggctatccccattactgagctaacaaagtcccaggtgcaagataaaccttacaaatgcacagactgcgggaagagctttaaccacaacgcccacctgacagttcacaaacggatccacacaggagagagaccttatatgtgtaaagagtgcggaaaggccttttctcagaactcctctctggtccagcatgagcgtattcacactggggacaagccctataagtgtgccgaatgtggcaaaagtttctgtcacagcacacacctgacagtgcataggaggatccacacaggcgaaaagccttacgaatgtcaagattgtggccgggcctttaatcaaaatagctccctgggacgccataaaaggacccacacgggcgagaagccctacacgtgctccgtttgtggcaagagcttctcgagaaccacatgcctgtttctacatttaagaacccacacagaagagagaccctacgagtgcaatcactgcggaaagggcttcagacactccagctccctggcccagcaccagaggaagcatgccggcgagaagccattcgaatgcaggcagcggttaatattcgagcagacgccagccctcacgaaacatgagtggacggaggccctcggctgtgatcctcccttatcacaggatgagcggacccatcgctccgatagaccatttaagtgtaatcagtgcggaaagtgttttatacagtccagtcacctgatacggcaccagattacacacacgagggaagagcaaccccatgggagaagtcggcgccgtgaacaaagctccagccgtaattctcatttagtgcagcaccagcatcccaattctcgaaagagttctgccggcggggctaaggctggacaaccggagtcccgtgccctggctctcttcgacatacagaagattatgcaggaaaagaacccggtgcacgtgattggcgtggaggaaccgtccgtaggagcctccatgctgttcgatatacgggagtcaacctag

SEQ ID NO: 141616 - DNA, 519 bp, Artificial Sequence
  Description of Artificial Sequence: Synthetic coding sequence
atggatccagaagatgaaggagtcgccggcgttatgagtgtgggcccacccgcagcgcggctgcaagtcacgattaccactattaccactgccgccggatctggacaggcctctcccgcccagacggaccccttcacatctagacgcgacgaaagtggtactgctgttaatgcgctcgacacttggggcaattctgatgcaggacgcggggtagtcaccgtgttagctggccagaggggggggcgcgacagtaatcaggccccaggtcctaggatgcggatgctgcacgccgccctctcatcaccagccccacgcagtccatgtcccggggcctgggctcaacctctaggtggcaacgacgggtccccacggactgagtgcgatgagagcgaccatcagggcagaccactgcgcgattgcgggcggactgccgtccaggggggacaatgtctccagggtcacctggcaataagggctccgctttcgcgtcagagcggctgcggtctgtgtagcccatag

SEQ ID NO: 141617 - DNA, 873 bp, Artificial Sequence
  Description of Artificial Sequence: Synthetic coding sequence
atgtgcaaagagtgtggtaaggcctttagccagaattcttcactcgtgcagcacgaacggatccacactggcgacaaaccctataagtgtgccgagtgcggaaagtcattttgccacagcacgcacttgactgtgcataggaggatccacaccggcgagaagccatacgaatgtcaggattgtggcagagccttcaaccaaaactctagcttaggccgccacaagcgcacacacaccggtgaaaaaccatatacgtgcagtgtttgcggtaaatctttttctcgaaccacttgcctattcctgcatcttagaacccacaccgaggagcgcccatatgaatgtaaccattgtggcaaaggttttcgtcactcttctagtctagctcagcaccagcgcaaacacgccggggaaaagccgttcgaatgtaggcaacgcctgatctttgagcagacacccgcacttacgaagcacgagtggactgaggctctggggtgcgatcccccactttcccaagacgaaagaactcaccgatctgacagaccctttaaatgcaaccagtgtggaaaatgtttcatacaatcttcacacctgattcgccatcagatcactcacaccagggaggagcaaccacacggaaggagccgcaggcgtgaacaatctagttctcggaacagtcacctggtgcaacatcaacaccccaactccaggaagagcagcgccggaggcgccaaggccgggcaacctgaatcccgggctctggctctgttcgacatccaaaaaatcatgcaggagaagaacccggtccatgtcatcggagtggaggagccatccgtcggtgcctcaatgctgtttgacattagagaatctacttag

SEQ ID NO: 141618 - DNA, 822 bp, Artificial Sequence
  Description of Artificial Sequence: Synthetic coding sequence
atgtcccccaagcgcgatgggctgggcacaggagatgggctacattctcaggtgttgcaggagcaagtgagcacgggcgataatctacatgagtgtgacagccagggcccaagtaaagacactttagtgcgcgaggggaagacgtacaagtgcaaagaatgtggctcagttttcaataaaaattccctcttagtcaggcatcagcagattcatactggcgttaagccttacgagtgtcaggagtgtgggaaggcattccccgaaaaggtggactttgtgaggcccatgaggatccatacgggagagaaaccttgcaaatgcgtcgaatgtggaaaagtgtttaatcggcgatcccaccttctctgctaccggcagattcacaccggtgaaaaaccatatgaatgtagcgaatgcggaaagacattctcttatcattcagtgtttatacagcatcgcgtcacacataccggagagaagctgtttgggtgcaaagagtgcgggaagactttctactataactctagcctgactaggcacatgaagatacatacaggggagaaaccctgtaagtgtagcgagtgcgggaaaaccttcacctaccggagcgtgttttttcggcactccatgactcacactgctggcaaaccctatgaatgcaaggagtgcggaaaggggttctattactcttactcgctgacgagacacaccagaagccataccggagaaaaaccctacgagtgcctggaacatcgcaaggactttggctatcactctgcctttgctcagcaatctaagatacattctggagggaagaatctctag

SEQ ID NO: 141619 - DNA, 822 bp, Artificial Sequence
  Description of Artificial Sequence: Synthetic coding sequence
atgagcccgaaacgggatggcttagggacaggggatggcttgcattctcaagtgttgcaggagcaggtgtctacgggagataacctgcacgagtgtgactctcagggccccagcaaagacacactggttcgtgaaggaaagacctacaaatgtaaggagtgcgggagtgtgttcaataaaaattcccttctggtgaggcaccagcagattcatactggcgtgaagccttacgagtgccaggaatgcggcaaggcttttcctgaaaaagtagattttgtgcggcctatgcggattcacaccggagaaaagccctgcaaatgcgtagaatgtggcaaggtgtttaaccggagatcacatctactctgttaccgtcagatccataccggcgagaagccatacgagtgttccgagtgtgggaagaccttctcctaccactctgtgtttattcagcacagggtgacccacacgggggaaaagctctttggttgtaaggagtgtggcaaaacattttattacaattcttctctcacgagacacatgaagattcatactggtgaaaagccctgcaagtgttcagagtgcggtaaaaccttcacgtatcgctccgtgttctttcgtcacagcatgacgcacactgcaggaaaaccttatgagtgtaaagaatgtgggaaaggattttattacagctactctttgacaaggcacacaagatcacacacgggggaaaagccttacgagtgtctcgagcacaggaaggatttcggatatcacagcgctttcgcccagcaatccaagatacatagcggcgggaaaaatctgtag

SEQ ID NO: 141620 - DNA, 3630 bp, Artificial Sequence
  Description of Artificial Sequence: Synthetic coding sequence
atggagtgctattacatcgttatatcatccactcatctgtccaacgggcacttccggaacattaagggcgtgtttagagggcctctgtctaagaacgggaacaagacactggattacgccgagaaagagaatacaatagccaaagccttggaagatctgaaggctaatttctactgtgagctctgtgacaaacagtactataaacatcaggagttcgacaatcatatcaattcttacgatcatgcccacaagcaacggctcaaggaactcaagcagcgcgagttcgcccggaatgtggcctctaaatcgcggaaagacgagcgcaagcaggagaaggccctgcagcgcctccataagctagctgagctgaggaaagaaaccgtgtgcgccccaggctctgggccaatgtttaagagcacgaccgtaacagttagggagaactgtaacgagatctcgcagagagttgtcgtcgacagcgtgaataatcagcaagattttaagtacactctgatccactctgaggaaaatacaaaggatgcaacaacagtcgctgaggatcccgagtctgccaacaactacacagcgaaaaataatcaagtgggggatcaggcacagggtatccaccggcacaaaattggttttagttttgccttccccaagaaagccagtgtcaaactggaatcatccgcagccgcattcagtgagtatagtgatgatgctagcgtggggaaggggttttcacggaagtcccgcttcgtgcccagcgcttgccatctgcagcagtcgagccctacagatgtgttattatcttccgaggaaaagaccaattcttttcatccccccgaagccatgtgcagagataaggagacggtgcaaacccaggagattaaggaagtgtcttccgagaaggatgcgctgcttctaccatccttctgcaaatttcaactccagttgagcagcgacgctgataattgccaaaactctgtgccactggccgaccagattcctctcgaaagcgtggttattaatgaagatattccagtctctggaaactctttcgaactgctgggaaacaagtccaccgtgctcgacatgagcaatgattgtatctcggttcaggccacaaccgaggaaaacgtcaagcataacgaggcctctaccaccgaggtggaaaacaaaaacggccccgaaactctggccccctctaataccgaagaagtgaacatcaccattcataaaaagaccaacttctgcaagagacaatgtgagcctttcgtgccagttttgaacaaacaccgatccactgttctccaatggccaagcgaaatgcttgtgtatactacaactaagccctccatttcttactcgtgtaatccactctgctttgattttaagtccacaaaggtcaataacaatcttgataaaaataagccagacttgaaggacctgtgttcccagcagaagcaggaagatatctgcatgggccccctgtcggactacaaagatgtgagtaccgaaggcctaactgactatgagatagggtcttctaagaacaagtgctcccaggtgactcctctcctagccgacgacatcctttcctctagttgtgacagcggtaaaaacgagaacactggtcaaaggtataaaaacatctcatgcaagataagagaaacagagaagtataactttactaagtctcagatcaaacaagacactctggatgagaagtataacaagattaggctcaaggagacccatgaatactggtttcacaagtcaagacgcaagaagaaaaggaagaaactgtgccagcaccaccatatggagaagacgaaggagtccgaaacccgctgcaagatggaggcagagaacagttatacggaaaatgccgggaaatatctgttggagcccatctcagagaagcagtatctggccgccgaacagctgttggattcacaccagctgctggataaaaggcccaaaagcgaaagtatttctctgagcgataacgaggaaatgtgtaaaacttggaatactgagtataacacttacgacacaattagctcaaagaaccactgtaaaaagaacaccatcctgttaaatggccagtcaaacgcaacgatgatccatagtgggaaacataatttaacttactcccggacttactgttgctggaaaactaagatgagctcatgctcccaagaccacaggtcactcgtgttgcaaaatgatatgaagcacatgtctcaaaatcaggccgtgaagcgcggatataacagtgttatgaacgaatcagagcggttttatcgtaagcggcgccaacattcgcattcttacagctccgacgagtcccttaacagacagaatcacttgccagaagaatttctacgccctccctctacttctgtcgctccgtgtaagcctaaaaagaagagacggagaaaaagagggcgtttccacccgggctttgagacattggaactcaaagagaacactgactacccagtgaaggacaactcatccctgaaccccttagatcgcctcatttccgaggataagaaagagaagatgaagccacaggaagttgcaaagatagaaagaaatagcgagcagacgaatcagttgcgcaacaaactttccttccatccaaataacctgctgccttccgaaactaatggcgaaacagaacacctggagatggagacgacatccggggaacttagtgacgtgagcaatgacccaacgacttccgtgtgtgtggcatccgctcccacgaaagaagccatagacaacactctcctggagcacaaggagaggagtgaaaacatcaatctgaatgaaaagcagatccccttccaggtgccaaatatagagaggaacttccggcagtctcagccaaagtcatatctgtgtcactacgaactggcagaggcccttccccaggggaagatgaacgagactcctacagagtggcttcgttacaatagtggtatcctgaatacgcagcctcccctgcccttcaaagaggctcatgtgagtgggcatacctttgtgactgcggagcagattcttgctcccctggctctgcccgagcaggccctgctgatcccactggaaaaccatgataaatttaaaaacgtcccatgcgaggtgtaccagcacattctgcagcctaatatgttggctaacaaggttaaatttacgtttcccccagccgccctgccgccgccttccacgccattacaaccactccctctgcagcagtctctgtgtagtacctctgtaactacgatccaccacactgtgctgcaacaacacgctgccgctgcagctgctgcagcggccgccgcagcagccggcaccttcaaggttctgcagcctcaccagcaattcctgtctcaaattcctgccttaacccgaactagtctgcctcagctcagcgtgggtccagtgggcccgagactctgtccagggaaccagcccacatttgttgcacctccacagatgccgatcattccagccagcgtccttcaccctagccatctagctttcccatcattaccacatgctctcttcccatccttgctgtcacctcatccaactgttattccattgcaaccccttttttag

SEQ ID NO: 141621 - DNA, 210 bp, Artificial Sequence
  Description of Artificial Sequence: Synthetic coding sequence
atgccagctaatgaggacgctccccaacccggcgagcatggcagcgcctgcgaagtttcagtttcattcgaggacgtaacagtcgattttagccgagaagagtggcagcagctggattctacacagcgaaggctataccaggacgttatgctcgaaaactacagccatctgctatctgtcggcaaggacaaccaccccgtgaaactgtag

SEQ ID NO: 141622 - DNA, 1986 bp, Artificial Sequence
  Description of Artificial Sequence: Synthetic coding sequence
atgcccgctaatgaggacgcgccacagcccggggaacatgggtctgcatgtgaggtgtctgtgagtttcgaggacgtgaccgtggactttagtagggaagaatggcagcagttggactctactcagcggcggttgtaccaagatgtgatgctcgagaactattcccacctcctttctgtcggctttgaagtacccaagccagaagtcatatttaagctggaacaaggagagggaccctggaccctcgagggcgaggccccccatcagagttgctctgacggaaaatttgggatcaagccttcccagcgtcgcatctctggaaagagcactttccactctgagatggagggtgaggacacaagagacgatagcctgtactcgattctggaggagctttggcaggatgcagagcagataaagagatgtcaggaaaagcacaacaagctcctgtcccgcaccaccttcctcaataaaaagattttgaatacagagtgggactatgaatacaaagacttcggcaaatttgtccacccatctcccaaccttatcctgtcccagaagagaccccacaaacgggatagttttggaaaaagctttaaacataatcttgacctgcacatccataacaaaagcaacgccgccaagaatctggacaaaacaattgggcatgggcaggtgttcacacaaaattcaagttacagccaccatgagaacacccacacgggggttaagttttgcgagcgcaaccagtgtggcaaggtgctgtctctcaaacacagcctgagccaaaatgttaaatttcccatcggggagaaagccaacacctgcacagaatttgggaaaatctttacacagcgctcccacttcttcgcgccccagaaaatccatactgtggaaaagccccacgaactctccaaatgtgttaacgtgttcacccagaaacctctattgagtatctacctgcgcgtccacagggacgagaaactatacatatgcacaaagtgtgggaaagctttcattcagaatagcgagctcattatgcatgaaaagacgcacactagagagaagccatataagtgtaacgagtgcggaaaatcattttttcaggtgtcctccctcctgcggcaccagactacccacaccggtgaaaaactgttcgagtgctcggaatgcggcaagggcttttctcttaacagtgccctgaacattcaccagaagattcacactggggagagacaccataaatgctcagaatgcgggaaggcgttcacgcagaagagtacactccgcatgcaccaaaggatccatacaggggaacggtcgtacatctgcacacagtgcggccaggccttcatccaaaaggcacatctgatcgcccatcagcgtatccacaccggagagaaaccctacgagtgttctgattgtgggaaatccttcccaagcaagagccagctgcaaatgcataaacggatacacactggagaaaaaccttatatctgcacagagtgcggcaaagcattcacaaaccggagcaatctcaacacccaccaaaagagccacaccggagagaagagctacatttgtgccgaatgtggcaaggcctttaccgatcgaagtaactttaacaagcaccaaactatacataccggagagaaaccatatgtttgcgctgattgtggtcgcgccttcatacagaagagcgagctgatcacccatcagcgcattcataccactgagaagccttacaaatgtccagattgcgagaagtccttctccaaaaagcctcatctcaaggtacatcagcgaatacacaccggagaaaagccctacatctgcgctgaatgcgggaaggcgttcacagatcgctccaacttcaacaaacaccagacaatacatacaggtgacaagccctacaaatgctctgattgtggcaaaggcttcacccaaaagtcagtgctttccatgcaccggaacatccacacctag

SEQ ID NO: 141623 - DNA, 312 bp, Artificial Sequence
  Description of Artificial Sequence: Synthetic coding sequence
atgccagccaatgaagacgcccctcaacccggggagcatggctccgcgtgcgaagtctcagtgtcttttgaggacgttaccgttgacttctcacgcgaggagtggcagcagttggattccacacaacgacggctctaccaggatgttatgctggaaaattactcccacctcttgtctgtcggattcgaagtccctaagcccgaagtgatattcaagctggagcaaggcgaaggaccgtggaccttagagggtgaagcaccccaccagagttgctccggaatctcaacctatttcgtgactagcactgtgtag

SEQ ID NO: 141624 - DNA, 1986 bp, Artificial Sequence
  Description of Artificial Sequence: Synthetic coding sequence
atgcccgcaaacgaagacgccccccagcccggggagcacggctctgcgtgtgaagttagcgtgtcttttgaggacgtgactgtagacttttcgagggaagagtggcagcagcttgactccacacagcgccggctgtatcaagatgtcatgctcgagaattatagtcacctcctctctgtgggattcgaggtccctaagcctgaggtgatcttcaagctagagcagggcgaaggtccatggactctagagggagaggcaccacatcaaagctgcagtgacggtaagttcgggattaaacccagccaacggaggatctcaggcaaaagtacgtttcatagcgaaatggaaggagaggatacccgggacgactcactttacagtattcttgaagagctctggcaggatgccgagcagattaaacgatgccaggaaaagcacaacaagctgttgagccggactaccttcctgaataaaaaaattctgaataccgagtgggactacgagtacaaggactttggtaagttcgtccacccctcccctaacctgattctgagccagaagaggccacacaagcgcgatagctttggaaagagcttcaagcacaatcttgacctgcacatccacaataaatccaatgcagctaaaaacttagataaaacaataggtcatgggcaagtgtttacccagaactccagttactctcaccacgagaatactcacacaggggtgaagttctgcgagcggaatcagtgcggcaaagtgttgtccctcaagcattcgttatctcagaatgtgaagtttcccatcggtgaaaaagctaatacttgcactgagtttgggaagatattcacccaacgatcacacttcttcgcgcctcagaagatccatactgttgagaaacctcacgagttatcaaagtgcgttaacgtcttcactcagaaacctctgctatccatttacctacgggtccacagagacgagaagctgtatatatgtaccaagtgcggcaaggcctttatccaaaactctgaactgataatgcatgagaaaacccacactagagaaaaaccatacaagtgcaacgagtgcggaaaatcttttttccaggtgtcatcactgttacgccatcaaactacccacacaggggaaaagctttttgaatgcagtgagtgcggtaaagggttttctcttaattcggcactcaatattcaccagaaaatccacaccggcgaaaggcaccataaatgttctgagtgtggcaaggcctttacacagaaaagcactctacgaatgcatcagcggatacacaccggcgagcgatcatacatttgtacacaatgcggtcaagcattcattcagaaggcacacctgattgctcaccaacggattcacactggtgaaaagccgtacgagtgttccgattgtggcaaaagtttcccctcgaagtctcaattgcagatgcacaagcgcatacataccggcgagaagccctacatctgtactgaatgcgggaaggccttcacaaatagatcgaatcttaacacccaccagaaatcgcacacgggcgagaagtcttacatctgtgctgagtgcggcaaggcctttacagatagatctaactttaacaaacatcagacaattcacacaggagagaaaccttatgtatgcgcagattgtggaagagcctttattcagaagtctgagttaatcacccatcagcgaattcacactacagagaagccgtataaatgccctgactgcgagaagagtttcagcaaaaagcctcaccttaaagtgcatcaacggatccacactggagaaaaaccctacatttgcgccgagtgcgggaaggccttcactgaccggtccaactttaacaagcaccaaacaattcatactggcgacaagccatataaatgtagcgactgtggtaaagggttcacccaaaaaagtgtgctgtctatgcataggaatattcacacctag

SEQ ID NO: 141625 - DNA, 369 bp, Artificial Sequence
  Description of Artificial Sequence: Synthetic coding sequence
atgcctgctaatgaagatgcacctcagccaggagaacatggaagcgcttgcgaggtctccgtttcattcgaggacgtgacggtggattttagtcgggaagagtggcagcagctggattctactcagcgcagactctaccaagatgtcatgttggaaaactattcgcacctcttatctgtgggctttgaggtgcccaaaccagaggtgatcttcaagcttgagcagggtgagggcccatggactctcgagggcgaggcaccgcaccagagttgttccgacggaaagtttggaatcaaaccatctcaacgcagaattagcggtaagagcacatttcacagcgagatggaaggggaagataccctgtgttag

SEQ ID NO: 141626 - DNA, 1551 bp, Artificial Sequence
  Description of Artificial Sequence: Synthetic coding sequence
atgcacggccgaaaggatgacgcccagaaacagcccgtaaaaaatcagctcggactgaacccccagtcacatttgccagaactccagctgtttcaagccgagggcaaaatttacaagtatgaccacatggagaagtccgttaatagcagctcacttgtctcacctccacagagaatctctagcactgttaaaacccacatctcccatacctacgagtgcaacttcgtcgattcactgtttacccagaaagaaaaggccaatattggtacagagcactacaagtgttccgagcgcggcaaagcatttcaccagggcctgcatttcaccattcaccagataatccacaccaaggagacgcagttcaagtgtgatatctgtgggaagatcttcaacaaaaagagtaatctggccagtcaccaaaggattcatactggcgagaagccttataagtgtaacgagtgtggaaaagtgttccataacatgtcccacctggcacagcaccgtcgaatccatacaggagagaaaccgtataagtgcaacgaatgtggaaaggtgtttaaccagatctctcatttagctcagcatcaacgcatccacacaggagaaaaaccgtataagtgtaacgaatgcggcaaagtgtttcaccagatttcacatcttgctcagcacagaacgatccatactggcgaaaagccatatgaatgcaataaatgtgggaaggtgttttctcgcaattcatacctggtccagcatcttatcatacataccggggaaaagccatatagatgtaatgtgtgcggaaaggtctttcaccacatatctcaccttgcacagcaccaaaggatacatacaggcgaaaagccgtacaagtgtaacgaatgcgggaaggtgtttagtcacaagtccagtctcgtaaatcactggcggattcataccggtgaaaagccttacaagtgtaatgagtgtggtaaggtttttagtcataagtctagcctggtgaatcactggagaatacataccggggagaagccgtataaatgtaatgagtgcggaaaggtgttttctaggaactcatatctggctcagcacctcattattcatgcaggcgaaaagccctacaagtgcgacgagtgcgataaggccttcagccaaaattcacacctggttcagcaccatagaattcacacaggggaaaaaccctataagtgtgatgagtgcggaaaagtgttctctcagaactcttacctcgcataccattggcggatccacacaggagagaaggcatacaaatgtaatgagtgcggaaaagtttttggcctgaattcgtctttagcgcatcatcgaaagattcacacaggcgaaaagcctttcaagtgcaatgagtgtggcaaagccttctcaatgcgtagttccctaaccaaccatcacgcaatccacactggggagaagcacttcaagtgcaacgaatgcggcaagttgttcagggataacagttacttggtccgacaccagcggttccacgccggcaaaaagtccaacacctgcaactag

SEQ ID NO: 141627 - DNA, 1467 bp, Artificial Sequence
  Description of Artificial Sequence: Synthetic coding sequence
atgcacggccgcaaagatgatgcgcaaaagcagcccgtcaaaaatcagctggggctgaatccgcagtcgcacttgccagaattgcaacttttccaggccgaaggtaagatctataaatacgaccacatggagaagtcagtcaactcaagtagcctggtcagccctccacagagaatttctagcacagtgaagacccacatctctcatacttatgagtgcaattttgttgattcgctctttacccagaaggaaaaggctaacattggcacagaacactataagtgtagtgagcgcggaaaagcatttcatcagggacttcacttcaccattcatcagatcatccatactaaggaaacccagttcaagtgcgatatctgtggcaaaattttcaacaagaagagcaaccttgcttcccatcagcgcatccacactggcgagaagccttataagtgcaacgagtgtggaaaggtcttccataatatgtcccacctcgctcagcacaggcgtatccatacaggggaaaagccatataagtgtaatgaatgtggaaaggtgttcaaccagattagccacctggctcaacaccagagaatccacaccggagagaagccctacaagtgcaacgagtgtggcaaagttttccatcagatcagccatcttgcccagcatcggacgatccacaccggcgaaaaaccatacgaatgcaataagtgtggtaaagttttctctcgaaattcatatttagtccagcatctcattatccatactggcgagaagccttatcggtgcaacgtatgtggcaaggtattctctcataagtccagtctggtgaatcactggcgcatacacaccggcgaaaaaccctacaagtgcaacgagtgcgggaaggtgttcagccacaagagctcgctggtgaatcactggcgtatccatacaggcgagaagccctacaaatgtaatgagtgtgggaaagtgttctcaagaaacagctatttagcccagcacttgatcattcatgctggggaaaaaccctataaatgcgacgagtgtgacaaggctttctcgcaaaactcccatctggtccagcatcataggatacacacgggcgaaaaaccatacaagtgcgacgaatgtggaaaggttttttcacagaatagctatctcgcttaccattggaggattcatactggcgagaaagcgtataaatgcaacgagtgtggcaaagttttcggcttaaattctagcctggcacatcatcggaagattcacacaggggaaaaacctttcaaatgcaatgagtgcgggaaggcattcagtatgagaagcagcctcaccaaccaccatgccatccacactggcgagaagcactttaaatgtaacgagtgcggaaaactatttcgggacaattcttacctagtgcggcatcagcgattccacgctgggaaaaaaagtaacacatgcaattag

SEQ ID NO: 141628 - DNA, 1467 bp, Artificial Sequence
  Description of Artificial Sequence: Synthetic coding sequence
atgcacggaagaaaggacgacgcccagaagcagcctgtgaagaaccagctgggactgaacccccagagccacttgcctgaacttcagctgttccaggctgagggtaaaatctataagtacgaccatatggaaaagagcgtgaactctagttcccttgttagtcccccccagcgaattagcagcaccgtaaagacccacatcagtcatacctacgaatgtaacttcgtggacagcttgtttacacagaaagaaaaggcgaacattgggaccgagcattataagtgctctgaaagaggcaaggcgttccatcaaggactgcactttaccatccaccaaatcatccacactaaggagactcaatttaaatgtgatatctgcggtaaaatttttaacaagaaaagtaatctggcatctcatcagcgaattcacactggtgagaagccttataagtgtaatgagtgcgggaaagtcttccacaacatgtctcaccttgcccagcacaggcgcatccacaccggcgaaaagccttataagtgtaacgagtgtggtaaggtgttcaatcagattagtcacttggctcaacatcagcggatccatacaggggagaagccctataagtgtaacgaatgtggtaaagtgttccatcagatcagccaccttgcacagcacaggacaatccacaccggggaaaaaccttatgagtgcaataaatgcggaaaggtgttcagcaggaacagttacttagtgcagcatcttatcatccatactggagaaaagccttacaggtgcaacgtgtgtggcaaggtcttctcgcataagagcagccttgtgaaccattggcggattcataccggtgaaaagccttacaaatgtaacgagtgtggcaaggtcttcagtcacaagtctagcttggtcaaccactggagaattcacacgggcgagaaaccatataaatgtaatgagtgtggtaaagtattctcccgaaattcctacctggctcagcatctcattatccatgccggggagaaaccttataagtgcgacgagtgtgataaagcgttctcacagaattcgcacctcgtacagcaccatcgcattcatactggagagaaaccttacaaatgcgatgagtgcggaaaagtgttttcccagaattcctacttggcataccattggcggatccacactggcgaaaaggcctacaagtgcaatgaatgtggcaaggtgttcggcctcaatagtagcctggcacaccaccgaaagatccacacaggcgagaagcctttcaagtgcaacgaatgtggcaaggccttctctatgcgatcttctctgacaaatcaccatgccatccatacaggcgaaaaacacttcaagtgcaacgaatgcggcaaactattcagggacaactcttatctggtgcgacatcagcgtttccacgctgggaaaaagtcgaatacctgtaattag

SEQ ID NO: 141629 - DNA, 1551 bp, Artificial Sequence
  Description of Artificial Sequence: Synthetic coding sequence
atgcacggccggaaagacgacgcccagaagcagcccgtcaaaaaccagctggggctgaaccctcaatcgcatcttccggagctgcaactctttcaagcagagggcaaaatctacaagtacgaccacatggagaaatccgtgaattccagctctctggtgtcccctcctcagagaatcagtagcaccgtgaaaacccacattagccacacttatgaatgcaacttcgtcgatagcttatttactcagaaggagaaggccaacattggcaccgagcactacaagtgtagcgaacgaggaaaggcgtttcatcagggtctgcatttcactattcatcagatcatacacaccaaggagacacagtttaagtgtgacatttgtggaaaaatattcaataagaaatcgaacctggcctcgcaccagaggattcacacaggtgagaagccctataagtgcaatgaatgcgggaaagtttttcacaacatgtcacacttggcacaacatcgacgtatccatacgggagaaaagccttataaatgcaatgaatgcggcaaagtcttcaaccagatttcacacctggcacagcatcagcgaatccacactggcgaaaaaccctacaaatgcaacgagtgtgggaaggtgttccatcagatatcccatctggctcaacatcggaccatccacaccggtgagaaaccctacgagtgcaataagtgtggtaaagtcttttcacggaatagctacctggtgcaacatctgattattcacacgggagagaagccgtataggtgcaatgtatgtggtaaagtgttccaccacatttcgcatttggcccagcatcagcggatccatacgggggagaagccatacaaatgcaatgagtgcgggaaggtattttctcacaaaagctcgcttgtgaatcactggcgcattcacacaggcgagaaaccctacaagtgtaacgagtgcggcaaggtcttttcacacaaatcctcactcgtgaatcattggcggatacacacaggtgagaaaccctacaaatgtaatgagtgcgggaaggttttctcacggaacagctatctggctcagcacctcatcatacatgcaggcgaaaaaccctacaaatgcgacgagtgcgataaggcattcagccaaaattcccatctggtccagcaccatagaatacacacgggcgaaaaaccctacaagtgtgacgagtgtggtaaggtgttctcccaaaatagctacttggcatatcactggaggattcacacgggggaaaaggcttacaaatgcaatgaatgtggcaaagtgttcggattaaacagcagtctcgcccaccaccgcaaaatccacacgggggagaaaccattcaaatgtaacgaatgtgggaaagctttttctatgcgctcatccctgactaaccaccacgcaatacatactggggaaaaacactttaagtgcaacgaatgtggcaaactctttcgagataactcttatctggtcaggcatcagaggtttcacgcaggaaagaagtcgaacacctgcaattag

SEQ ID NO: 141630 - DNA, 1551 bp, Artificial Sequence
  Description of Artificial Sequence: Synthetic coding sequence
atgcacggaagaaaggacgacgcacagaagcagcctgtcaagaatcagctgggactcaatccacagagtcatttgcctgagctgcagctgtttcaggcagagggaaagatttacaaatacgaccatatggaaaaaagtgtcaattctagtagcctggtatcaccaccacagaggattagttccaccgtgaagacccacatatcccacacttacgagtgtaatttcgttgactctctttttacgcagaaggagaaggctaatattggtacggaacactataagtgttcagaacggggcaaggccttccatcaaggacttcacttcacaatacaccagattattcacaccaaggaaactcaattcaaatgcgacatctgcggtaaaatttttaacaagaagagcaatcttgctagccaccaacgaatccacactggagagaagccctataagtgtaacgaatgcggtaaggtgtttcataacatgtctcacttagcacagcacaggcgcatccacacaggggaaaagccatacaaatgcaatgaatgcgggaaagtgttcaaccagatctcacacctggcccagcatcaaaggattcatactggagagaagccttacaagtgcaacgaatgtgggaaggtgtttcaccagatctcacaccttgcccagcataggactattcataccggggaaaagccgtacgagtgtaataagtgtggaaaggtgttctcacgcaatagctatttagtccagcatctgatcatccataccggggaaaaaccctatcggtgcaacgtctgcgggaaggtgttccaccatatcagtcacctggcccagcatcagagaatccacaccggggagaaaccttataagtgtaatgaatgtggcaaagtttttagccacaagagctctttggtgaatcattggcgaatacataccggcgaaaagccttataaatgtaatgagtgtggcaaggtattcagccacaaaagttccctggtcaaccactggcgcatccatactggcgagaagccctacaaatgcaacgaatgtgggaaggtattcagcagaaacagttatctggcccagcacctcattatccatgcaggagagaagccttacaagtgcgatgaatgcgataaagctttctcccagaattctcacctagtgcagcaccacaggattcatacgggtgagaaaccctataaatgcgacgagtgtgggaaggttttttctcagaatagctatctggcataccattggcgtattcatacgggcgagaaggcctataagtgcaatgagtgtgggaaggtgttcggactgaacagtagcctcgctcaccacaggaaaatacatacaggtgagaagcccttcaaatgcaacgaatgcggcaaggctttctccatgaggagttcactaaccaaccatcatgctatacataccggagagaagcacttcaaatgtaacgagtgcggcaaacttttccgcgacaattcttacctggtgagacaccagaggtttcacgcaggcaagaaatcgaacacttgcaattag

SEQ ID NO: 141631 - DNA, 1551 bp, Artificial Sequence
  Description of Artificial Sequence: Synthetic coding sequence
atgcatgggcgcaaggacgacgctcagaaacaaccagtgaagaaccagctggggctgaaccctcagtctcatctccccgaacttcagctctttcaggcagaaggcaaaatctacaaatacgaccatatggaaaagtctgtgaacagttcttctctggtaagcccgccccagagaatcagttccactgtgaagacacatattagccatacttatgagtgcaacttcgttgacagcctgtttacccagaaggagaaagctaatatcggcacagagcactataagtgttccgagcgaggcaaggcatttcaccaggggttgcattttacaatacatcagatcatccacaccaaagagacccagtttaagtgtgatatttgcgggaaaatatttaataagaaaagtaatctcgctagtcaccagcgtatccatacaggggagaagccctataagtgcaacgaatgtggaaaagtgttccacaatatgtcccatctagctcaacacagacgaatccacacgggcgaaaaaccttataaatgcaacgagtgcggtaaggtgttcaaccagattagtcacttagctcagcatcaaaggatccacactggggagaagccctataaatgcaacgaatgcgggaaggtattccaccagatttcacatctagctcaacatagaacgatccacacaggggaaaagccctatgaatgcaataaatgcggaaaggtgttctcgcggaattcttacctggtgcagcacctcatcatacatactggagaaaaaccttatcgctgtaatgtctgcggtaaggtgttccatcatatttctcatctcgcacagcaccagcgtatacatactggcgaaaagccttacaagtgcaacgaatgtggcaaagtcttttcccacaagtcgtccctcgtcaaccactggagaatacacactggagaaaaaccttacaagtgcaatgaatgcggcaaagttttcagccacaagtccagcctggtgaatcactggcggattcacaccggtgagaagccctataaatgtaatgaatgtgggaaggttttctctcgcaacagttacctggctcagcacctaattatccacgctggtgagaagccttacaagtgcgatgagtgtgacaaagctttttcacagaatagtcacctggtacagcaccaccggatccacaccggtgagaagccctataagtgcgatgagtgcgggaaagttttctcccagaacagttatctcgcttatcattggagaattcacactggagaaaaagcttataaatgcaatgaatgcggcaaggttttcggtctcaacagttctctggctcaccaccggaaaatccatacaggagagaaacctttcaagtgcaatgagtgcggcaaggccttttctatgcgatcttcacttacgaaccaccacgctatccacactggtgaaaaacatttcaagtgcaatgagtgcggcaaactcttcagagataattcctacctagtgcggcatcagaggtttcatgctggtaaaaaaagcaacacatgtaattag

SEQ ID NO: 141632 - DNA, 1551 bp, Artificial Sequence
  Description of Artificial Sequence: Synthetic coding sequence
atgcacgggagaaaagatgacgcccagaaacaaccagtaaagaatcagctcggcctcaacccacagtcccacctgcctgaactccaattatttcaggctgaaggcaagatttacaaatacgatcatatggaaaagtcagtgaattccagcagtctggtgtccccgcctcagcggatctcctctacagtcaaaacccatatcagccacacctacgagtgtaatttcgtcgattcgctcttcacacaaaaagagaaggctaatatcgggacagagcactataagtgcagcgaaagagggaaggcctttcaccagggtcttcacttcacaatacaccagatcatccacactaaagaaacacagttcaaatgcgatatctgcggcaaaattttcaataaaaagagcaacctcgcttctcaccagcgcatccacacaggggaaaaaccatacaagtgcaacgaatgcggaaaggtctttcacaatatgagccatcttgctcagcacaggagaatccacaccggagagaagccatataaatgcaatgagtgtgggaaagtcttcaatcagattagtcatctagcacagcaccagagaattcacacaggggagaagccctacaaatgcaatgagtgcggaaaggtcttccatcaaatctctcacttagcccagcataggaccatacacaccggggaaaaaccatatgagtgtaataaatgcgggaaggttttttcaaggaatagctacctggtacagcatctgatcatccacaccggtgagaagccatataggtgcaatgtgtgcggcaaggtatttcatcacatttctcacctggctcagcatcaaaggattcatacaggcgagaaaccgtacaaatgtaatgaatgcgggaaggtgttcagtcacaagagtagccttgtaaaccactggcggattcatacaggtgaaaagccctacaagtgcaatgaatgtgggaaggtgttttctcataagtcttctctggtcaatcactggcgaattcacaccggcgagaagccttacaagtgtaatgaatgcggtaaagtgtttagtagaaactcatatctggcacagcacttgattatccacgcaggcgaaaagccttataaatgcgacgagtgcgataaggccttcagtcaaaattcacacctggtccaacatcacaggatacatactggcgagaaaccttataagtgcgacgagtgtggcaaggtgttttctcagaactcatatttggcctaccactggcgaattcatacgggcgagaaggcatacaagtgcaatgaatgtggaaaggtgtttgggctgaactcctctttggcacatcatcggaaaatccacacaggggaaaaaccatttaagtgtaatgaatgtggaaaggcattctccatgcggagttctttaactaaccatcacgccatccacacgggagagaagcactttaaatgcaacgaatgcggcaaactatttcgcgataactcttatctggttagacaccaaaggtttcatgccggcaagaaatctaatacatgcaattag

SEQ ID NO: 141633 - DNA, 5034 bp, Artificial Sequence
  Description of Artificial Sequence: Synthetic coding sequence
atggaggttcccgagccgacatgtcccgccccaccagctcgggatcagcctgctcccaccccaggcccaccaggtgctcccggggggcaggcctccccccacctgactctggggccagttttgctgccaccggaacagggcctcgcccctcccactgttttcttaaaggccttgccaatcccactctatcacacagttccaccaggcgggcttcagccacgtgctcccctggtaacaggctctctggacggagggaacgtgcctttcatcttatctcccgtgctgcagcctgagggccctggaccaacccaggtggggaagcctgccgcacccacgctgaccgtcaacattgtcgggacactgcctgtgttgtctccaggcttaggacctactttgggaagccccggtaaagtacggaacgcggggaaatacctgtgtccacattgcggccgggattgcctgaagccgagtgttctggaaaagcacataagaagccacactggcgagagaccattcccctgcgctacgtgcggtatcgcttttaaaacacaatctaacctgtataagcatcggcggacccagactcacctgaataactctcgtctgagctctgagtcggagggggccggcgggggcctattggaggagggagataaggcaggcgagcccccacggcctgaaggccgaggagagtccaggtgtcagggcatgcatgagggagccagtgagaggccgttgtcccccggagcacatgtcccacttctcgctaagaacctggacgttcgcaccgaagctgcgccatgccctgggagcgcattcgctgaccgggaagccccgtgggatagtgcgccaatggcatcgcccggccttcctgccgcgagcacccaaccatggagaaaactgcctgagcagaagtcccccactgccggcaagccttgtgccctgcagaggcaacaagctaccgccgccgagaagccatgggacgccaaagcacctgagggaaggctacgcaagtgcgaatcaaccgactccggctatttgagtcggtccgatagtgctgaacagccgcatgcaccctgttcaccactgcacagtctgtcggagcacagcgccgagtcagagggagagggaggcccgggcccaggtcccggtgtagctggcgccgagccaggggccagggaggctggactcgaactggaaaagaaacgtctcgaggaaagaattgcgcagttaatctcccacaaccaggcagtggtcgacgatgcacaacttgataatgtgagacctcggaaaacaggcctctccaaacaaggatctatcgatctgcccaccccctacacctacaaggacagctttcacttcgacataagagctttggagcctggccgcagacgcgcccccgggcctgttcggtccacatggaccccaccagacaaatctcggcctctgtttttccacagtgtgcctactcagctgtccaccactgtggaatgcgttcccgtcacgcggtccaattctttgccctttgttgaggggagccgcacttggcttgaacctcgagaaccacgggacccctggagtagaactcagaagcccctttccccaaggccgggccccgccaggttgggctgtagatccggactgagctccaccgacgtaccgtcaggacatcctcgggctctggttcgccaggccgccgttgaggatttgccggggaccccaattggggacgctctggttcccgccgaggacacagacgcaaagcgcaccgccgccagagaagccatggccggaaaaggtagggccgggggccgcaaatgtgggcaaagaaggcttaagatgtttagtcaagagaagtggcaggtgtacggtgatgaaacatttaaaaggatctaccagaagatgaaggcctcaccacatggaggcaaaaaagcccgcgaggtggggatgggctccggtgctgagcttgggtttcctctgcagaaagaagcggcaggttcgagtggaacagtgcctacacaggatcgaagaaccccagtgcatgaggacatatcggccggcgccaccccagaaccatgggggaacccacccgctcttgaggcatctttggttaccgagcctacaaagcatggtgagacggtggcaagacgcggggatagtgatagacccagagtcgaagaagccgtgtccagcccagcactgggcggccgcgacagtccttgcagcggcagtcgatctccgctggtttcaccgaacggtcggctggagctcgggtggcaaatgccgcccgcccccggcccccttaagggtggtgatgtggaggcccctcggcccgtgtggcctgaccccaagctggagggaggcgcccggggagtgggcgatgtacaggaaacttgcctgtgggcccaaactgtgctgagatggccttccagaggcagcggcgaggataagctgcccagtgagaggaagaagctcaaagtagaagatctgcactcatggaagcaaccggaaccagtgtccgctgaaacacccggcggtccgactcagcccgctagtctgtctagtcagaagcaggatgccgatccgggggaggtgccaggaggcagtaaggagagtgctagacaggtgggtgaacccctcgagtctagcggagcctccttggccgccgcgtctgtggctctgaagcgagttggtcctcgcgataaagctactcctctgcacccagccgctcccgcccccgctgagcatccgtccctcgcgacacctccgcaagccccgagagtcttaagtgccctcgccgacaacgcattttcacctaagtatttactacgcttaccccaggctgaaacacctttgcccctcccaataccatggggccctagacatagccaagactcactgtgttctagtggatggccggaggaacgcgcatcatttgttgggtcgggattggggactcccctctccccctccccagctagtggtccctcccctggagaagctgactctatcctggaagacccaagctgctctaggccccaggatgggcgcaagggggcccagcttggaggggataagggtgacagaatggctacttcaaggcctgccgcccgtgagctcccaatctctgcccccggcgctcctcgcgaggctacctcctcgccccctacccctacatgcgaggcccatttagtacaggatatggagggtgactctcatcgcatacaccgcctgtgtatgggttcaactctggcgcgcgcacgcctctcaggggatgtacttaacccttgggtccccaactgggagctcggagagcctccaggtaatgcacccgaagacccatctagtggacctctggtgggacccgacccctgcagccccctccagccggggtcattcctcaccgctctaacaagaccacagggcgtccccccggggtggcctgaattggcgctgagcagccattccggtacaagccgctctcatagcacaaggagcccacacagcacgcagaatcccttcccaagcctgaaggcggagccgaggctgacatggtgttgcctgagccggtccgtaccactacccgcagaacagaaggccaaagccgctagtgtttatttggctgtccacttcccagggtcctctttgcgagacgaaggacccaacggcccacctggaagtaatggagggtggacatggacaagcccaggggagggcggccctgctcagatgtccaaatttagctacccaactgttcccggtgtgatgccccaacatcaagtgtcagagcccgagtggaagaaagggctgccatggagagcaaagatgagcagaggcaattctaaacagcgcaagctcaaaatcaatccaaagcgttacaaaggcaactttctgcagagttgtgtgcagctcagggctagcaggcttcgtaccccaacgtgggtaagaaggcgctccagacatccaccagcccttgaggggctgaaaccctgccgcacacccggccagacatcatcggagattgccggtctcaatctgcaagaggaaccttcctgtgccacctctgagtctcccccttgctgcggaaaggaggaaaaaaaggaaggcgactgcagacaaactctcggcacactaagcctcggcactagttcccgtatcgtgcgcgagatggataagcggaccgtcaaggacatttcgccctcagccggcgagcatggcgattgcactacccattccacagccgcaacttcaggtttatctctccagtccgacacttgtctggccgtggttaatgatgttccactccctccaggcaaagggttggacctgggcttgttagagacccagttgctggcaagtcaggactctgtgtccactgacccaaagccctatatcttctccgatgcccagcgtccctccagcttcggctcaaagggaacattcccccatcacgacattgccacctcagtggctgctgtgtgtatttccctcccagtgaggactgaccacatcgctcaggaaattcactcagcggaaagtcgcgaccactcgcaaactgcgggaagaacactcacctctagttctcccgattcaaaagttacagaagaggggagagctcagaccctgctacctgggcgaccctcatcaggccagcgtatttccgattcagttcctctggagtcaacagagaagacccatctggaaatccccgcctccggtcccagttcagcctcctcccatcacaaagaaggaagacataaaaccttttttcccagtcgcggtcagtatgggtgcggggaaatgaccgtaccctgtcctagtttgggcagcgacggccggaaacggcaggtgtcgggtttgatcacccgaaaggattccgttgtcccgagcaagccggaacagcctattgaaatcccagaggcaccctcaaagagcctgaagaagcgatctttagaaggcatgagaaagcagaccagggttgagtttagcgacacaagctcggatgacgaagatcgattagtcatcgaaatctag

SEQ ID NO: 141634 - DNA, 264 bp, Artificial Sequence
  Description of Artificial Sequence: Synthetic coding sequence
atggggcccctgacgtttcgcgacgtggctatcgagttcagcctgaaggaatggcagtgcctcgacacggcccagcggaacctatatcggaacgttatgctggagaattatcggaacttggtgtttctgggaatcacagtgtccaaaccggatctgatcacctgccttgaacaaggaaaggaggcctggagcatgaagcgtcacgagattatggtggcgaagccgacagaatcttattccgtgacccagtccgggatgcagtag

SEQ ID NO: 141635 - DNA, 1788 bp, Artificial Sequence
  Description of Artificial Sequence: Synthetic coding sequence
atggggcctcttacatttagggatgtggccattgaattctccctgaaagaatggcagtgcctggataccgcccagcgcaacctctataggaacgtgatgctggaaaactataggaacctggttttcctcggaatcaccgtgagtaaacctgatctgatcacctgccttgagcaagggaaggaggcctggagcatgaagaggcacgaaatcatggtagccaagccgacagtaatgtgcagccactttgcccaggacctctggccggaacagaacattaaagacagtttccagaaggtgaccctcaagcgctatggtaagtgcaggcatgaaaatctacccctgaggaaggggtgtgagagtatggatgaatgtaaaatgcacaaaggcggatgcaacggactgaatcaatgtcttacggctacgcaaagtaagatttttcagtgcgacaagtacgtcaaggtggcccacaagttctcgaattccaaccgtcatgaaatccggcacaccaaaaagaaacctttcaagtgtactaagtgcgggaaaagttttggtatgataagctgtctgacagagcacagtaggattcacaccagagtcaacttttacaaatgcgaggaatgcggcaaggcgtttaattggagttctacacttaccaaacataaacggatacacactggcgaaaagccttataaatgtgaagagtgtgggaaggcttttaatcagagctccaacttgattaaacacaaaaagattcacacaggcgagaaaccatacaagtgtgaagagtgcggcaaaacatttaaccgcttctccaccctgacaacccataaaattattcacacaggagaaaagccatacaagtgtaaggaatgtggaaaagcctttaataggtcaagcacactgacgacccatcgcaagatacatactggtgagaaaccatataaatgtgaggagtgcgggaaggctttcaaacaaagcagtaatctgacaacccacaaaattatccacactggggaaaaaccttacaaatgtaagaagtgcggaaaagcctttaatcagtccgcccaccttaccactcatgaggtgatccataccggcgaaaagccatacaagtgtgagaaatgcggaaaagcttttaatcatttttctcatctgacaacacataaaataattcatactggggagaagccatataagtgcaaggagtgtggaaaagcgttcaagcactcatcaacacttaccaagcataaaataatacacacaggtgagaagccatataagtgcaaagagtgcgaaaaagctttcaatcagtcatccaagcttaccgaacataagaaaatccacaccggtgagaagccatatgagtgcgaaaaatgtggtaaggcgttcaaccagagttccaatcttacaagacataaaaaaagccacaccgaggaaaaaccctataagtgtgaggagtgcgggaaggggtttaagtggccatcgactctgaccatccataaaattattcatacaggtgaaaagccgtacaaatgtgaggagtgcgggaaggctttcaaccaatctagtaaattgaccaagcataagaaaatccatacaggtgaaaagccttatacatgcgaagaatgtggcaaagcttttaatcagagctccaacctgacgaaacacaaacggatccatacgggtgaaaagccatataaatgcgaggaatgtgacaaggccttcaaatggtcatccgtgctaactaagcataagatcatccatacaggagaaaaattacaaatttag

SEQ ID NO: 141636 - DNA, 1689 bp, Artificial Sequence
  Description of Artificial Sequence: Synthetic coding sequence
atgggcccactcacctttcgggacgtggcgatagagttctctctcaaagagtggcaatgtctagataccgctcagagaaatctctatagaaacgtgatgctggagaactataggaacttggtatttctggtgatgtgtagccacttcgctcaggacctatggcccgaacagaacattaaagattccttccagaaggtgacgctgaaaagatacgggaaatgtcggcacgagaatcttcctctgcgtaagggctgcgaatcaatggacgaatgcaagatgcacaagggcgggtgtaatggcctgaatcagtgcctcaccgccacccagtcaaagattttccagtgtgacaagtatgtcaaggtcgctcacaaattttctaattccaaccggcacgaaattcggcacacaaaaaaaaaaccatttaaatgtacaaagtgtgggaagtcctttggcatgatcagctgtctgaccgaacattcacgcattcacacaagggtgaatttctacaaatgcgaagagtgcggaaaggcattcaactggtcctccaccctgaccaagcacaagagaattcatacaggagaaaagccctacaagtgcgaagaatgcggaaaggcatttaatcaatcgtctaacctcattaagcacaagaagatccacacaggagaaaaaccttataaatgcgaagagtgtgggaaaacgttcaacaggtttagcactcttaccacacataaaatcattcacaccggtgaaaaaccatataaatgtaaagagtgcggcaaggcgttcaataggtcatccacgctgaccacgcacaggaaaatccataccggagaaaagccttacaagtgcgaggagtgtggaaaggcgtttaaacaaagttctaatctaacaacgcacaagatcatccacaccggagaaaaaccatataagtgcaaaaaatgcggaaaggctttcaatcagtcagcacacctcacaacacatgaagttatccacaccggcgaaaaaccatataaatgcgaaaagtgtggaaaggcttttaatcacttctcacacctgacaacacacaaaatcattcatacaggagagaaaccgtataagtgtaaagagtgcgggaaagcctttaaacactcaagcacgcttacaaagcacaagatcatacataccggtgaaaaaccttataaatgcaaagaatgcgaaaaggcttttaatcaaagcagtaaacttactgagcataaaaagattcatactggcgagaagccctacgagtgtgaaaagtgtggcaaagcctttaaccagagttccaacctcacgcgtcataagaaaagtcataccgaagagaagccatacaagtgcgaggagtgcggaaagggattcaagtggccttccacattaacgatccacaagattatccatactggtgagaagccttacaagtgcgaagagtgcggaaaagcttttaaccagtcctccaagctgaccaaacataagaagatccacacaggagagaagccatacacctgcgaagagtgcggcaaagctttcaatcaatcgtccaatctcaccaagcacaagcggatccatactggcgagaagccttacaagtgtgaggaatgcgacaaagcatttaaatggtcatccgtgctgaccaaacacaagattattcacaccggcgagaagctccagatatag

SEQ ID NO: 141637 - DNA, 1413 bp, Artificial Sequence
  Description of Artificial Sequence: Synthetic coding sequence
atgcacaagggtgggtgtaacgggttaaatcagtgtttaacagcaacccaatccaagatcttccaatgcgataagtacgtaaaggtagctcataagttttccaacagtaacaggcatgagattcgacatactaagaaaaagccatttaagtgcacgaagtgcggcaagtcatttgggatgatatcctgccttactgagcactcccggatccacacaagagtgaacttctataagtgcgaggagtgcggcaaagccttcaattggtcttctactttgacaaaacacaaacgcatccatacaggggaaaagccttataagtgtgaagagtgtgggaaggcttttaatcaaagctccaacctgataaaacataagaagattcacactggggagaagccttacaaatgcgaagaatgcgggaagaccttcaaccggttttcgaccctgactacgcacaagatcattcataccggcgagaaaccatataagtgtaaggaatgtgggaaagctttcaaccggtccagcacattgacaacacatagaaagatacacacaggtgaaaaaccatacaaatgtgaagagtgcggaaaagctttcaagcagtcttcaaacctgacaacgcataagatcattcatactggcgaaaagccgtataagtgcaagaaatgcggcaaggcattcaatcaaagcgcgcatctaaccacccacgaggttattcacactggggaaaaaccttataaatgcgagaaatgcgggaaagcttttaaccattttagccatctgacgacacacaagatcattcacaccggtgagaagccttacaagtgtaaagaatgtggcaaggcatttaagcactcttctactctgacaaagcataaaatcatccacaccggagagaaaccctataaatgtaaggaatgcgaaaaagcgttcaaccagtcatccaagctcaccgagcacaagaaaatccacaccggggaaaaaccctacgagtgcgagaaatgtgggaaggcatttaaccaatcttcaaatttgactcgccacaagaagagccacacagaagaaaaaccctataaatgcgaggagtgcggaaaaggcttcaaatggcccagtaccttgactattcataaaatcatccatacgggtgaaaagccatacaaatgtgaggagtgcggtaaggcctttaaccagagctcgaaattaacaaaacacaagaaaatacatacaggggaaaagccctacacgtgtgaagaatgcggaaaggcgtttaatcagagctcaaatctcacaaaacacaaacgaatccataccggggagaaaccctacaagtgcgaggaatgcgataaggcttttaagtggtccagtgtgctgacaaagcataaaattattcacaccggggagaaactgcagatctag

SEQ ID NO: 141638 - DNA, 1806 bp, Artificial Sequence
  Description of Artificial Sequence: Synthetic coding sequence
atgggcccccttgaatttcgggatgtggcaatcgaattctctctggaggagtggcactgtctcgatactgcccaacagaatttgtaccgcgatgtcatgttggagaattaccgccatttggtcttcttagggattgttgtgacaaagccggacctgatcacttgtttagaacaggggaagaaacctttcaccgtcaagcgacacgaaatgattgcaaaatctcccgtaatgtgtttccacttcgctcaagacctttgtcctgaacaaagcctgaaggatagtttccagaaagtgatcgtgacacgttacgaaaaacgagaatacggaaatctggagcttaagaaggggtgtgagtccgtggacgagggaaaggtgcacaagaggggctataacggactaaatcagtgcttgactgctacacagagtaaggtatttcagtgcgatacctatgttaaggtaagtcatatatttagcaacagtaacagacacaagatcagagatactgggaaaaagccgtttaaatgcattgaatgcggaaaggcattcaaccaatcttcaacgctcgccacacataagaaaatccacactggggagatcacttgcaagtgcgaagagtgtgggaaggcattcaaccgctcgtctcatctgactagccacaagcgcattcacacgggtgaaaaacggtataaatgcgaagattgcgggaaggagctgaaatactcctccactcttactgcacataaaagaatacacacaggcgagaaacggtataaatgcgaggattgtggaaaggagctgaaatatagtagtacattgaccgcccacaagagaatccacaccggagaaaagccttataaatgcgataagtgcggccgcgcattcattagctcttccattctgtacgtacacaaaatctcgcacactgaagagaaaccatacaagtgcgaagagtgtggcaaggccttcaaactgtccagcatcctgagcacccacaaacggattcatacaggtgagaaaccctacaagtgtgaagagtgcgggaaagcgtttcggcgctctctggtgctcagaacccacaagaggattcacacgggggagaaaccatataagtgtgataagtgcggcaaagcgtttatctccagcagccttctttacaaacataaaattagtcactcggaaaaaaaaccctacaaatgtgaagagtgtggcaaagcgtttaagcgatcttccaccctcacaatccacaagatatcacatactgaagagaagccgtacaaatgtcaggagtgtgataaggtcttcaagagatcctcggcactttcaacacacaaaataattcactcgggagagaaaccatacaagtgcgaggagtgtggaaaagctttcaagagatcatcgaacctgaccacgcacaagatttcccacaccgaggaaaagctttacaaatgccaagagtgcgacaaagcatttaagtatagctcagccttatccactcacaaaatcattcacagcggtgagaacccttacaagtgtgaagaatgcggcaaggcttttaaaagaagcagcgtcttgtctaaacacaagataatccatactggggcaaagccttataaatgcgaggaatgcgggaaggcatttaagagatcctcacagctgactagccataagatctcgcacactggagagaaaccatacaagtgcgaagaatgcggaaaggccttcaacctgtcttcagacctgaatacccacaagcggatccacattgggcagaaggcgtacatcgtaaagaacatggcaaacctgtag

SEQ ID NO: 141639 - DNA, 369 bp, Artificial Sequence
  Description of Artificial Sequence: Synthetic coding sequence
atgaggaagcacattaaagagcgggagctgagccttatggagcagattaaggaattcatactagaaaggaacactatgaatgtgccgacggtgggaaaacctttctctggtcgacacagcctgttaagtatccgcgagttcacgcttggcaggagcccaatgaatgttatgaatgtgggagaaccctccgagaagaagcccacttgcatgatcattagagagttcatattggagaaaaaccctattctggtcagaaacgtgggcaagacaagcgccgaggtccagctgctgctaaatactagagagttcatcctggagattaactccagaaatagagagatcaaggagttcgcagaatgtttctcatag

SEQ ID NO: 141640 - DNA, 1911 bp, Artificial Sequence
  Description of Artificial Sequence: Synthetic coding sequence
atggccccaaggccccccaccgcagcaccccaagagagcgtgacttttaaagatgtctccgtggatttcacccaagaagagtggtaccacgttgacccagctcagagatctctgtatcgtgatgtaatgcttgaaaactacagtcacctggtttccctgggctaccaggtttcaaaaccagaggttatttttaagctcgaacagggtgaggaaccctggattagcgagggcgagatacagcggcctttctatcccgattggaaaacgagaccagaggtgaagtccagccacctgcagcaggacgttagcgaggtcagccattgtacgcacgatctgctgcatgccactcttgaagacagttgggatgttagtagccagctagacagacagcaggaaaattggaaacgtcacctgggtagcgaagcctcaacccaaaaaaagattatcactccccaggaaaatttcgagcaaaataaattcggggagaacagtaggctgaacaccaatctagtaactcagctcaatatcccagctaggatccgccctagcgagtgcgagaccctgggctctaacctggggcacaacgccgatctcctaaacgagaacaatatcctggcaaaaaagaagccgtacaaatgtgacaagtgccgtaaggcttttatccacagaagctcactgacgaagcacgagaagactcacaagggtgagggggccttccccaatgggactgatcagggcatctatccaggaaagaaacatcatgagtgcaccgattgtggtaaaacttttctgtggaaaacccagcttaccgaacaccagcgcatccataccggcgagaaaccttttgagtgcaatgtgtgcggtaaggcttttcgacacagcagttcactgggccagcacgagaatgcgcatacgggcgagaaaccatatcaatgtagcctgtgcggcaaggcctttcagcggagctctagcctggtccagcatcagcggattcatacaggtgagaagccctaccgctgcaacctctgtggtcggtctttcagacatggaactagtctcactcagcacgaagtcacacattccggggagaagccttttcagtgcaaggagtgcggcaaagcattttcaagatgctctagccttgtgcagcacgagcggactcacacaggagaaaaacctttcgagtgctccatctgtggtcgtgcctttggtcaaagcccctccctctataagcatatgcggatccataaacgcggcaagccgtatcagtcatctaactatagtattgactttaagcattcaacatctctcacacaggacgagtccacactcactgaagtaaaatcataccactgcaacgattgcggcgaggacttctcacacatcacagactttacagatcaccagcgaatccacactgcggaaaatccatacgactgcgaacaagcctttagccagcaggcaatctcccaccccggagaaaagccctatcagtgcaatgtctgcggaaaggctttcaaacgcagtacaagttttatagaacaccatcggattcataccggagaaaaaccgtatgaatgtaacgagtgcggggaagcatttagtaggcggtcttcactgacacagcatgaacgcacgcatacaggggagaagccctacgaatgcattgattgcggcaaggcattctcccagagctccagtctgatccagcatgagcgaacccatacgggcgaaaaaccttatgagtgcaacgagtgcggccgcgcctttaggaagaagaccaacctgcacgaccaccagcggatccacactggcgagaagccctatagctgtaaagagtgtggtaaaaacttcagcagaagttctgctctgacaaaacaccaacggattcatacccggaataaattatag

SEQ ID NO: 141641 - DNA, 3576 bp, Artificial Sequence
  Description of Artificial Sequence: Synthetic coding sequence
atgccgggaacgcccgggagtctggagatgggtctgctcacattcagggacgtggcgatcgaattttcacctgaggagtggcagtgcctggacactgcccaacagaacttgtacagaaacgtcatgctggagaattatcgtaacctggcctttctgggtatcgcgctgagtaagccagacctcattacatatctggagcagggcaaagaaccatggaacatgaagcagcatgaaatggtggacgagcctactggcatctgcccgcacttccctcaagatttctggccagagcagtccatggaggactcttttcagaaggtgctgctgcgcaagtatgagaaatgtgggcacgaaaaccttcagctgaggaaaggttgtaaatcagtggatgagtgtaaggtgcataaagaaggttacaacaaactgaatcagtgtctcactacagcccaaagcaaagtttttcagtgcggaaaatacttgaaagtcttctataagttcctgaatagtaatcggcatactatcagacacacaggcaagaaatgtttcaaatgtaagaaatgtgtgaaatctttctgcattcggctgcataagacccaacacaaatgcgtttacatcaccgaaaagtcttgcaaatgcaaagagtgtgaaaagacctttcactggtcatcaaccctgaccaatcataaagaaattcacaccgaagacaagccttacaagtgtgaggagtgcggaaaagcctttaagcaactctctactctgactacccacaagatcatttgtgccaaggagaaaatctataaatgcgaagagtgtggaaaagcctttctgtggtcctctacactgacacgtcataagcgaatacacactggcgagaaaccatacaagtgcgaggaatgcggtaaggccttttctcacagcagcactctcgcaaaacataaaaggatccataccggagagaagccatacaagtgcgaggagtgcgggaaagcctttagtcgcagctctacactcgctaagcataagcgaatccacactggagaaaaaccctacaagtgcaaggagtgcggaaaggctttcagtaattcttccaccctggctaatcacaagatcactcacacggaggaaaagccatataaatgtaaagagtgcgacaaggcctttaaacgactgtctacgctgactaaacacaagatcatacacgcaggtgaaaagctttataagtgcgaagaatgcggcaaggctttcaacagatccagtaacctgacgattcataagtttattcacactggcgaaaagccttacaagtgtgaagaatgtggaaaggcctttaattggtcgtcttcccttaccaaacataagcgcttccatacacgggaaaagcccttcaagtgcaaggagtgtgggaaggccttcatctggagctctaccctgaccaggcacaagcgaatccacaccggggagaagccgtataagtgcgaggagtgcgggaaggcatttcgccagtcgagcactctgaccaagcataaaattatccacacgggtgaaaagccctacaagtttgaggagtgtgggaaggctttcaggcaatctctgaccctgaataaacacaagatcatccatagccgggagaaaccctacaagtgcaaagagtgcggcaaggccttcaagcagttctctacacttactacgcacaagattatacatgctggcaaaaaattatacaagtgcgaggagtgcgggaaagcttttaaccactcttcttccctcagcactcataaaatcatccacactggagaaaagagctataaatgtgaggaatgcgggaaagcctttctgtggtcctcaacattgaggcgtcataaacgcatccacaccggcgagaaaccttataaatgcgaagaatgtggcaaggccttttcgcactcctccgccctggccaaacataaacgcattcacacaggggaaaagccttacaagtgtaaagaatgtggcaaggctttctcaaactcttcaacgctggccaaccacaagataacccacactgaggaaaaaccctacaagtgtaaagaatgtgataagacatttaagagattatcaaccctgacaaagcacaagatcatacatgctggggagaagctatacaaatgtgaagaatgtgggaaggcatttaatcgctcttctaacctcacaatccataagttcattcataccggcgaaaagccatacaagtgcgaggagtgcggtaaggcattcaattggagttccagcttgacaaagcacaagcgcatccacacaagggagaagccgttcaagtgtaaagaatgcggaaaggcattcatctggtcctctactctcactagacacaaaagaatacatacaggtgagaaaccttacaagtgtgaagagtgtggcaaagctttcagccggagctctacactgaccaagcacaagacgatccacacaggcgagaagccatacaaatgcaaagagtgcggtaaggcgttcaagcacagcagtgctttggccaaacacaaaatcattcatgcaggggagaaattgtacaagtgtgaagagtgcggaaaagcctttaaccagtcaagcaacctcaccactcacaagatcatccacaccaaggagaagccctccaaatccgaagaatgtgacaaggcctttatatggtcctccacgcttactgaacacaagcggatccacaccagggaaaagacctacaagtgcgaagaatgcggcaaagccttcagtcaaccttctcatttaactacacacaagaggatgcacaccggcgagaagccctacaaatgtgaagagtgcggaaaagccttctctcaaagttctaccctaacaacacataagataattcacacgggcgagaagccctacaagtgtgaagagtgcggcaaagccttcagaaagagttcgacacttactgaacacaaaattatacacactggtgaaaagccttataaatgtgaggagtgcggtaaagctttcagccagtcaagcaccttgaccaggcatactcgcatgcataccggcgagaagccttataagtgtgaagagtgcggcaaagccttcaataggagctcgaagctcacaacacataagattatccacaccggcgaaaagccttataaatgcgaggaatgcggaaaagcttttatcagctctagcaccttaaacggccacaagaggatccatactagagagaagccttacaagtgtgaggagtgtggcaaagcgtttagtcagtcatctaccctcaccagacataagcggctacatacaggggaaaagccttacaaatgcggtgagtgcgggaaggcctttaaggagagctccgcccttactaaacataagatcatccacacaggcgaaaagccctacaaatgtgagaaatgtggcaaagctttcaatcagtctagcatccttacaaatcacaagaagatacacacaataacacccgtgatacctctcctctgggaggctgaagctggagggagtaggggacaagagatggaaaccatcctggccaataccgttaagcctctcctgtactag

SEQ ID NO: 141642 - DNA, 3480 bp, Artificial Sequence
  Description of Artificial Sequence: Synthetic coding sequence
atgccagggactcccggctctctggaaatgggactactgaccttccgcgatgtggctatagagttcagtccagaagagtggcaatgtttggatacggcccagcaaaacctgtaccggaacgtaatgttggaaaattacagaaaccttgcgttcctgggcatctgtccccactttccacaagacttttggccagaacagtcgatggaggatagtttccagaaggtgctactcagaaaatacgaaaagtgtggccacgagaacctgcagctcagaaagggttgcaagtcggtcgacgagtgcaaggtacacaaagagggctataataagctgaatcagtgcctgacaacagcgcagtccaaggtgttccagtgcggcaaatacctgaaggtgttctacaaatttttgaacagcaaccggcacactattcgacacaccgggaagaaatgttttaagtgtaagaagtgcgtgaagtctttttgcattcggctgcacaagacccaacacaaatgtgtatacatcacggagaagtcctgcaaatgtaaggagtgtgaaaaaacctttcattggagcagcacactgacaaaccataaggagatccataccgaagacaagccatataagtgtgaggaatgcggcaaggctttcaagcagttgtctactttaactacccacaaaatcatttgcgctaaagaaaaaatctataaatgcgaagagtgcggaaaggcttttttgtggtcaagcactctgacgcgccataagcgcatccacaccggcgagaagccatacaaatgtgaagaatgcgggaaagcgttttcccacagttccacccttgctaaacacaagcgtatccacacaggtgaaaagccctataagtgcgaagaatgtggtaaggccttttcccggtcttcaaccctggccaagcataagcgtattcacacaggtgaaaagccatataaatgcaaagaatgtggcaaagccttctctaactcttcgaccttagcaaaccataaaatcactcacacggaagaaaaaccatacaaatgcaaggagtgcgacaaggccttcaagcgactgagtaccctgacaaaacataagatcattcatgctggcgagaagctctataagtgtgaagagtgcggcaaagcattcaatcgtagctccaatctgacaattcataagtttatccacacaggtgaaaaaccctacaagtgcgaagaatgcgggaaggccttcaactggagttccagtctaactaagcacaaaaggttccacacgcgcgagaaaccattcaagtgcaaggagtgtggtaaagcctttatctggtcatctacccttacacggcacaagaggattcacactggggagaagccttacaagtgcgaagaatgcggcaaggccttcaggcagtcatccacgctcacaaagcataagatcatacacaccggagaaaaaccatataagtttgaagagtgtggtaaggccttccgccagtcattaactctcaacaaacacaaaataatccattcacgcgaaaagccttacaagtgcaaagagtgcggcaaggcttttaaacaatttagcaccctgaccacccataaaataatccacgcagggaagaagctctataaatgcgaagagtgtggcaaagccttcaatcatagcagctccctgagtacacacaaaatcatccacaccggtgaaaaatcatacaagtgtgaggaatgtggaaaagccttcctgtggagctccactttgagacgccataaacgcattcatactggcgagaaaccttacaaatgcgaggaatgtggcaaggcatttagccatagcagcgccctcgcaaaacataagagaatccacaccggcgagaagccctataagtgcaaggaatgtggcaaggcattttcaaacagtagcacactggccaaccataagattacccacaccgaggagaagccttacaagtgcaaggaatgcgataaaacgtttaagcgcttatcaactctcactaaacataagatcattcacgccggggagaagctctacaagtgtgaggagtgtggaaaagccttcaatcgcagttccaacctcaccattcacaagttcattcacacaggtgaaaagccatacaagtgtgaggagtgcggaaaagcattcaattggtcctcttcacttactaagcacaagagaatccacacgcgcgagaagccttttaaatgtaaggaatgtgggaaggcattcatttggtcatcaaccctgactaggcataagaggattcatacgggcgaaaaaccttacaaatgtgaagagtgcggtaaagcattttcgcggagttcaacactgactaagcacaaaacgatccacaccggcgaaaaaccatacaaatgcaaagagtgtggtaaagcctttaagcactcaagcgccctcgcaaagcacaagatcatacatgctggcgagaaactgtacaaatgtgaagaatgtggaaaggcctttaaccagagttccaacctgactacccataagataatccacacaaaagaaaaacctagcaagtccgaggagtgcgataaggccttcatctggtcatctacactaaccgagcacaaaaggattcacacccgtgaaaagacatacaagtgtgaggagtgtggtaaagcattctcccagccttctcatctcaccacacataaaaggatgcacacgggggaaaaaccctacaagtgcgaagagtgtggaaaggcgttctcacagagcagtaccctgaccacgcacaagattatccatacaggcgagaagccctacaagtgtgaggagtgtggaaaggcgttccggaaaagctctaccctaactgagcataaaattattcacaccggggagaaaccttacaaatgcgaagagtgtgggaaggcctttagtcagtcatctaccctgacaaggcataccaggatgcacacaggcgaaaagccctacaaatgtgaagaatgtggcaaggcgttcaaccggtcctccaaactcaccacccacaagatcatacatacaggagagaaaccatataaatgtgaggaatgtggtaaagcctttatatctagctcaactctgaatgggcacaaaagaatccacactagagaaaagccttataagtgcgaggagtgcggaaaggccttctcccaatcttcaactctgaccaggcacaagagactgcatacaggcgaaaagccgtacaagtgtggggagtgcggcaaagcattcaaggaaagtagcgcactgactaagcataagatcattcacaccggtgagaaaccctacaagtgtgaaaagtgcggtaaagccttcaatcaatccagtattctgaccaaccacaagaaaatccatacgattacccccgtcatacctctgctctgggaggcagaagcaggcgggtccagaggccaagaaatggaaaccatcttggcgaataccgttaaaccgttactttactag

SEQ ID NO: 141643 - DNA, 1761 bp, Artificial Sequence
  Description of Artificial Sequence: Synthetic coding sequence
atgggtcccctcacattccgtgacgtcaaaattgaatttagtctggaggaatggcaatgcctagatacagcacagcgtaatctttatcgggatgtaatgctagaaaattatcggaatttggttttccttggcatagctgtgtcaaaacccgacctgatcacctggcttgagcaaggaaaggaaccctggaacttaaaacgccacgagatggtggacaaaacgccggtcatgtgcagtcacttcgctcaggatgtgtggccggagcatagcattaaagattctttccagaaggtgattctgcggacctatggtaaatacggacacgaaaatctccagttacgcaaggatcacaaatccgtggacgcctgcaaggtgtacaagggaggctataatgggctaaaccagtgtctgacaactaccgattcaaagatcttccagtgtgacaagtacgttaaagtttttcacaagtttccaaatgtgaacagaaacaaaatccgacataccggcaagaagcctttcaaatgcaagaaccgaggaaaaagcttttgcatgttgagccagcttacgcaacacaagaaaatccacacccgcgaatacagctataagtgcgaggagtgcggcaaagccttcaattggagctctacgctgaccaagcacaaaatcatacacaccggggagaaaccatataagtgcgaggaatgcggaaaggccttcaatcggtccagtaacctgacaaaacacaaaattattcacacaggcgaaaagccttataaatgtgaagagtgcggcaaagcattcaaccgcagtagtaccctcaccaaacacaaaagaattcatactgaagagaaaccatacaaatgtgaggaatgtggcaaagcctttaatcagttttctatactgaataagcacaaaagaattcacatggaggataaaccctataagtgtgaagaatgtgggaaggctttcagggtgttctccatcctgaagaagcacaaaatcattcatactggggaaaaaccgtataagtgcgaggaatgtggcaaagcatttaaccaattcagcaatctgaccaaacataaaattattcatactggagaaaagccttacaaatgcgatgagtgtggcaaggcctttaatcagtcttccactcttaccaagcataagaggatccatacaggcgagaagccctataagtgcgaagaatgcgggaaagcttttaaacagtcttctactttaaccgagcacaaaataatacatacgggggaaaaaccttacaaatgcgaaaagtgtgggaaggcattctcctggagttctgcatttactaagcacaaacggaatcatatggaggataaaccatataagtgtgaagagtgcggtaaggcattctcagtattttctaccctcacaaagcataaaattattcatacccgagagaagccctataaatgtgaggagtgtggaaaggcattcaaccagagttctatattcacaaaacataaaattattcataccgagggtaagtcatacaaatgcgaaaagtgtggaaatgccttcaatcaaagctcaaatctcaccgcccgcaagattatctacaccggggaaaaaccctataagtatgaagagtgtgacaaggccttcaacaaattcagcactctaattactcatcagatcatctataccggagaaaagccctgtaagcacgagtgtgggagagctttcaacaagagctctaactacactaaggagaaactccagacttag

SEQ ID NO: 141644 - DNA, 1665 bp, Artificial Sequence
  Description of Artificial Sequence: Synthetic coding sequence
atgggacctttaacgtttcgcgatgtgaagattgagttctccctggaggaatggcagtgtctagacacagcccagcgaaatctgtaccgcgacgtgatgctcgaaaattacaggaacctggtgtttctggtgatgtgttcacattttgcacaggatgtatggccagaacacagcatcaaggattcctttcagaaggtgattcttaggacatatggcaaatacggccatgagaatcttcagctgcggaaggaccacaagtcggtagacgcctgcaaagtgtacaagggcggctacaatggtctaaaccagtgcctgactaccacggacagcaagatttttcagtgcgataagtacgtgaaggtgtttcataagttccctaatgtcaaccgcaataaaattcgtcatacgggaaagaaacccttcaagtgcaagaatcgcggcaagagtttttgtatgttgagccaactcacccagcacaagaaaatacacactagagagtactcatacaagtgtgaagaatgcgggaaggctttcaactggagttccacattaaccaagcacaaaataattcatactggcgaaaagccttacaaatgtgaggagtgcggaaaagcattcaaccgatcctctaacctgacgaaacataagatcattcacaccggggaaaagccatacaagtgcgaggaatgcgggaaagcattcaatagaagttctactcttactaaacataagcgaattcacaccgaagagaagccatataaatgcgaagaatgcggaaaggctttcaaccagttttcaattttgaataagcacaagcgtattcatatggaggacaagccctacaaatgtgaggagtgcgggaaggcttttcgcgtcttcagcatccttaagaagcataaaataattcacacaggagagaagccctacaagtgcgaggaatgtggtaaggcatttaatcagttcagcaacctaacaaaacacaagatcatccatactggtgagaagccctacaaatgtgatgaatgtggcaaggcatttaatcagtcttcaaccctaacaaagcataaacggattcatacaggcgaaaagccctacaagtgtgaagaatgcggcaaggctttcaagcaatcatcaaccttgacagaacataaaattattcataccggagagaagccgtacaagtgtgagaagtgcggcaaagcgttctcttggtcttctgcctttacgaagcacaagcgcaatcatatggaggataagccctataagtgtgaggaatgcggaaaagcattctccgtgttcagcactcttacaaagcacaaaattatccacacccgtgagaagccctacaagtgcgaggagtgcggaaaagcatttaaccaatcctctatctttaccaagcacaaaattatccacactgaaggcaagagctacaaatgtgagaagtgtggtaacgcattcaaccaaagcagcaacctaacagcacgaaagattatctataccggtgaaaagccatataaatacgaggaatgtgataaggcatttaataaattcagtaccctgattacgcatcagattatatatactggggaaaagccatgtaaacatgagtgcggtagggcttttaacaaatccagcaactatactaaagagaaactgcagacttag

SEQ ID NO: 141645 - DNA, 1554 bp, Artificial Sequence
  Description of Artificial Sequence: Synthetic coding sequence
atggtagataagactccggtgatgtgcagccattttgctcaggatgtttggcctgagcactccataaaggacagtttccaaaaggtcatccttcgcacatatgggaaatatggccatgaaaaccttcagcttcgcaaagaccacaagagcgtcgatgcctgcaaagtgtataaaggaggttataatggactgaaccagtgtctgactaccaccgactctaagatctttcagtgtgataagtatgtcaaggttttccataagttcccgaacgttaatcgcaacaagatcaggcataccggcaaaaagcccttcaagtgcaaaaatcgtgggaaatcattctgtatgctcagccagttaacccagcacaagaagattcatacacgggagtacagctacaagtgcgaggaatgcggcaaggcattcaattggtcttccacgctgacaaagcacaaaatcattcatacaggcgagaaaccatacaagtgtgaggaatgcgggaaagcgtttaatcggagctctaatttgactaagcacaaaataatccacaccggagagaagccgtataaatgtgaggagtgcgggaaggccttcaacaggagcagtacacttactaagcataaacggattcacaccgaggagaagccatacaagtgcgaggagtgtggtaaggctttcaaccagtttagtattctcaacaagcataagcggatacatatggaagacaagccctataagtgtgaagagtgcgggaaagctttcagggtcttttccatcctcaagaagcacaaaataattcataccggcgagaagccctacaagtgtgaggagtgcggtaaggccttcaaccagttctccaacttgacaaaacataagataatccatactggcgaaaagccttacaagtgtgacgaatgcgggaaggccttcaaccagagctccactctgacaaaacacaagcgcattcataccggcgaaaagccctacaagtgcgaggagtgtggcaaagccttcaaacagtcctctaccctcaccgagcacaaaattatccacacaggggaaaagccctacaaatgcgagaagtgtggcaaagcgttcagctggtcctctgctttcactaagcacaagaggaatcacatggaggataagccttataaatgtgaagagtgcggaaaggcattcagcgtgttctcgacactgacaaagcacaaaataattcacactcgcgagaagccctacaaatgtgaagagtgcgggaaagcttttaatcagtcttcaatatttactaaacacaagataattcacacagagggcaagtcttacaaatgcgagaagtgtggcaatgcatttaatcaaagcagtaacctgacagcccggaagatcatttatactggtgaaaagccttacaagtatgaggagtgtgacaaagctttcaataaattcagcaccttgatcacacaccagattatctacactggcgaaaagccctgtaaacatgagtgcgggagagcattcaacaaatcaagcaattatacaaaagagaaactccagacttag

SEQ ID NO: 141646 - DNA, 1863 bp, Artificial Sequence
  Description of Artificial Sequence: Synthetic coding sequence
atggggcctctgcagttccgcgatgtggcaattgaattctcattggaggagtggcattgcctggatactgcgcaacggaacctttaccgaaatgtgatgctggagaattactcaaaccttgtatttctgggaattgtggtctcgaaacccgacctgattgcccatctggaacaggggaaaaaacctttgactatgaaacgccacgagatggtggcgaatccatccgttatttgttcccacttcgcccaggacctgtggccagaacagaacatcaaggactccttccagaaggtgattcttcgccggtatgagaaaagagggcacggtaacctgcagctgatcaaaaggtgcgagagcgtggacgagtgcaaggttcataccggtgggtacaacggcttaaaccaatgctcaacgaccactcagtccaaagtgtttcagtgcgataagtacgggaaagtgttccataagttttccaattctaatagacacaacatcagacacactgaaaagaagccattcaagtgcatcgagtgcgggaaagcattcaaccagttttccacactgatcactcacaaaaagatccacaccggcgaaaagccctacatatgcgaggagtgcgggaaagctttcaaatattcctctgctctcaacacacataaacgtattcatacaggcgagaagccctataaatgcgataagtgcgataaggcatttattgccagcagtacattgtccaaacacgaaatcatccacacaggaaaaaaaccttacaagtgtgaagaatgcgggaaagctttcaatcagagttccaccctcacaaaacacaagaaaattcataccggcgagaagccatataagtgcgaagaatgcggcaaagccttcaaccagtccagcacacttacaaagcacaagaagatccacactggcgaaaagccatatgtgtgtgaggaatgtggaaaggcctttaagtacagtcggatcctgacaactcataagcggatccacacgggcgaaaaaccctacaagtgtaataagtgcggcaaggccttcatcgctagtagcactctcagccgacacgaatttatacacatgggaaagaaacactacaagtgtgaggagtgtggcaaggctttcatctggtccagtgtcctgacacgacacaaaagagtgcataccggtgagaagccttataagtgtgaagagtgcggcaaggccttcaaatacagcagtactcttagctcccacaaacggtcgcatacaggagaaaaaccctacaagtgtgaggaatgcggcaaagctttcgttgcgagttccacactcagcaagcacgagataatccataccggcaaaaagccctacaagtgcgaagaatgtggtaaggcgtttaaccaatcctcatctctgaccaaacataagaaaatccatacaggggaaaagccatacaagtgtgaagagtgcggcaaggccttcaatcaatcttccagcctgactaaacataagaagatacacacaggagaaaaaccatataagtgcgaggagtgtggtaaagcttttaaccagtcatccaccttaattaaacacaagaaaatacacactagagagaaaccttacaagtgcgaggagtgtggtaaggcatttcacctgagtacacacctgacgacacataagattctgcacacaggtgagaaaccatataggtgcagggagtgcgggaaggccttcaatcactccgccacactttcatcacataaaaagattcactctggggaaaaaccttatgaatgtgacaaatgcggaaaggctttcataagtccctcttctttgtccagacatgaaattattcatacgggcgagaaaccatag

SEQ ID NO: 141647 - DNA, 1779 bp, Artificial Sequence
  Description of Artificial Sequence: Synthetic coding sequence
atgggacctctacaatttcgcgatgttgctatcgaattctcattagaagaatggcactgcctcgacaccgcacagcgaaatctctacagaaatgtgatgctggagaactattcaaaccttgtgtttctgggcatcgtggtgagcaagcctgacctcattgcgcacctggaacaggggaagaaaccattaacgatgaaacgccacgagatggttgcgaacccaagcgtgatttgtagccacttcgctcaggacctgtggccagaacaaaatatcaaggactcgttccagaaggtaatcctccgaagatatgagaagcggggccatggaaatctccagctcatcaaacgttgcgaatctgtggatgagtgtaaggtgcatacaggcggttacaacggcctgaatcagtgcagtacgacaacacagagcaaagtctttcaatgcgacaaatacgggaaggtattccacaagtttagcaactctaataggcacaacatcaggcataccgaaaagaagccgtttaagtgcatagagtgcggcaaagcctttaaccagttctcgaccctcattacccataaaaaaattcacacgggggaaaaaccttacatatgtgaagagtgcggcaaggcctttaaatacagctctgccctcaatacacataaacgtattcataccggtgagaagccctacaagtgcgacaaatgtgataaagcctttattgcttctagcactctgagcaaacacgagattatccacacaggcaagaagccatataagtgtgaagaatgtgggaaggctttcaatcaatctagcacactcaccaaacacaagaaaattcatacaggagaaaagccctataaatgcgaagagtgtggcaaggcatttaaccagtcttccacattgactaagcataaaaagattcataccggcgagaagccgtacgtgtgcgaggagtgcggaaaggcatttaagtacagccgaattttaaccacccacaaacgcattcatacaggggagaaaccctacaagtgcaacaaatgcgggaaggccttcattgcctccagcaccttatctcggcacgagttcatccacatgggtaagaaacactacaagtgtgaggaatgcggaaaggctttcatttggagtagcgtgcttaccagacataaacgcgtccacaccggtgaaaagccttataaatgtgaagaatgtggaaaagcatttgtggctagctccactctttcaaaacatgaaataatccacactggcaagaaaccatacaagtgcgaggaatgtggaaaagctttcaatcagtcatcttcattaacaaagcacaaaaagatccataccggggagaagccatacaaatgtgaagagtgtggcaaggccttcaatcagagtagtagcctgaccaagcacaaaaagattcatactggagagaagccgtacaagtgcgaggagtgcggcaaagcctttaaccaaagcagcaccctgatcaaacacaagaagattcatacacgggaaaagccttacaaatgcgaggagtgcggaaaggcattccacttaagtactcatctcaccactcacaagatcctccatacaggcgaaaaaccttaccgctgtagagagtgcgggaaggcattcaatcactcagccacgctctcatcgcataaaaagatacattccggcgagaagccgtatgagtgcgacaagtgcggaaaagcattcatctctcccagtagccttagccgtcacgaaattatccatactggcgaaaaaccctag

SEQ ID NO: 141648 - DNA, 183 bp, Artificial Sequence
  Description of Artificial Sequence: Synthetic coding sequence
atggttgccaatcctagtgtgatctgttcccatttcgcccaggacctgtggcccgaacagaacataaaggatagcttccagaaggttatcctgcggcggtacgaaaaaagagggcacggaaatctccagctgatcaagcggtgtgaatctacgccctctgaaaaggaaaaaaagaaaaaatag

SEQ ID NO: 141649 - DNA, 1719 bp, Artificial Sequence
  Description of Artificial Sequence: Synthetic coding sequence
atgccgggtcctctcggcagcctagagatgggggtgctcaccttccgagatgtcgcactcgaattctctttagaggagtggcagtgcctggacaccgcccaacaaaatctttaccgaaacgtgatgctggagaattacagaaacctcgtgtttgtaggcatagcagcctctaagcccgacctgatcacatgtcttgagcagggcaaggagccctggaacgtgaaaagacacgagatggtaactgagcccccggtcgtgtactcatattttgcacaggacctctggccaaaacaggggaagaagaattactttcagaaagtgatcctccgaacatataagaaatgtgggcgcgagaacttacagctgcgcaagtattgtaaatccatggatgagtgtaaggttcacaaggagtgttataatggactgaatcagtgtcttacaacaacccagaacaaaattttccagtacgacaagtatgtcaaagtttttcataagtttagcaattccaaccgacataaaatcggacacacgggcaaaaaaagtttcaagtgcaaggagtgtgaaaagagtttctgtatgctgtcccaccttgcacaacacaagcggatccacagtggtgagaagccatacaaatgcaaggaatgtggcaaagcctacaatgaagcgagtaacctctctactcacaagcgaatccacaccggcaagaagccatataagtgtgaggagtgtggaaaagccttcaatcgcctgagccacctgactacccacaagatcattcatacaggcaagaagccttataaatgcgaggaatgcggaaaggcgtttaaccaatcagctaacctgacaactcacaaacgcattcacacaggggagaagccgtacaaatgtgaggagtgcgggcgcgcgttctcccaatctagcactctcactgctcataaaattatccatgctggagaaaaaccatacaagtgcgaagaatgcgggaaagccttctcccagagctcaactttgactacacacaagatcatccataccggagagaagttttacaagtgtgaagaatgcggcaaagctttctcccgcttgtcccacctgactacccacaagcgcatccattccggcgaaaagccatataaatgcgaggaatgtggcaaggcctttaaacagtcaagcacacttactacgcacaagcgcatccatgccggagagaagttttataagtgtgaggtgtgctccaaagccttctcgcgattttcccacctgacaactcataaaaggatccacacgggcgaaaaaccttacaaatgtgaagaatgtggtaaggcctttaacctgtcgtctcaattaaccacacataagatcattcatactggagagaaaccatataagtgcgaagagtgtggaaaagcatttaaccaaagctctactctgtctaagcacaaggttatacatacaggcgagaagccttacaagtgtgaggagtgtggaaaggcttttaaccaatcttcccatcttacgacgcataagatgatccataccggagagaaaccgtacaagtgcgaagagtgcggtaaagcatttaacaattcctcaatcctaaaccggcataaaatgattcacacaggagagaaactctacaagccagaaagttgtaataacgcttgtgataatattgcgaagattagcaagtacaaaagaaattgcgctggtgagaaatag

SEQ ID NO: 141650 - DNA, 3114 bp, Artificial Sequence
  Description of Artificial Sequence: Synthetic coding sequence
atgtccttctggtcagagaaatgtaccaggttgatcttatatgaccttaagattgccttgaagaatggctctttgaccttttgggatgtgaccatcgagttcgctcttgaggaatggcagtgcctggatatggcacaacagaacctctaccgcaacgtgatgttagaaaactatagaaacttggttttcctgggtatcgccgtgtcgaagctagatctgattacttgcctcaagcagggaaaggagccatggaatatgaagcggcatgagatggtgacaaagcctcccgtgatctccagccacttcactcaggatttttggccagatcaatccatcaaggattccttccaagagattattctgcgaacatacgccaggtgtggccataaaaacttgagactgaggaaggactgcgagtccgttaatgaaggcaagatgcatgaagaagcctataacaaactgaatcagtgctggaccactacacaaggtaaaatcttccaatgcaacaagtatgtcaaagttttccataagtacagtaacagtaaccgctacaagatcatccacacaggtaagaagccttacaagtgtgaggagtgcggaaaagctttcaaacaatcaagccatctgactcgccacaaggcaatacacaccggagagaagccctacaaatgtgaggagtgtggtaaggcctttaaccatttctctgctctgagaaaacaccagatcattcacaccgggaagaaaccctataagtgtgaggagtgcggtaaggccttctcccagtcttctactctcaggaaacatgaaattatccacacagaagagaaaccatacaagtatgaagagtgcggaaaggccttttccaacctgtctgcgctgcggaagcacgaaatcatccacacaggccagaaaccgtataagtgtgaggagtgcggcaaagcgttcaagtggtcaagcaagctcacggttcacaaggtaatccatacagcggagaagccgtgcaagtgcgaagagtgcggcaaggcttttaagcgctttagtgctctgagaaagcataaaattatccacactggtaaacaaccgtacaagtgcgaggaatgctccaaggcattcagtaattttagtgctctgcgcaaacacgaaatcatccataccggcgaaaaaccttacaaatgtgaggaatgcgggaaagctttcaagtggtcgagcaagctgaccgtccacaaggtcatccacatggaagagaaaccgtgcaagtgtgaggagtgtgggaaggcttttaaacatttcagcgccctgagaaagcacaagattatccacactggaaaaaagccatataagtgtgaggagtgcggaaaagcctttaacaacagtagcacattgatgaaacacaagattatccatacgggcaagaagccctacaagtgtgaagaatgtgggaaagcctttaaacagtcatcccaccttactaggcacaaagccatacacaccggtgagaaaccctataagtgcgaggaatgtgggaaggcctttaaccatttctccgctcttcggaaacaccagatcatccatacagggaaaaagccctacaaatgtgaggaatgcggcaaggccttctcacagtcgagtaccctgcgtaaacatgagatcatccacacaggtgaaaaaccctataagtgcgaggagtgtggtaaagccttcaaatggtcaagtcatctcaccagacataaagtgatccataccgaggagaagccttataagtgcgaggaatgtggcaaggctttcaatcatttctccgcattgaggaagcacaagatcatccacacgggtaaaaagccgtacaaatgcgaggaatgtggcaaggctttctcacagagttccaccctccgcaagcacgaaatcatccacacgggggaaaaaccttacaagtgtgaggagtgcggaaaggcctttaaatggagctccaagttaactgtccacaaggtgattcataccgctgagaaaccatgcaagtgcgaggagtgcggtaaagcattcaaacattttagtgccctgaggaagcacaaaattatccacacagggaagaagccttataaatgcgaagaatgtggcaaggcttttaataattcgtccacgctgcggaaacacgagatcattcatacaggggagaagagttacaaatgcgaggagtgcgcactccgcaaacacgaaattattcacacgggcaagaaaccctataagtgtgaagagtgcggaaaagccttcaataattcaagtaccctgcggaagcacaaaatcatctatactgggaagaaaccatataagtgtgaagagtgtggcaaagcttttaaacagtcttcacatctgaccaggcacaaggctgtgcacaccggagagaagccttataagtgcggagaatgcgggaaggcgttcaacaacagctccactcttaagaagcacaagctcatccacacccgggaaaagagctacaagtgtgaagagtgcggtaaggcttttagtaacttctccgccctcaggaaacataaaatcatacatacaggcgaaaagccttacaagtgcgaagagtgtgaatgtgggaaagccttcaataattctagcaccctgatgaagcacaaaatcattcacactggcgaaaaaccatacaaatgcgaagagtgtggaaagggatttaacaactttagtacactcatgaagcacaagattatccacacaggagaaaagccctacaagtgtgaagagtgcggaaaggcttttaaacagagttctcacctaaccaagcacaagtccattcataccggagagaagccttataagtgcgaggaacgaggcaaggcattctcccacttttccagactgactaagcatagaattattcacactggcaaaaagccatacaaatgtgaagagtgcggagaaaagccttacaagtgcgaggaatgcggtaaggcttttaaccagagtagtcatctgacgcaacacaagaccatccacacaggcggaaagacctacaaatgcgaggaatgcggaaaggccttcaaccacctgagtgctctgacaaagcacaaaatcattcacaccggagaaaagccatag

SEQ ID NO: 141651 - DNA, 3021 bp, Artificial Sequence
  Description of Artificial Sequence: Synthetic coding sequence
atgtctcggaggaaacagtcaaaccctcgacagataaaacgttccttaggggatatggaggctagagaggaggttcagctggttggggcctcacatatggagcagaaagccacagcgccagaagctccttctcctccttcggctgacgtgaattctccccctccgctgcctcccccaacatcccccggcggccccaaggaactggaggggcaggaaccagagcctcgcccgactgaggaggagcctggatcgccatggtccggtcctgacgagttggaacctgtggttcaggatggacagcggcgcattagagcccggctttcccttgccactgggttgtcgtggggaccgtttcacggatccgtgcagactcgtgcctcttctccgagacaggctgagcctagccctgcactgaccctgctactagttgatgaagcttgctggttgcgcaccctacctcaggccctaactgaagccgaagcaaatacggaaatccacaggaaagacgatgccctgtggtgcagagtgacgaagcccgtgcccgccggagggctactgtcagtgctgctcaccgctgagccgcatagtactcccggccacccagttaaaaaagaaccggcagagcccacctgtccagcccccgcgcatgacttgcagctcttaccgcagcaagctgggatggcgtctattctggcaaccgccgtaattaataaagatgtgttcccatgcaaggactgcggcatttggtataggagtgagcggaatctacaggcacacctcctttattactgtgcctcccggcagggtaccggcagcccggccgccgccgcaaccgatgagaaacccaaagaaacatacccgaacgagagagtgtgtccctttccccagtgtaggaaatcttgtccaagcgcctcatccctggagatacatatgcgatctcattccggcgagcgtccttttgtgtgcctgatatgtctttcagcctttacaacaaaggcaaactgcgagaggcacttaaaagtccacacagatacactgtctggcgtgtgccactcttgtgggttcatctcaaccacaagggacattctttattctcatttggtgaccaaccatatggtgtgccagcccggttcaaagggtgaaatctactctccaggcgctggccatcctgccacgaagctgcctcctgatagcctaggctcctttcagcagcagcacacagcactccagggaccactcgcatcggcagaccttggtctggctcctacccctagtcccgggctggatcggaaagcgctggccgaagccacaaatggagaggctagggcggagccgttggcacagaacggcggatcgtccgaacccccagccgcgcctaggagtataaaagtggaggcagtagaggagccagaagccgctcccatattggggcccggtgagccaggcccccaagctccttcaaggacccccagccctcgcagccccgcgcccgcacgagtgaaggctgaactgagctctcctaccccgggtagctccccagtgccaggtgaactgggtctagccggcgccctgttcctcccacagtacgtgtttggtccagacgcagcacccccagctagtgagatcttagcaaaaatgtccgaactggtgcattcccgacttcaacaaggcgccggagccggggcaggaggcgcacagaccggcttgtttccaggggcgccgaagggggccacttgctttgagtgcgaaattaccttctctaacgtcaataactattatgtccacaagcggctctattgcagtggacgcagggcaccagaggacgcaccagccgctaggcggccgaaggcacctccaggcccagctagggcccctcccggtcagccagccgaacctgatgcccccagatcctctcccggacctggggctagggaagaaggggctggcggagccgcaacacctgaggacggggcggggggacgagggtctgaaggatctcagtcgcccgggagctctgtagatgacgcggaggatgacccctcacgaacactgtgcgaagcctgcaatatccgcttcagtcgccacgagacatatacagtgcacaaaagatattattgcgcctccagacacgatcccccgcccaggcgtcccgccgccccacctggcccccctggtcccgctgctcctcccgcgccatccccggctgccccagtgagaacaagacggaggcggaagctgtatgagcttcacgcagcaggagcccccccccctcctcctcccggccacgctccagcgccggaaagccctcgacccggctccggcagcggttctggacccggactggcaccagcgagatctcctggccccgcggcagacggtcccatcgatctgtccaagaaacccagaaggccattaccgggagctcctgcaccagcactcgctgactatcacgagtgtactgcatgcagagtaagttttcatagcttagaagcttacctagctcataagaaatactcatgtcccgccgcgccgcctccaggggccctggggctgcctgccgcggcctgcccttactgcccacccaacggccccgtgaggggggatctgttggaacactttcgcctcgcacatggactactgctaggtgcacccctggccggccccggagtggaagccagaacccccgccgacagagggccatcccccgccccagctcccgccgcgagtcctcagccgggctccaggggacctagggacggtctgggtcctgaaccgcaggagcccccacctggaccccctccgagcccggcggctgcacctgaggccgtgcccccgccgcccgctccgccttcatactctgacaagggggtgcagactccatcaaagggaactccagctccattaccgaacggtaatcatagatattgccggctctgcaacataaaatttagcagtttgtcaacttttattgcacataaaaagtactactgctcgtcacacgctgcagaacacgtcaaatag

SEQ ID NO: 141652 - DNA, 2649 bp, Artificial Sequence
  Description of Artificial Sequence: Synthetic coding sequence
atgtactactgcagtggtcgccaacgcgaggctgccccagtttccgaggagaacgaagattccgcccaccagatctcttcattgtgccctttcccacagtgcactaaatcttttagtaacgctagggctttagagatgcacctgaattcacatagtggcgtgaaaatggaggagttcctgccccccggtgcttctctgaaatgcacggtgtgctcatatactgccgattctgtgataaacttccatcagcatctgttcagtcatctgacgcaagcggcatttcgttgcaatcactgtcactttggttttcagacacagcgtgaacttctgcagcaccaggagttgcatgtgccctccggtaagctgcccagggaatccgatatggagcatagcccgagtgctactgaagattccttgcagcctgccaccgacctgctgaccagaagcgagcttcctcagtctcagaaggccatgcaaaccaaggatgcatccagcgatacagagcttgataagtgcgagaagaagacacagttatttctcaccaaccagcgaccggaaattcagcctacaaccaacaaacagtctttcagctacacaaaaattaagtccgaaccctctagtcctcgactagcaagtagcccagttcaaccaaatatcgggccatcttttcccgttgggcctttcctgtctcaattctccttcccccaggacattaccatggtaccacaggcgagtgaaatcttggccaagatgtctgaactagtgcaccggcggctcagacacggaagctctagctacccaccggttatttactcaccactgatgccgaaaggggcaacctgcttcgagtgtaacattacattcaataacttagataattacctggtgcacaagaagcactactgttctagccgctggcaacaaatggccaagtcccctgaatttccttcggtgagtgagaagatgcctgaggcactgtccccgaacacaggccagacctccatcaatctgctgaacccagccgcccactctgctgacccagaaaatccacttctgcagacctcttgcataaattcgagcaccgttctggacctgattgggcccaatggcaagggccacgataaggacttttccacacagaccaagaagctgagcaccagctcaaacaacgacgacaaaattaatggcaaaccggtggatgtgaagaatccttccgttcctctggtggacggtgaatccgaccccaataaaactacgtgtgaggcgtgtaacatcaccttctcacgccacgagacatacatggtccacaaacaatattactgtgccaccaggcacgatcctcctttgaaacgttcagctagtaacaaggtgccggcaatgcaacggacaatgcgaacccgaaagaggcggaagatgtatgaaatgtgtttgccagagcaggaacagcgacctcctctggttcagcagaggttcctcgacgtcgcgaatctgaacaacccgtgtaccagtacccaagagccgaccgagggcctcggagaatgctatcatccgagatgtgacattttccctggaattgtttcgaaacatcttgagactagcctgacaattaacaaatgcgtccccgtgtcaaaatgtgatacgacacactccagtgtctcctgcctcgaaatggatgtgccaattgacttgtcaaaaaagtgcttaagtcaatcggaacggacaaccacatcccctaagcgcctcctcgactatcatgagtgcaccgtatgcaaaatttcattcaacaaagtggagaattacttggcccataaacagaacttttgccctgtcacagctcatcagcggaacgatctcggacagctggatggcaaggtattccctaacccagaatcagagcgcaactcccccgacgtgagttacgagagatctataatcaaatgtgaaaaaaacgggaacttaaagcagccctccccaaacggcaaccttttctcctcgcacctagcaacgcttcagggtttaaaggtcttttcagaggctgcacagctgatcgctactaaggaggaaaataggcatctgtttctgccccagtgtctgtatccgggtgcgatcaaaaaggcgaaaggcgccgaccaactgtcaccttactacgggataaaaccatcagactacatctccggatccctggtgatccacaatactgatattgaacaatctcgcaatgccgagaacgagagccctaaggggcaggccagcagcaatgggtgcgccgcactcaagaaagattccctgccccttctgcccaaaaaccgtggaatggtgatcgtcaatggcggacttaagcaggatgagcgaccagcagccaacccacagcaagagaacatctcccagaatccacaacatgaggacgatcacaagtctccctcttggataagcgaaaaccccctagctgctaatgaaaacgtgagccccggaataccttcggcagaggaacaactctctagtatcgcaaaaggtgtgaacggttcctctcaggctcccacctctggtaaatactgtaggctgtgcgatattcagtttaacaacctgtccaactttataacacacaagaaattctattgcagttcccacgccgccgagcatgtgaaatag

SEQ ID NO: 141653 - DNA, 3456 bp, Artificial Sequence
  Description of Artificial Sequence: Synthetic coding sequence
atgagtcgtagaaaacaatcaaagccccggcagataaagcggcctctcgaagacgccatcgaggacgaagaggaagagtgccctagcgaagaaaccgacatcatctctaaaggggacttcccgctggaagagagcttttcaacggagttcggacctgagaatctctcgtgcgaagaggtcgagtacttctgtaacaagggtgatgacgagggcatccaggaaacggccgagagtgatggtgatacccagtcagagaaaccaggccaaccaggggtggagaccgatgattgggacggacccggcgagttggaagtgttccaaaaggatggcgagcgcaagatccaaagccgacagcagctgcccgtgggcactacttggggcccattcccaggaaaaatggaccttaacaacaattctttaaagaccaaggcccaggttccaatggtcctgacggccgggccaaagtggctgctggacgtaacatggcagggtgtggaggataacaagaacaattgcattgtttatagtaaggggggacagctgtggtgcacaactacaaaggctatctctgagggggaagaactaatcgcgttcgttgtcgatttcgatagtagactgcaggccgcttctcagatgaccctcactgaaggcatgtacccagcacggctactcgatagcatccaactgctgccccagcaggccgctatggcaagtatacttcctaccgcaatcgtgaataaggatatttttccctgcaaatcgtgcggtatttggtatcggtccgagcgaaatctgcaggctcacctcatgtattattgcagcggacgtcagcgcgaggccgctccggtgagcgaggagaacgaagattcggctcatcagataagctccttatgcccgtttccgcaatgcacaaaatctttttcaaatgcgcgcgccctggagatgcacctgaactctcactccggggtcaagatggaggagtttttgcctccaggagctagcttaaaatgcacggtatgtagctatacagcagattcagtgataaacttccaccagcatttgttcagccaccttacgcaggctgcattcagatgcaatcattgccacttcggttttcagacccaaagggagttgcttcagcaccaggagcttcacgtcccctctgggaagctgccacgtgaatcagacatggaacactcccccagcgccactgaggattccctgcaaccggccactgacctgctcactcgatcagagcttccccaatcccagaaggctatgcaaacaaaggacgcttccagcgacaccgagctcgataagtgcgagaaaaagactcagctctttcttacaaatcagagacctgaaatccagccaaccacaaataaacagagcttctcctataccaagatcaaaagcgaaccaagttccccacgactcgcgtccagccctgtgcaacccaacattggtccatcctttcctgtggggccttttctgagccaatttagcttccctcaggatattaccatggtaccccaggcttcggaaatcctcgccaaaatgtcggagctggttcatcggcggctgagacatggttcatctagttatccacccgtaatctattcccccctaatgccaaagggggctacctgctttgaatgcaacataacatttaacaacctcgacaattatctcgtgcataagaagcactactgttccagtcgttggcagcagatggcgaaatcacctgagttccccagtgtatccgagaagatgcccgaagcactgtcccctaacaccggacagacctcaattaacctactgaaccctgctgcacattcagccgatccggaaaatcccctactgcagacgtcttgtatcaactcctcgacagttctggatctaataggacccaacggcaagggacacgataaagatttttcaacccaaacaaaaaaactgtctacatctagcaacaacgatgacaagatcaacggaaagcccgtcgacgtgaagaatccttctgtgcccctggtggatggggaatctgaccccaataagacaacttgcgaggcatgtaacatcaccttctcaagacatgagacctatatggtacataagcagtattactgcgctaccagacacgatcctcccttaaaaaggagcgcctccaacaaggttcctgccatgcagaggactatgaggaccaggaaacggcggaagatgtacgagatgtgtctaccggagcaggagcaaagaccgccacttgtgcagcaacggttcctggatgtggctaacttaaacaacccatgcacatctacacaggaacctacagaaggactcggggaatgttatcacccgcggtgtgatatctttcctggaatcgtgagtaaacacctcgagacaagcctaacaattaataaatgcgtacctgtgtctaagtgtgataccacgcattcctccgtgagttgcctggagatggacgtgccgatcgatttaagtaagaaatgtctctctcagtccgagcgcacaacaacctctcccaagcgcctcctcgattaccacgagtgcacagtctgcaagatttcattcaacaaagtcgagaattatttggctcacaagcagaatttttgcccggtgactgcgcatcagcgcaatgatctgggacagctagatggcaaagtgttccctaacccagaatccgagcggaacagtcctgatgtgtcctatgaacgatcaattattaagtgtgagaaaaatgggaacttgaaacagcccagtccaaatggcaacttgttttcgagccacttggctacacttcagggtctgaaggtgtttagtgaagccgcacagctgattgccacaaaagaggagaatagacacctttttctgccccagtgcctttaccccggagctataaagaaagctaagggtgctgatcaactgtcaccatattatggtatcaagccttcagattacatctccgggtccctggttattcataacaccgatatagagcaaagccgcaatgcggaaaacgagagtcctaaggggcaggcttcttcaaatggctgtgcagcattaaaaaaagactctctgccgctcctgcccaaaaaccgcggaatggtgatcgtgaacggcgggctaaagcaggatgagaggcctgcagcgaacccacagcaggaaaatatcagtcagaaccctcagcacgaagacgatcacaaatccccttcctggataagtgagaacccactggctgccaatgaaaacgtgtcacctggtatcccatcagcagaagaacagctcagtagcatcgccaaaggagtcaacggctcgagccaggccccaacctctggcaaatactgccgcctgtgtgacatacaattcaataacctttcgaactttataacacacaagaagttctattgttccagtcacgccgcagaacacgtcaagtag

SEQ ID NO: 141654 - DNA, 3060 bp, Artificial Sequence
  Description of Artificial Sequence: Synthetic coding sequence
atggacctgaacaataactctctgaaaacaaaggcccaggtcccaatggtactcacggcaggcccaaaatggctcttggatgtaacttggcagggtgtggaggacaataagaacaactgtatcgtgtatagtaaaggcggccagctgtggtgcacgacaaccaaggccattagcgaaggagaagagctgattgcgtttgtggttgacttcgatagccgcctgcaggccgcatctcagatgactttgaccgaggggatgtacccagctcggctgttagactctattcagttactccctcagcaagcggccatggccagcatccttccaactgccattgtgaacaaggatatcttcccttgtaaatcatgtggcatctggtaccgctcggaacgcaacctgcaggcacaccttatgtattactgctcaggaagacagcgagaagctgcgcccgtttcggaagagaatgaggactcggcacaccagatcagctcactctgtccgttccctcagtgcaccaaatccttttccaacgcccgggctctggagatgcatctgaatagccacagtggcgtgaaaatggaggagtttctccccccgggtgcctccttgaaatgcaccgtgtgctcctatacagctgattcagtcatcaactttcaccaacacttgttttctcacttaactcaagctgcattccgctgcaatcattgtcattttggctttcagactcaacgggagctgctgcagcatcaggagcttcacgtgccgtctgggaagctgccccgggaatcagatatggaacactcgccaagtgcaactgaggatagtctgcagccagccactgaccttctcacaaggagcgaactgccacagagccaaaaagctatgcagaccaaggacgcttcgtcagacacagaactggataaatgtgagaaaaagacccagctgtttctgaccaaccagaggccggagatccagccgacaactaataagcagtctttttcttatacaaagatcaagtccgagccttcttcaccccggctcgcatcctcgcccgttcaaccaaatattggccctagtttccccgtcgggcccttcctctctcagtttagctttcctcaggatattacgatggtgcctcaggcaagtgagatcctggccaagatgtcggagctggttcatcggcggttgagacatggaagctcaagctaccccccagtgatttattctccactgatgcccaaaggcgccacctgttttgaatgtaacattacctttaataacctggacaattacctggtgcacaaaaagcactattgttccagccgatggcagcagatggcaaaatcacccgagttcccaagtgtgtccgagaaaatgcccgaagccctgtcaccaaacacgggtcagacaagcattaacctcctcaaccctgcagcccactcagccgatccagagaatccgctcctacagacgagctgtattaattcctctactgtccttgaccttataggcccgaacggtaaaggacacgacaaagatttcagcacccaaacaaagaaactcagtacttcctccaacaatgatgataaaatcaacggtaaacctgtggacgtgaagaatccttctgttccactcgttgacggcgagtctgaccccaacaaaactacttgcgaagcttgtaatataacattctcccgccacgaaacttatatggtgcataagcagtactactgtgctacaaggcatgacccccctttaaagaggtcagcttcaaataaggtccccgcgatgcagcgcaccatgcggaccaggaagaggcgtaagatgtacgagatgtgtctgcccgagcaggagcagaggccacctctagtccagcagcgattccttgacgtggccaacctcaacaatccatgtacctctacccaggaaccaactgaagggctcggggagtgttatcatcctcgttgcgacatttttcctggaatcgtttccaaacacctggaaacttccctcaccataaacaagtgcgtgcctgtaagcaagtgtgacaccacccactcttctgtgagctgtctggagatggacgtgccaattgacctcagcaagaagtgtttgagccagtctgagcggaccactacctccccaaagaggctcctggattaccacgaatgtacagtttgcaagatatcatttaacaaggttgagaactacctggcacacaagcaaaatttctgccccgtgaccgcacaccagcggaacgacctagggcagctagatgggaaggtgttcccaaatcctgagtcggagagaaactcaccagatgtgagctacgaacgttccatcattaagtgcgaaaagaatggaaacctcaagcaacccagccctaacgggaatctgttctcctcccacttggccacattacaggggctcaaagttttctcagaagcagcccagttaattgcaaccaaggaagaaaacagacacttgtttttgcctcagtgcctctatcctggtgcaattaagaaggcaaaaggggcagatcaactctcgccctattatggcatcaaaccatctgactacatctcaggttctcttgtgatccacaatacagatattgagcagtcgagaaatgctgagaatgagagtccgaagggacaggccagcagtaatgggtgtgctgcgctgaagaaggactccctgccactgctcccaaagaaccgcggcatggtgattgttaatggcgggctaaagcaggatgaaagacccgcggcgaatcctcagcaggagaatatcagtcagaaccctcagcatgaagacgaccacaagagcccttcttggatttctgagaaccctctggctgccaacgagaatgtttccccaggcatcccctcggcggaagaacagttgagctcaatcgcaaaaggagtcaacggatcgagtcaggcacctacttctgggaagtactgcaggctgtgcgacatccagttcaacaacctgtcaaacttcatcactcacaaaaagttctattgctctagtcatgcggcagaacatgtgaagtag

SEQ ID NO: 141655 - DNA, 3060 bp, Artificial Sequence
  Description of Artificial Sequence: Synthetic coding sequence
atggacctcaataataactctctaaagacaaaggcacaggtccccatggttctgacagcgggcccaaagtggctgctggatgtgacttggcagggcgtggaagacaataagaataattgtattgtttattcaaagggcggccagttgtggtgtaccaccacgaaagccatctcagaaggcgaggaactgatcgcttttgtggtggactttgattcccgactacaggcagcatcacagatgaccctgaccgagggaatgtaccccgcaaggctgttggattctatccagttacttccgcagcaggcagcaatggccagtatccttcccaccgccattgtaaacaaagacatttttccatgtaagtcttgtggcatttggtacaggtctgagcggaatctgcaggctcatcttatgtactactgttcagggagacagcgcgaggccgcacccgttagtgaagaaaacgaggattccgcacatcagattagctccctgtgccccttccctcagtgcacaaagtctttcagcaatgctcgggcactcgaaatgcacttgaattcacattcaggagtgaaaatggaggaattcttgccacccggagcaagtctcaagtgtaccgtctgcagctatacggccgactccgtcattaactttcaccaacatctgttcagccacttgactcaggccgcttttcgatgtaaccattgtcattttggctttcagacccagcgcgagctgttacagcaccaggaactgcacgtgccttcaggtaaactgccgcgggaatctgacatggagcattcaccctcagcaacggaggacagtctgcagcccgcaactgacctgcttacacgctctgagctgcctcagtcgcagaaggccatgcagactaaagatgccagctccgacacagagctggataagtgtgaaaagaaaactcagctgtttttaactaaccaacgcccggagattcaacctacaacaaataagcagagcttttcatatacaaagataaagtccgagccctcctcaccaagattggcaagctcccccgttcaacccaatataggtccaagtttcccagtgggaccctttctgtcacaattttcgttccctcaggatatcactatggtgccgcaggcgtcagaaattttggcaaagatgtccgaactcgtccacagacggctgaggcacgggtcatcgtcatacccacccgtgatctactctccactgatgcccaagggtgctacctgttttgaatgcaacatcacattcaataaccttgataactacttggtgcataaaaagcattattgtagttcccggtggcaacagatggccaagtcgccagaattcccttccgtcagcgaaaagatgccggaggctctgagtcccaacaccggacagacgtccatcaatctgttaaatcctgctgcacacagcgctgaccctgaaaatcctctattgcaaacctcttgcatcaacagcagcaccgtcctggacctgatcggccccaatgggaaaggacatgataaagacttctccacccagacaaagaaattaagtacatcttctaacaatgatgataagataaacggaaagcctgtcgatgttaagaaccctagtgttcctctagtcgacggagagagcgacccaaataaaaccacttgcgaagcctgcaacatcaccttctcccgccatgagacgtacatggtccacaagcaatattactgcgctacccgacacgacccacccctgaaaagatccgcatcaaataaggtcccagcaatgcagagaactatgaggacccggaagcggcggaaaatgtacgagatgtgtcttcccgagcaggaacagcggccaccgctggttcagcagaggtttttggatgtggctaatctgaataatccctgcacaagtactcaggaacccacagagggcctgggcgagtgttatcacccccgttgcgacatcttccctggcattgtctccaagcacctcgagacctcgctgaccatcaacaaatgtgttccggtttcaaagtgcgataccacccactccagcgtgtcctgccttgaaatggacgtcccaattgacctctctaaaaagtgtttatcgcagagcgagagaactaccactagccccaagaggctgcttgactaccacgagtgtactgtttgcaaaatctcatttaataaagtagaaaactatctggcccataaacagaacttctgtccagtcaccgcacaccagagaaatgatctcggtcagcttgacggtaaggttttcccaaacccagagagtgagaggaattccccagacgtgtcctacgagagatcaattattaagtgcgagaaaaacgggaacctaaaacagccctcgcccaatggcaacctatttagttcgcatttggccactctgcaggggcttaaagtgttttccgaagccgcacagttgatagccacgaaagaggagaatagacatttgttcctgccacagtgcctataccccggcgcgatcaaaaaagccaagggcgctgatcagttgagcccttattatggcataaagcctagcgactatatttctggctccctggtgatacataacacagatatcgaacagtccaggaatgctgagaacgaatctccaaagggtcaagcttcaagcaacggctgcgccgccctgaaaaaagattctttaccccttctccctaaaaatcgagggatggtgatcgttaatggcggcctcaaacaggatgagaggcctgcagcaaacccgcagcaagagaatatctcgcaaaacccacagcatgaggacgatcacaagtctccatcctggataagcgaaaatcccttagcagccaacgagaacgtctcgcctgggattccctccgcggaggaacagctgtcctcaatagccaaaggggtcaacggatcgagccaagcccctacttctggcaaatattgccggctctgcgacattcagttcaacaatttatccaattttattacacacaagaagttctattgttccagtcatgcggcggaacatgttaagtag

SEQ ID NO: 141656 - DNA, 2418 bp, Artificial Sequence
  Description of Artificial Sequence: Synthetic coding sequence
atggacgaggacggattggaactgcagcaagagcccaattccttcttcgacgccactggggccgacggaacccatatggatggtgaccagatcgtcgtagaagttcaagagacagtcttcgtgtccgatgttgtggatagtgatataaccgtccataactttgtgcccgatgatccagattccgttgttatccaagacgttattgaggatgtggtcatcgaggatgtacaatgcccggacatcatggaggaggccgacgtctccgagaccgtaattattcccgaacaggtactggacagtgatgttactgaggaggtctcactggctcattgtactgtaccggatgacgttcttgccagtgatatcactagtgcttccatgagcatgccagaacatgtgcttaccggcgattccatccacgtttcagacgtcgggcacgttggccacgtaggacatgtcgagcacgtagtgcacgattccgtcgtagaggctgagatagttacagatccactcaccaccgatgtcgtctccgaggaggtgctggttgccgactgtgcctcggaagccgtcatcgacgccaacgggattccggtcgaccagcaagatgacgataaaggaaactgtgaggattacctgatgatttcgctcgacgacgccgggaagattgagcacgacggttccagcggaatgacaatggacaccgagagtgagatcgacccatgtaaggtcgacgggacatgccctgaggttatcaaggtatacatcttcaaggctgaccccggtgaagacgatttgggaggcactgtcgacatcgtagagtcagaaccggaaaatgaccacggcgtggagcttcttgaccagaactcatctatcagggtgcctcgagagaaaatggtttacatgacagttaatgacagccaacccgaagatgaggacctaaatgtcgcggagatcgctgatgaagtttacatggaagtgatcgtcggcgaggaggacgcggcggccgctgccgcagctgccgcagtgcacgagcaacaaatggacgacaacgagataaagacatttatgcctatcgcctgggcagccgcctatggaaataactctgatggcatcgagaatcgaaacggcaccgcgagcgcactgttgcatatcgacgagagtgcaggactcggaaggcttgcaaagcaaaaacctaagaagcggcgaaggcccgattcgcggcaataccaaactgcaattatcattgggccagatgggcaccctctgactgtctatccatgcatgatctgcgggaagaaattcaagtctagggggtttctcaagaggcatatgaagaaccatccagagcatctggccaaaaagaagtaccggtgcacggattgtgactatacaactaacaagaagatcagtcttcataaccacctcgagtctcacaagctgaccagtaaggccgagaaggctatcgaatgtgacgaatgtgggaagcacttcagccacgccggggctctgttcacacacaaaatggtgcacaaggagaagggtgcaaataagatgcacaaatgcaaattctgcgaatatgaaacagcagaacagggcttgctgaacagacacctgctggcagtgcatagtaagaattttccgcatatctgcgttgaatgtggcaaagggtttagacacccctctgaattgaaaaagcacatgaggattcatacaggcgagaagccctaccaatgccagtactgcgaatatcggagcgccgattcttctaatctgaaaacccacgtcaaaactaagcacagtaaagagatgccttttaaatgtgacatctgcctgctcacattctccgacaccaaagaggtgcagcagcatgcgttaattcaccaggaatctaaaactcatcagtgcctgcactgtgaccataagtcgtccaattcatctgacctgaagagacacataatttccgttcacactaaggactatccacacaagtgtgacatgtgcgataaaggttttcatagaccctcagaattaaagaaacacgtcgccgcccacaaggggaagaaaatgcatcagtgtcgccactgtgattttaagatcgcggatccattcgtgctgtcaagacacatactgtctgtgcataccaaggacctgccttttaggtgtaagaggtgccgaaaaggatttcggcaacagagcgagttaaaaaagcacatgaagacgcactcaggacgaaaggtgtaccagtgtgagtattgtgagtatagcaccacggatgcctcggggttcaaaagacacgtgatcagtattcacaccaaggattacccacacaggtgcgagtactgtaagaaaggcttccggaggccgtccgagaaaaaccagcacatcatgcgacatcacaaggaggtaggattgccctag

SEQ ID NO: 141657 - DNA, 2268 bp, Artificial Sequence
  Description of Artificial Sequence: Synthetic coding sequence
atggatgaagatggactggagctacagcaggaaccaaatagctttttcgacgccacaggggcagacggcacccatatggacggggaccagatagtcgtagaagtgcaggaaacagtctttgtgagtgatgtcgttgactcagacatcacagttcacaacttcgttccagacgaccctgattccgtggtgattcaggacgtaatcgaggatgttgtgatcgaagacgtgcagtgcccagacatcatggaggaggccgacgtctcagagacagtgattatacctgagcaggtcctcgattctgatgtgactgaggaagtgtctctggctcattgtactgtgccagatgatgtgctcgctagtgacatcacctctgcttctatgagcatgcctgaacatgttttgacaggtgattccatccacgtaagcgatgtgggccacgtaggtcacgttgggcacgtcgagcatgtcgtccacgactccgttgttgaggcggagatcgttactgatccactgaccaccgacgtggtttcagaggaagtgctggtcgcagactgtgcttccgaggctgtcattgatgccaacggcatcccagtcgaccaacaggacgacgataagggcaactgtgaggactatctgatgattagctgcggtaccgtcgacattgttgagtcggagccagaaaatgatcatggcgtagagttgctggatcagaacagtagcatccgtgtgcctagggaaaagatggtctacatgacagttaatgattcgcagcccgaggatgaagatctcaatgtagcagaaattgccgacgaggtgtatatggaagtaattgttggagaggaggacgccgcagccgccgccgctgcggcagcagtacatgagcaacagatggacgacaatgagatcaaaaccttcatgcctatcgcctgggcagccgcttacgggaacaatagcgatgggatcgaaaatcgcaacggcacagcgagtgcattactgcacattgatgagagcgccgggctcggtaggttagccaaacaaaagcctaagaaacggcggaggccagactctcgtcagtaccagacagccataattatagggccagacggccaccctttgaccgtttacccgtgcatgatttgtggcaaaaaattcaagagccggggctttttgaagcgtcacatgaaaaatcaccctgagcatttggctaagaaaaaatataggtgcaccgactgcgattacacgaccaacaaaaagatctctctccacaaccacctggagtcacacaaattaacttctaaggctgagaaagctattgaatgcgacgaatgtgggaaacacttttcacacgcgggggcattgttcacccataagatggttcacaaggagaagggggctaataagatgcataaatgcaagttttgcgagtacgagaccgctgagcagggactgctgaataggcatcttctagccgtgcattccaaaaacttccctcatatctgtgtcgaatgtggcaagggatttagacaccccagtgaactcaaaaagcatatgaggatccatactggagagaaaccgtaccagtgccaatactgcgagtacagatctgccgattcctcaaatctgaagacccacgtgaagaccaagcactccaaagaaatgcccttcaaatgcgacatttgtttattaacgttttcggacacaaaggaggttcaacagcacgcactgatccaccaggaaagtaagacacaccagtgcctgcactgcgatcataaaagtagtaattcttccgatctaaaacgtcacatcattagcgtgcatacgaaggattacccacacaagtgcgatatgtgcgataaaggcttccacaggccaagcgagctcaagaaacatgtcgccgcccataagggcaaaaagatgcaccagtgtagacactgtgacttcaagatagccgaccctttcgtactgtcacggcatatattgtccgttcatactaaggatttaccctttagatgtaaaaggtgccgcaaagggtttcgtcaacaatctgaactgaagaagcacatgaagacccactctgggcggaaggtctaccagtgtgagtattgtgagtattctacgaccgatgccagtgggttcaagcgccacgtgatttcaatccacactaaagactatcctcaccgctgcgaatactgtaagaaaggttttcgaaggccttctgaaaaaaatcagcacataatgcgccatcataaggaagtgggcctgccctag

SEQ ID NO: 141658 - DNA, 2418 bp, Artificial Sequence
  Description of Artificial Sequence: Synthetic coding sequence
atggatgaggacggtctcgagctccagcaggagccaaatagctttttcgacgctactggagccgacggcactcacatggatggcgatcaaattgtcgtggaggtgcaagaaactgtgtttgtctccgatgtagtggactcagatatcacagtgcataattttgtgccagatgacccagacagcgtggtgatacaggacgtgatcgaggacgtggtgatcgaagacgttcagtgtccagatatcatggaagaggccgacgtctcagagactgtgatcattccagagcaagtgttagacagcgacgtcaccgaggaggtaagcctcgcccactgcactgtgcctgacgacgttcttgcgagcgacattactagcgcttctatgagtatgcccgaacatgtgttaaccggggattccattcacgtcagcgatgtagggcacgtggggcatgtgggacacgtggagcatgtggtacatgacagcgtagtggaagcggaaatagtcaccgaccctctgaccactgacgtagtgagtgaagaagtgttggtcgccgattgcgccagtgaagccgtcatagatgctaatggcatacctgttgaccaacaggacgatgataagggcaactgtgaagactatctgatgatctctctggacgacgctggcaagattgagcatgacgggtcttctggcatgacaatggacactgaaagcgagatcgacccgtgcaaagtagacgggacctgtcccgaggtcattaaagtgtatattttcaaggccgaccccggagaagatgatcttggcgggaccgtagatatcgtcgagtccgagcccgagaatgaccatggagttgagctgttggatcagaactcatctattagagtgccccgcgagaaaatggtctatatgaccgtcaacgactcccagccagaggacgaagaccttaatgtggcagagattgccgatgaagtctatatggaggtgatcgttggggaggaagacgctgccgcagcagcggccgccgctgccgttcatgaacagcagatggacgataacgaaatcaagacattcatgcctatagcctgggccgccgcctacggcaataactcagacggcattgaaaatagaaacggtaccgcctcagctcttcttcacattgatgaatctgcagggctcggcaggcttgcaaagcagaagccgaaaaaacggagacgacccgactcaagacagtatcaaactgccatcatcatcggacccgatgggcaccccttgacggtatacccatgcatgatctgcggcaagaaatttaagtcaagagggtttttgaaacggcatatgaagaatcatcctgaacacctggccaaaaaaaaatatcggtgcaccgactgcgattacacaacaaataagaaaatcagtttgcacaatcaccttgaaagtcacaaactcacatccaaggcagagaaggctattgagtgtgacgaatgtggaaagcatttctcacacgctggagccctgttcacacacaaaatggtccacaaggagaaaggagctaataagatgcacaaatgtaagttttgcgagtacgagaccgccgaacaggggctactgaatagacacctgctagcggtccatagcaagaattttccacatatttgtgtcgagtgtggtaaggggtttcggcatccctcagaactgaagaaacatatgaggatccacaccggggagaagccttaccaatgccagtactgtgaataccgaagtgccgactccagtaacctgaagacacacgtgaagacgaaacattccaaagagatgccatttaagtgtgacatctgcctcctgaccttttcagacaccaaggaggttcagcagcatgcactgatccaccaagaatctaagactcaccagtgtctgcactgtgatcacaagagcagtaattctagcgacttgaagcgccacatcatatcggtccataccaaggactacccccacaagtgcgatatgtgtgacaaaggctttcaccggccctccgaactgaaaaaacatgtggcagcccacaagggtaagaagatgcaccagtgtcggcactgtgatttcaaaattgctgaccccttcgtgctgtccagacatatcctttctgtacacaccaaagatctgcccttcaggtgtaaacgatgtaggaaagggttccggcagcagtctgaactcaaaaagcacatgaaaacacactccgggagaaaggtgtaccaatgtgaatattgtgaatattctactacagacgcatccggcttcaagcgccatgtgatctccatccatacaaaggactaccctcaccggtgtgaatattgtaaaaagggtttccgtcgcccgtcagagaagaatcagcatataatgagacatcacaaagaggttgggctcccatag

SEQ ID NO: 141659 - DNA, 2418 bp, Artificial Sequence
  Description of Artificial Sequence: Synthetic coding sequence
atggatgaggatggactggagctgcagcaagaacctaattcgttcttcgacgcaactggagcagacggtacccatatggatggggaccagattgttgtggaggtacaggagaccgtgtttgtgtccgacgtggtggattccgatattaccgtgcacaattttgtgcccgacgatcccgacagcgtagtgatccaggacgtaattgaagacgtcgttatcgaggatgttcagtgcccggatatcatggaggaagctgatgtcagcgaaacagtgataatcccggagcaagtattagactccgacgtgaccgaggaggtgtcccttgcccattgtaccgttccagacgacgtcctggcctctgatatcacgagcgcgtccatgtccatgcccgaacatgttctgacaggtgattccattcacgtgagcgacgttggccatgtggggcacgttgggcacgtcgagcacgtcgttcacgactccgtcgtcgaggccgagattgtgacagatcctctgacaactgacgtggtctccgaagaggttttagtagccgactgcgcaagcgaagccgttattgatgctaatggtatccccgtggaccagcaggatgatgataaagggaactgcgaagactacttaatgatttctcttgacgatgccggcaaaatcgagcacgatggcagttctggcatgactatggataccgagtcagaaattgacccttgtaaagtggatgggacctgccctgaggtgataaaggtttacatttttaaggcggatcctggcgaagacgatctcggcggcactgttgatatcgtggagtcggagcctgaaaatgaccatggcgtcgaacttctggaccagaactcatcgattagagtgcctagggagaagatggtgtacatgacagttaacgattcacagcccgaggacgaggatttgaatgtggcggagattgcggatgaggtgtatatggaagtgattgtgggtgaggaggacgctgctgctgctgctgcagctgcagctgtccatgagcaacagatggacgataatgaaattaagactttcatgcctatcgcctgggcagcagcttatgggaacaattccgacggaatcgaaaatcgcaatgggaccgcatccgcactgctccacattgatgaatctgctggccttggacgtttggcaaagcaaaagccaaaaaaacggcgtagacccgacagccggcagtatcagactgccataattatcggtcctgacggccatccactgactgtctatccatgtatgatctgtggtaagaagtttaagtcccggggattcttgaaaaggcacatgaagaaccaccctgagcacttagctaagaaaaagtatagatgcacagattgtgactacacaactaacaaaaagatttcactgcacaatcatctggagagtcataagctgacatcaaaggccgagaaggccattgagtgcgacgagtgtggcaagcactttagccacgccggtgccctgttcacgcacaaaatggtacataaggaaaagggtgccaataagatgcacaagtgcaaattctgcgaatacgagaccgccgaacagggactgctgaatcgtcatctgcttgcagttcatagcaaaaatttcccccacatctgcgttgagtgtggaaaagggtttagacacccaagcgaattgaagaagcacatgcggatacacaccggtgagaaaccatatcagtgtcagtattgcgagtaccgatccgcagatagcagcaacttaaagacacacgtgaaaaccaagcatagcaaagagatgcctttcaagtgtgatatttgtcttcttactttcagcgatactaaagaagtgcagcaacacgctttgatccatcaagaaagcaagacacaccagtgcctgcactgcgaccataaatcttctaattcttctgacctgaagagacacattatttccgtacacactaaggattacccccacaagtgcgacatgtgtgacaagggattccatcgcccttctgaactcaaaaaacatgttgccgcacacaagggcaagaaaatgcatcagtgtcggcactgcgacttcaagattgcagacccatttgtgctctccagacacattctgtccgtgcacacaaaagatttgcctttcaggtgcaagaggtgtagaaaaggttttaggcaacaaagcgaattaaagaaacacatgaagactcacagcgggaggaaagtttatcaatgcgagtattgcgagtatagcactactgacgccagcggttttaagagacatgtcatttctattcacacgaaggactacccacaccgttgtgagtactgcaagaaaggcttccgacgccctagcgaaaagaaccagcacatcatgcgacaccataaggaggtgggcctcccctag

SEQ ID NO: 141660 - DNA, 99 bp, Artificial Sequence
  Description of Artificial Sequence: Synthetic coding sequence
atggacgaggatggactggagttacagcaggagcctaactcttttttcgacgctacaggggctgacggcacacacatggacggcgaccagattgtatag

SEQ ID NO: 141661 - DNA, 408 bp, Artificial Sequence
  Description of Artificial Sequence: Synthetic coding sequence
atggatgaagatgggttggagctgcagcaagagcctaattctttttttgacgccaccggcgccgatggcactcacatggatggggatcagatagtcgtggaagtacaggagaccgtctttgtgagcgacgtagttgactccgacatcacagtgcataactttgtccccgatgaccccgattcagtggtgatacaggatgtgatcgaggatgtggtgatcgaggacgttcagtgcccagacattatggaggaggccgatgttagcgagacagtgataattcctgagcaagtactggattctgacgtgactgaagaggtgtcccttgcacattgtacggtaccggatgatgtgctcgctagcgacatcacttctgcctccatgtctatgcccgagcatgttctgacatag

SEQ ID NO: 141662 - DNA, 1584 bp, Artificial Sequence
  Description of Artificial Sequence: Synthetic coding sequence
atggacacggagtcagagattgatccgtgtaaagtcgatgggacctgccccgaagtgattaaggtgtacatctttaaagctgaccctggagaagacgacctgggcggaaccgttgacatcgtcgagagtgaaccagagaacgaccatggggttgagctcctggaccagaactcctccatacgggttccaagggagaaaatggtctatatgacagtgaacgattcgcagccagaagacgaggatctcaacgttgccgagatcgccgatgaggtctacatggaagtgattgtgggcgaggaagatgcagccgccgccgctgcagccgccgctgtgcatgagcagcaaatggatgacaatgagattaagactttcatgcccatcgcctgggcagcagcttacgctataattatcgggcctgatggccatcctttgacagtgtacccctgcatgatctgtggcaagaagtttaaatcaaggggattcctcaagaggcacatgaagaaccaccctgaacaccttgcgaagaagaagtaccgatgtactgattgtgattatacaacgaacaaaaagatttccctccacaatcatcttgaatctcacaaattgacgagcaaggctgaaaaggctatcgagtgtgacgagtgtggaaaacacttttctcacgccggggctttgtttacacacaaaatggtgcataaagagaagggggcaaacaagatgcacaaatgtaaattctgcgagtacgagacagcggagcagggtctgttaaacagacacctcctggctgtgcactctaagaattttccccacatttgtgttgaatgtggcaaaggcttccgtcatccttccgaactcaaaaagcatatgcgcattcacacaggcgaaaaaccataccagtgccaatactgcgaatataggtccgcagacagtagcaatctcaaaacacatgttaaaacaaaacactctaaggaaatgcccttcaagtgcgatatttgtctgctcacctttagcgatactaaagaggtccagcaacacgcactgatccatcaggaaagcaagacccaccagtgcctccattgtgatcacaaaagctcaaacagcagtgatctgaagcggcatatcattagtgtacacactaaagactaccctcataagtgcgatatgtgcgacaagggtttccacaggccgagcgagctgaaaaagcacgttgcagctcataagggtaagaagatgcaccagtgcaggcattgtgatttcaaaatcgcggacccctttgtgttgtccagacacattctgtcggttcacacgaaggacctacccttccgttgtaaaaggtgtaggaagggctttcgccagcagtcagaattgaaaaagcacatgaaaactcattcggggaggaaggtttaccaatgcgagtattgcgagtattctacaaccgacgctagcggattcaaacggcatgtcatttccatccacacaaaggattacccccatcggtgcgaatattgcaaaaagggcttcagaaggcctagtgagaagaatcagcacatcatgcggcatcacaaggaggttggcctgccctag

SEQ ID NO: 141663 - DNA, 789 bp, Artificial Sequence
  Description of Artificial Sequence: Synthetic coding sequence
atggacgaagatggcttagagctgcaacaggaaccaaacagtttttttgatgcgacaggtgccgacggaactcacatggatggtgatcaaatcgtggtggaggtacaggaaaccgtcttcgtgtcagacgttgtggactctgacatcacggtgcacaattttgtgcccgatgaccctgatagtgtagtaatacaagatgtcatagaagatgtggtcatagaagatgttcaatgtccagacataatggaggaagcagacgtatcggaaaccgtcattattccggagcaggttctcgacagcgacgtcaccgaggaggtatccctcgctcattgtactgtacctgatgacgtgttagcttctgacattaccagcgcaagtatgtcaatgcccgagcatgtcctcactggcgatagcatccatgtttcagatgttggacatgtggggcacgtcggacacgtggaacatgttgtccatgactctgttgtcgaagcggagatagtgaccgatccattgactactgacgtcgtgtccgaggaagtgctcgtcgctgactgcgcatctgaggctgtgatagatgccaacggcatcccggtggaccagcaggacgacgataagggcaactgtgaagactatctgatgatcagttgcaataatagtgacggtatcgagaataggaatgggaccgcaagcgcccttctccatattgacgaatcggctgggctgggtcggctcgctaagcaaaaaccaaagaagagaaggagacctgatagtcgccagtatcagacttag

SEQ ID NO: 141664 - DNA, 1731 bp, Artificial Sequence
  Description of Artificial Sequence: Synthetic coding sequence
atgaccatggacacagaatcggaaattgatccatgtaaagtggacggaacctgtcccgaggtaatcaaagtgtatatattcaaggctgacccgggtgaggatgaccttggtggaaccgttgacatcgtcgagtccgagccagagaatgatcatggagttgagctgcttgatcagaattcctccatcagggtccccagagagaaaatggtttatatgactgttaatgacagccaacccgaggatgaggatctgaacgttgccgagatcgccgacgaagtctatatggaggtgatcgtgggggaagaggacgcagcagcggccgccgccgccgctgccgttcacgaacagcagatggatgacaacgagatcaagaccttcatgccaattgcatgggcggcagcgtacgggaacaacagcgatgggattgaaaaccgaaacggcacagcatctgctctccttcatatagatgagtccgctgggctagggcggctggcaaaacagaagccaaaaaagcgacgaaggcctgactcccggcagtatcagactgctattatcattgggcccgatggacaccccctgaccgtgtacccgtgcatgatctgcggaaagaagttcaaaagccgggggttcttgaaacggcacatgaagaaccaccccgagcaccttgccaagaagaagtaccgctgcacagattgcgactacaccactaacaagaaaatttccctgcacaatcacctggaatctcacaaactcacatccaaagccgaaaaagccatcgagtgtgacgagtgcgggaaacatttctcgcatgccggcgctttgtttacacacaagatggtacacaaagagaagggtgctaataagatgcataaatgcaaattttgcgaatatgaaaccgccgagcagggcctccttaatcggcatctcctagcagttcactccaagaatttcccccacatctgcgtggaatgcgggaagggatttcggcaccccagtgaattaaagaaacatatgaggattcacaccggcgagaagccgtatcaatgccagtattgcgaatatagaagtgctgacagtagcaacctgaaaacccatgtgaagaccaaacatagcaaggaaatgcccttcaagtgcgacatatgtctgctgaccttctcggacactaaggaggtacagcagcacgctcttattcaccaggagagcaagacgcatcagtgtctgcattgtgaccacaagtcctcaaactcatccgatctgaaaaggcacattatctctgtccataccaaggactaccctcacaagtgtgacatgtgcgataagggctttcaccggccgtccgagctgaaaaagcacgtagcggcccacaaaggaaagaagatgcatcagtgcaggcactgtgattttaaaattgcagatccctttgtcctgagtcgccacatactgtctgtgcataccaaggacttgccatttcggtgtaagagatgtagaaaagggtttagacagcagtccgagctcaaaaagcatatgaagacacatagcggcagaaaggtataccaatgtgaatactgtgagtacagcacgaccgacgcatctggcttcaagcggcatgtgatatcaattcataccaaagattatccacacagatgtgaatattgtaagaagggattccgtcgtccttcagaaaaaaatcagcatatcatgcgccatcataaagaagtgggtctgccctag

SEQ ID NO: 141665 - DNA, 2535 bp, Artificial Sequence
  Description of Artificial Sequence: Synthetic coding sequence
atggacgaggacggactggaactacagcaggagcccaacagctttttcgatgccaccgatcgggtgagcttctgccatcccgggtggtccaccgtggctccctccggaagcactgctacgtccgccagtcaggcccaggtgatttgctctgcgagccgcgttaccggagcaaccggagctgatggaacacacatggacggcgatcagatcgtcgtggaggtccaggagacagtgttcgtgagtgatgtcgttgactccgacataaccgtgcacaacttcgttcccgacgacccagacagcgtggtgatccaggacgtcatagaggacgtcgtgatcgaggacgttcaatgtcctgacattatggaggaggcggatgtgagcgagactgtgatcatccccgagcaggttcttgacagcgacgtaacagaagaggtttcactcgcacattgcaccgttcccgatgacgtgctcgccagcgatataacctcagcaagtatgtctatgcccgagcatgtgctgacaggggactcaatccatgtcagcgacgtcggccatgttggtcatgtcggtcacgtagaacacgttgtgcacgattctgtagtggaagccgagatcgtaaccgatcccttgaccaccgacgtagtttccgaagaggtgcttgtggcagattgcgcgtcagaagcagtaattgatgcaaatgggatccctgtagatcagcaggatgatgataaaggaaattgtgaggattatctgatgatttctctggacgacgctggcaaaattgagcatgacgggagttccgggatgactatggatacagagtcagaaattgacccttgcaaagtggatgggacatgccctgaggtgatcaaggtttatatttttaaggcagatccgggagaagatgatctcgggggaactgtggacatcgtggaaagcgagcccgagaacgaccacggtgtggaactgcttgaccagaatagttctattcgcgttccaagggagaaaatggtgtatatgacagtgaacgacagccagcccgaggacgaagatctcaacgtcgcagagatagcagacgaagtttatatggaagtcattgtgggggaagaggacgcggcagccgctgctgccgccgcagccgtgcacgagcagcaaatggatgataacgaaatcaaaaccttcatgcctatcgcttgggctgcggcatacggcaataattcagatggcattgagaataggaatggaaccgcgtccgccctcctgcatattgacgaaagcgcaggtcttgggagactggccaaacagaagccaaagaagaggagacggcctgattctaggcagtaccagactgcaatcatcatcggccctgacggccatcccctgacggtctacccttgtatgatctgcgggaagaaatttaagagccgagggtttcttaagaggcatatgaagaaccatccagagcatcttgccaagaagaaataccggtgcactgactgcgactacacaactaacaaaaagatttcgttgcacaatcacctggagtcccataagttaactagcaaggcggaaaaagcaatcgaatgtgatgaatgtgggaagcacttttctcatgcaggagccctgttcacgcacaagatggttcacaaagagaaaggcgcaaataagatgcataagtgcaaattttgcgaatacgaaacagccgagcagggtctgcttaatcgacatctgctcgccgtgcacagtaagaacttcccccatatttgcgtggagtgcggtaaaggcttccggcacccttccgaattgaaaaaacacatgagaatccatactggcgagaagccatatcaatgccaatactgcgagtaccgcagcgcagattcgtccaatctgaaaacacacgtcaagacgaaacacagcaaagagatgccctttaagtgcgatatctgtctgttaactttttctgatacaaaagaagttcagcagcatgccttgatccatcaggagtctaaaacacatcagtgtctgcactgcgatcacaaatcctccaactcatccgaccttaagagacacatcatttccgttcatacaaaggattacccccataagtgcgatatgtgcgacaaaggctttcaccgtccttctgagctaaaaaagcatgtggctgcacacaaggggaaaaaaatgcaccagtgtagacattgcgactttaaaatcgccgatccattcgttttgagtcgacatatcctgtctgtgcacacaaaagatctgcccttcaggtgcaagcgttgtagaaaaggcttcaggcagcaatcagaactcaaaaagcatatgaagacacatagcggcagaaaagtgtatcagtgcgaatactgcgagtactctacaaccgatgcatctgggtttaagcggcacgtgatttccatccacaccaaagattatccccatcgctgcgagtattgtaagaagggcttcagacgtccatctgagaagaaccagcacattatgagacaccacaaggaagtcggactaccttag

SEQ ID NO: 141666 - DNA, 522 bp, Artificial Sequence
  Description of Artificial Sequence: Synthetic coding sequence
ggaggctgttcccaatacttacttttgttcgtggatgacgccggcaagatcgaacacgacggctcgtccggaatgaccatggacacggaatccgaaatcgacccctgtaaggttgacggtacatgccctgaagtgatcaaagtttacatcttcaaggctgatcccggggaagacgaccttggaggcacagtggatatcgtcgaaagtgaaccggagaacgaccatggcgtcgagctgctcgaccagaacagcagtatcagagttccgagagagaagatggtatacatgacagtcaacgacagccaacccgaggatgaggatttgaatgtggcggagatcgctgatgaggtctacatggaggtgatcgtgggcgaggaagatgccgcagccgcagcggcagccgccgcagtccacgagcagcaaatggacgataatgaaatcaaaacctttatgccaattgcctgggccgccgcttacgggaacaactcagacggcattgagaatcgcaacgggacggcatag

SEQ ID NO: 141667 - DNA, 2406 bp, Artificial Sequence
  Description of Artificial Sequence: Synthetic coding sequence
atggacgaagatgagttcgagcttcaaccacaggaacccaactcattctttgatggtataggtgctgatgccacgcacatggatggcgatcaaatcgttgtcgaaattcaggaggccgttttcgtctcgaatatcgttgatagtgatatcaccgtgcacaacttcgtgcccgacgaccctgattccgtcgtgatacaggatgtggtggaagatgtcgtgatcgaagaagatgtacaatgctctgatatcctggaagaggccgatgtgagcgagaacgtcataattcccgagcaagtcttggacagcgacgtgactgaggaagtctctctcccacactgcactgttccagacgatgtcttggcaagcgatattacaagcacgagcatgtccatgcccgagcacgtacttacttccgagagcatgcacgtatgtgacataggacatgtcgagcacatggtgcacgatagcgtcgtggaagccgagattatcacagacccccttacttctgatattgtgtctgaggaagtgcttgtcgccgactgcgcacctgaagcagtgatcgacgcaagtgggatctccgtagaccagcaggataacgacaaagcctcctgcgaggactacctgatgatctcgctggatgacgctggaaagatcgagcatgacgggtctacaggagtgaccatcgatgctgagtccgaaatggacccctgcaaggtcgatagcacctgtcctgaggttatcaaagtgtacatctttaaggcagatccaggtgaggatgatctgggcggaacggtcgacatcgttgagtccgagccagagaatgatcatggcgtggaactgctcgaccagaattctagcattagggtgcccagggagaagatggtctacatgacggtgaatgacagtcagcaggaggacgaagacctgaacgtggctgagatagcagatgaagtgtacatggaagtgattgtcggtgaggaagacgcagccgtagccgcagctgcagctgccgtgcacgagcagcagattgacgaagatgaaatgaaaacattcgtcccaatcgcgtgggcagctgcgtacggaaacaatagtgatggaatcgagaaccggaacggaaccgcaagcgccctattacatattgatgaatcagccggcttgggcaggctggctaaacagaagccaaagaaaaagagacgacctgatagtcgccagtaccagaccgctattatcattggcccagatggccaccccctgaccgtgtacccttgtatgatctgcggaaagaaattcaagtcacgagggttcttaaagaggcacatgaaaaaccatccagaacatctggcgaagaagaaataccactgtacagactgcgattataccaccaacaaaaaaatcagccttcacaatcatttggagtctcacaagctcacctctaaagccgaaaaagctatcgaatgcgacgaatgcggcaaacacttcagtcacgccggagctctgttcacccacaagatggtacacaaagagaagggagcaaataagatgcacaaatgtaaattttgtgaatatgaaactgccgagcagggcctgctgaatagacacctgctcgcagtccactccaagaattttccacacatctgcgtggaatgcgggaagggcttcaggcaccctagcgaactaagaaaacacatgcgcatccataccggtgagaagccctatcaatgtcagtattgtgagtacaggtcggcagactcctcaaatctgaagacacatatcaagacaaagcacagcaaggaaatgccctttaaatgtgatatctgtctcctgaccttttctgacacaaaggaggtccagcagcacacgttagtgcaccaggaaagcaaaacccaccagtgtttacactgcgaccataagtccagtaactcctctgaccttaaaagacatgttatctcagttcatactaaggactacccacataaatgcgaaatgtgtgaaaaaggatttcatagaccctctgaactgaagaaacatgtggccgtgcacaaggggaaaaagatgcaccaatgtaggcactgtgatttcaagatcgcggacccttttgtgctgtctcgccatattctgagtgttcataccaaagacttgccattcaggtgcaagcgatgtcgcaagggctttcgccaacaaaatgaacttaagaagcatatgaagacccactccggcagaaaggtgtatcagtgcgagtattgcgagtacagtacgaccgatgcctcagggttcaaacgtcatgtcatttctattcacaccaaagattatcctcacagatgtgagtattgtaagaaggggttccggaggccgagcgaaaagaatcagcacattatgagacaccataaggaagttggcttaccctag

SEQ ID NO: 141668 - DNA, 2406 bp, Artificial Sequence
  Description of Artificial Sequence: Synthetic coding sequence
atggatgaggatgaatttgagctccagccccaggagccaaacagcttttttgacgggataggagctgatgccacgcacatggacggcgaccagatcgtcgtggaaatccaagaggctgtctttgtcagtaacatagtcgactctgacatcacagtgcacaactttgtacccgatgaccctgactccgtcgtgatccaggatgtggttgaagacgttgttatcgaggaggatgtgcagtgctctgatattctggaagaagcagacgtgtcagagaatgtgatcatccctgaacaagtactggattcagacgtcactgaggaggtgtctctcccccactgcaccgttcccgacgacgttctggcttcagatatcacctcaacaagcatgtccatgccagagcacgtgctgacttcagaaagcatgcacgtgtgtgacatcggccacgtcgaacacatggttcatgattcagtggttgaggccgaaattattacagaccctctcacctctgatatagtgtccgaggaggtcctcgtggcggattgtgcaccagaggcagtgatcgacgcatctgggattagcgtcgatcagcaggacaacgacaaggccagctgtgaggattatttgatgataagcctggacgacgcaggaaagatcgagcacgatggatcgactggtgtcacaatcgacgccgagtccgagatggatccatgtaaagtagattccacttgtccagaggtgatcaaagtttatatattcaaggccgatccaggggaggacgacctcggcggcacagtggacatagtagagagcgagcctgagaacgaccatggggtggagctgctggatcagaattccagtatccgtgtacctcgcgaaaagatggtctatatgactgttaacgacagccagcaagaagacgaagacctaaacgtggccgaaatcgccgatgaagtgtatatggaagtgatcgtgggtgaggaagacgccgccgtcgccgctgcagccgcagccgtgcacgaacagcagattgacgaagatgaaatgaaaacatttgttcctatcgcgtgggccgccgcttatggaaataattccgacggcatcgagaaccgaaacgggactgcttcagctttactacacatagatgagagcgctggcttggggagattagctaagcagaaaccaaaaaagaagcgtagacccgattcacggcaataccagacggctatcattatcgggcctgatgggcatcccctgacagtttacccttgcatgatctgcgggaagaagtttaaatcacgaggtttcctgaaaaggcacatgaaaaaccatccggagcacctcgccaaaaagaagtatcactgcactgactgcgattacacgaccaataagaagatatccctccacaaccacttggagagccacaagctgaccagcaaagctgagaaggctatagagtgcgatgagtgcggaaaacacttttcccatgcaggcgctctttttactcacaagatggtgcataaagagaaaggtgccaacaagatgcacaaatgcaaattctgtgaatacgaaactgcagaacagggcctgctcaacagacaccttctcgcggtgcactccaaaaacttcccccacatctgcgtggaatgcggaaagggattccggcaccctagtgagctgaggaagcatatgcgcatccacactggagagaaaccctatcagtgccagtattgtgaataccggtctgccgattcaagtaatctgaagacccacataaaaactaaacattctaaggagatgccattcaagtgcgacatttgcctgctcactttctcagacaccaaagaagtacagcagcatacccttgtccatcaggagagcaagacacaccagtgcctgcattgcgatcataagtctagtaattcatctgacctgaaaagacatgtgattagcgtccataccaaggattacccacacaagtgcgaaatgtgcgagaagggatttcaccgcccatccgagctgaagaagcacgtggccgtgcacaaagggaagaaaatgcaccagtgtaggcactgcgattttaagattgcggacccttttgtgctgagtcggcatattttgagcgtgcataccaaggatctgcctttcagatgcaaaagatgtcgaaagggcttccgccaacagaatgaacttaaaaaacatatgaagactcactctggacgtaaagtgtatcagtgcgaatactgtgagtactccactacggatgcctcagggtttaagaggcacgtcatctctatccacacaaaggactacccgcatagatgtgaatattgtaaaaagggcttccggcggccatcggaaaagaatcagcacataatgcggcaccacaaggaagtcggcctaccttag

SEQ ID NO: 141669 - DNA, 1833 bp, Artificial Sequence
  Description of Artificial Sequence: Synthetic coding sequence
atggatgaagatgagttcgaactccagccccaggaacctaactccttcttcgatgggatcgttgatgatgctggaaagatcgaacatgatggatcaaccggggtaactatcgatgccgagtccgaaatggacccatgtaaggtcgattccacgtgccccgaagtgatcaaggtatacatattcaaggccgaccctggtgaggatgatctgggaggcacagtcgatattgtggagtcggaacccgagaacgatcacggagtggaattattagatcaaaattcatcaatcagggtgcctcgcgaaaagatggtctatatgactgtcaacgactctcaacaggaagacgaagatctaaacgtggcggaaatagccgacgaagtctacatggaagtaatagtgggcgaggaagatgcagctgtcgccgcggcagccgctgccgtgcacgaacagcagatcgatgaggacgagatgaaaacatttgtgcccatcgcttgggccgcagcttacgggaacaactccgatggaatcgagaacagaaatggaacagcatccgccctgctccatatcgatgagtccgcaggactcggccgccttgctaagcaaaaacccaagaagaagagacgccccgattcaagacagtatcaaaccgcaataatcataggacctgatgggcatccacttactgtatacccttgtatgatctgcgggaagaaattcaagtcccggggattcctcaaaaggcatatgaagaaccacccggaacacctcgcaaagaagaagtatcactgtaccgattgtgattatacaactaacaaaaagatctccctgcataaccacttagagagccataaactgacaagcaaggctgaaaaggccatcgagtgtgacgaatgcggtaagcacttttctcacgcaggggcactgtttactcacaaaatggtgcacaaggaaaagggggcgaacaagatgcataagtgtaagttttgtgagtacgagacagcagagcaggggctactcaaccgccatctgttggcagtccattccaagaacttcccacatatctgtgtggagtgcggaaaaggatttaggcacccttcagaattaaggaagcatatgagaatccacacgggggaaaaaccataccagtgccaatattgtgagtaccgctccgccgattcatccaacctgaagacacacatcaaaaccaagcattcaaaagagatgccattcaaatgcgatatctgtctgctaaccttttctgacaccaaagaggttcagcaacatacgctcgtgcaccaggaatccaaaacccaccagtgcctgcactgcgatcacaaatcttccaatagcagcgacctgaagaggcacgtcatatctgttcacacaaaagattatccccataagtgcgaaatgtgcgagaaaggtttccacaggcccagtgagctgaaaaagcatgtcgccgttcacaagggtaagaagatgcaccaatgtaggcactgcgactttaaaatagctgatccttttgttctatctaggcacatcctttccgtgcataccaaggatctgccattcagatgtaaaaggtgcagaaaggggtttcgccagcagaacgagttaaaaaagcacatgaaaacgcacagcgggagaaaagtgtaccaatgtgagtactgcgagtacagtactacagatgcctccggctttaagaggcatgtgatctccatccataccaaagattaccctcatcggtgcgaatactgcaaaaagggttttcgtcgccccagtgagaagaatcagcacattatgcgccaccacaaggaggtgggcctgccttag

SEQ ID NO: 141670 - DNA, 276 bp, Artificial Sequence
  Description of Artificial Sequence: Synthetic coding sequence
atggatgaagatgagttcgagctgcagcctcaggagcccaatagcttcttcgatggaattggcgcagacgccacacacatggatggagaccagatcgtagtggagattcaggaagctgttttcgtctccaacatcgttgatagcgacattactgtgcataactttgttcctgatgaccccgatagcgtagttatacaagacgtggttgaggatgtggtcattgaagaggacgttcagtgttccgatatcttggaggaagctgatgtgtccgagtag

SEQ ID NO: 141671 - DNA, 2175 bp, Artificial Sequence
  Description of Artificial Sequence: Synthetic coding sequence
atggacggagaccagattgtcgtggagatccaagaggcagtctttgtctcaaatatcgtcgacagtgacatcactgtacacaatttcgttcctgacgaccccgactccgtggtcatacaggacgtggtagaggatgtggtaatcgaagaagacgttcagtgcagcgacatcttggaggaggctgacgtatcagagaatgtaattatacctgaacaggttctggacagtgatgtgacagaagaagtgtctctgccgcattgcactgtcccagacgatgttctcgcatccgacatcacttcaacgtctatgtccatgcccgagcacgtcctcaccagtgagagtatgcacgtctgcgatataggacatgttgagcacatggtccatgattcggtggtggaagcagagatcatcaccgacccacttacaagcgatatcgtgtcagaggaagtgttagtggctgactgtgcccccgaggcagttatcgatgcctctgggatttcagttgaccagcaggataacgacaaagcatcatgcgaagactatttaatgatcagcctcgatgacgctggaaagatcgaacacgacggatcgacaggagtcaccattgatgctgagtctgagatggatccctgtaaggtagacagcacatgcccggaagtgataaaagtctacatcttcaaggccgaccccggcgaagacgatttaggaggcacggttgatatcgttgaatccgagcccgagaatgaccacggcgtggagctgctcgaccagaattcctctatcagggtgccgcgcgagaaaatggtttacatgaccgtcaacgatagccaacaggaggatgaggatttgtcaaacaacagcgatggaatcgagaatagaaacggcaccgccagcgcccttctgcatatagacgagtcagcgggtcttggacgactcgccaagcagaaacccaaaaaaaaacgccgtccggattcccggcagtatcaaaccgccattatcatcgggcctgatggccaccctctgaccgtttacccatgcatgatctgcggcaaaaagttcaagagtagggggtttcttaagcgccatatgaaaaaccacccggagcacctggccaaaaaaaagtaccattgtaccgattgcgattatactacgaacaagaaaatctccttacacaaccatctggaatctcataagctcacgtccaaggccgaaaaggccatagaatgcgatgagtgcgggaagcactttagtcacgctggagcccttttcacacataagatggttcacaaggagaaaggcgctaataagatgcacaaatgcaagttttgtgagtatgagactgctgaacagggtctgctgaaccggcacttgctagccgtgcactcaaaaaatttcccacacatatgtgtcgaatgtggcaaaggcttcagacatccatcggaacttagaaaacacatgcggatacatacaggcgaaaagccctatcagtgccagtattgtgagtaccgctcggcagacagtagcaatctcaagacccatataaaaaccaaacatagcaaggaaatgccatttaagtgtgatatctgcctgcttactttttccgacactaaggaggtacagcagcacacactggttcaccaggagtccaaaacccatcagtgcttacattgcgaccacaaaagcagtaatagcagcgatttgaaaagacacgtgatatctgtccacacaaaagactatcctcataagtgcgagatgtgcgaaaagggtttccaccggccttctgaactgaaaaagcatgttgccgtgcataagggaaaaaaaatgcaccagtgtcgccactgtgattttaagatcgccgaccccttcgtgctgtcccgccatattctcagcgtgcacactaaagatctcccatttcggtgtaagaggtgccgaaaaggtttccggcagcagaatgagctcaagaaacacatgaaaacacattcaggaagaaaggtttaccagtgtgagtattgtgaatacagcacaacagatgcatccgggtttaagagacacgtcatttcgatccacacgaaggactatccccacagatgcgaatattgcaagaaagggtttagacggccaagcgagaagaatcaacacataatgcggcaccacaaggaggtgggcctaccgtag

SEQ ID NO: 141672 - DNA, 1617 bp, Artificial Sequence
  Description of Artificial Sequence: Synthetic coding sequence
atggcgcgagagctgtctgaatctacagccctagacgcacagagcacagaggatcaaatggagctgcttgtaatcaaggttgaggaagaggaggccgggttccctagttctccagatctgggatcggaagggagtcgggagaggtttcggggttttcgttatcccgaggcagcaggacccagggaggcgctgtcacggctcagggagctctgcagacagtggctccaacccgagatgcacagcaaagaacagatcctcgagctgttggtactcgaacagtttctcacaattctcccaggaaacctgcagtcctgggtcagagagcaacaccccgagagtggggaggaagtcgtggtcctgttagagtatctggagcgccagttggacgaaccggccccacaagtgtcaggagttgatcagggacaagaactactgtgctgtaaaatggccctgctgacaccagccccaggaagccagtcttcccagttccaactgatgaaagcactgcttaagcacgagagtgtgggaagccagccattacaggacagagtactgcaagtgccggtcctcgcccatggcggctgttgccgcgaggacaaagtcgtcgcttccagactgacaccagagtcacaggggctgctgaaggttgaggatgtagccctgacactgacgccggagtggacacagcaagattcctctcagggtaatctgtgtcgagatgagaagcaggagaaccacggaagtttggtcagcctgggagatgaaaaacaaacaaagtccagagacctcccgcctgctgaggaactaccggaaaaggagcacggcaagatctcttgccatttgagagaggatatcgctcagatacctacatgtgctgaagcaggagaacaggaaggacgcctccaaagaaagcagaagaatgccaccggcggcaggcgtcacatctgccacgaatgtggaaagtcttttgcacagtcgtctggactctctaaacatagacggatccacaccggagagaaaccatacgaatgtgaagagtgcggaaaagcgttcataggaagttccgctctggttatccatcagcgagtgcacaccggcgagaagccctacgaatgcgaagagtgtggcaaagctttctcccacagctccgacctaatcaagcatcagcggacccatacaggggagaaaccatatgaatgtgacgattgcggaaagacattttctcagtcttgctctctgttggagcaccacagaatccataccggagaaaagccctaccaatgttctatgtgcggaaaagctttcaggagatcatcacacctgctgcgacatcagcggattcacacgggggacaaaaatgtacaggaaccggaacagggcgaggcctggaaatcacggatggagtcccaacttgagaacgtggagactccgatgagctataaatgcaacgaatgtgaaagatccttcacacagaacacaggactaattgaacaccaaaagatccataccggcgaaaaaccctatcagtgcaacgcctgtggaaagggttttacccggatatcctatctggtgcaacatcagcgctcccatgtggggaaaaacatattatcccagtag

SEQ ID NO: 141673 - DNA, 1173 bp, Artificial Sequence
  Description of Artificial Sequence: Synthetic coding sequence
atggcactcctcactcccgcccccggatcacagtcaagtcaattccagctgatgaaggcccttctaaagcacgagagtgtggggtcccagccgctgcaggatcgggtgcttcaagtgcctgtgttagcacacggcgggtgttgcagagaagacaaagtggtggcctcaaggctgactccggaaagccagggcttgctgaaggtggaggacgtagctctgactctgacaccggagtggacccagcaggatagttcccagggcaacctgtgtcgcgacgagaaacaagagaaccacggtagtttagtgagtctcggggatgaaaaacaaaccaagtcccgggacctcccacctgccgaagaactgccagagaaggaacacggcaaaatatcatgtcacctgagggaagacattgcacagatcccaacatgcgcagaagccggagaacaggaagggaggttacagcggaagcagaaaaatgctacaggagggcgtcggcacatttgccacgagtgtggaaaatccttcgctcaaagttctggtctgtcaaagcatcgtaggatccacactggtgagaagccttacgaatgcgaagaatgcggaaaagcctttataggctctagcgcattagttattcatcaaagggtgcatacaggcgagaaaccatatgaatgtgaggagtgcggaaaggccttttctcactccagcgatcttatcaaacatcagagaacacataccggggaaaaaccatacgagtgtgatgattgtggaaagactttctctcaatcctgttccttgcttgagcaccacaggattcatacaggcgagaagccctatcagtgtagcatgtgcgggaaggctttccgtcgttcctctcacctgttacggcaccaacgcatacacactggggataagaacgtacaggagccggaacaaggtgaggcctggaagagtagaatggaatcacagctggaaaacgtggaaactcccatgtcttataagtgcaatgagtgtgagcgatcctttacccagaataccggcctcatagaacaccagaaaattcataccggagaaaagccatatcagtgtaatgcatgtggtaaaggttttacccggatttcgtacctggtccagcaccagcgatcacacgttgggaagaatatcctgagtcagtag

SEQ ID NO: 141674 - DNA, 1617 bp, Artificial Sequence
  Description of Artificial Sequence: Synthetic coding sequence
atggcccgggagctgtccgagtccactgcactcgatgcccagtccaccgaagatcagatggagctcctcgtgattaaagtcgaggaagaagaggcgggctttcccagctcaccagaccttggctctgagggaagcagggaacggttccggggattcagatacccagaagccgctgggcctcgcgaggcactctcaagactgagagagctctgccggcaatggcttcagcccgagatgcattcgaaggaacagattctggagttactggtccttgagcaatttctgactatcttgcccgggaacttgcagtcctgggttcgtgaacaacaccccgaaagtggagaggaagtcgtcgtgctgctcgaatatcttgagcgccaactggatgagccggcaccccaagtgagcggggtcgaccagggccaagagctcctgtgttgtaaaatggccctcctgactcccgcacctggcagtcagagttcccaattccagcttatgaaggccctgctgaaacatgagtcagttggttcacaacctctgcaggatcgggtgttgcaggtgcccgtgctcgcccatggtggctgctgccgtgaggacaaggtcgtggcctccaggcttacaccagaatcccaggggctgctgaaggttgaagacgtcgccttgactctcactccagaatggactcaacaagacagttcccagggcaatctttgccgggatgaaaaacaggaaaaccatggctcgctggtctcactgggagacgagaaacaaacaaaatccagagacctgccaccagcagaagagctgcctgagaaggaacacggaaaaatctcctgtcacctgcgcgaggacatcgcccaaatacctacctgtgccgaggcgggagaacaggaaggcaggctccagcggaagcaaaagaacgctacaggcggcagacggcatatctgccacgagtgtgggaagagctttgctcagagttcagggctgtcaaaacatcgccgcatacataccggggaaaaaccatacgagtgtgaggagtgtggaaaagcttttataggaagctctgccttggttattcaccagagagtgcacactggagagaaaccttacgagtgtgaggagtgcggaaaagcgttctcacactcttcagacctgatcaaacaccagcgcacacacaccggcgagaaaccatacgaatgtgatgactgtggcaagacctttagtcagtcttgctcattactcgagcaccacaggattcatacaggtgaaaagccataccagtgttcaatgtgtggcaaagcctttcgtagatcgtcacaccttttgaggcaccagaggattcacacaggcgacaaaaacgtgcaagaacctgaacagggggaggcgtggaaatctaggatggagtcccagttggaaaatgtcgagacccccatgtcttacaagtgtaatgagtgcgagaggtcgttcactcagaacaccggcctcattgaacatcagaagatccacaccggcgagaagccctaccaatgtaacgcatgcggcaaggggtttaccaggatttcctatctggtccagcaccagcgctcgcatgtgggcaagaacattctgagccagtag

SEQ ID NO: 141675 - DNA, 537 bp, Artificial Sequence
  Description of Artificial Sequence: Synthetic coding sequence
atggcccgggaactgtccgagagcacagcactcgatgcccagtcaacagaagaccaaatggagttactcgtgattaaggtcgaggaggaggaggccgggttccctagtagcccagacctcggatccgaggggtcgcgggaaaggttccgagggttccgctaccctgaggcagccggacccagggaggccctgtctagactacgggagctttgcagacagtggcttcagcccgaaatgcattccaaggaacagatccttgagcttttagtcctcgaacagttcttaaccatccttcccggaaatctgcagagctgggtgagagagcagcatcctgagtccggagaggaggtggtcgtgcttctcgagtatctagagaggcagctggatgaacctgccccgcaggtggaacggaccggcctcgtatctgaacggtgcggtctgttccccccagagatacctgaccaatctgaggggcacagctttaacatccaagagtttttcatttctttcctttatcgtgaacccccctggcagtag

SEQ ID NO: 141676 - DNA, 993 bp, Artificial Sequence
  Description of Artificial Sequence: Synthetic coding sequence
aggcagaggttccgcggttttcggtaccccgaagcggccggtccaagggaggctctgtcaaggctgcgtgagctgtgtggccaatggctccaacccgagatgcattccaaagaacaaattttggaactgctggtgctggagcagttcctcactattcttcccgggaatctgcaatcatgggttagggagcagcacccagagtctggcgaggaagttgtggtgctgctagagtatctggagcgccagctggacgaacccgcaccacaggtcgagcggaccggacttgtgtcggagcggtgcgcacgcggcatcccactgaggagcagatccagcagctccctcttcgtgctggcttttttaccttggcaaggcattacgcatagctgcagaccttttgtggtctccggcggcgaaatccagacaaaatctcgggatctgccaccagtgaagaaactgcccgagaaggaacatggcaaaatttgccacctgagggaggatatcgcccagattccaacccacgccgaggccggtgagcaggaaggtcgccttcaaagaaaacagaaaaatgctatcggctcaaggaggcactattgtcacgagtgcggcaagagctttgcgcagagctcaggattgaccaaacaccgccgcattcatacgggggaaaagccctacgaatgcgaagattgtggtaagacttttataggtagttctgctttggtgatacatcagcgcgtgcacactggggagaagccttacgaatgcgaagaatgtggaaaagtgttcagtcattcctccaacttgatcaaacatcagcggactcataccggggaaaaaccatacgagtgtgacgattgtggtaagaccttctctcagagttgttcacttctggaacatcataagatacacactggcgagaaaccctatcagtgcaacatgtgtggaaaagcgttcaggcgcaactcacacctcttaagacaccagcgtatccactag

SEQ ID NO: 141677 - DNA, 1638 bp, Artificial Sequence
  Description of Artificial Sequence: Synthetic coding sequence
atggctcgagagccccgcaaaaacgccgcactcgatgcccaatcagccgaagaccagactgggctcctcacagtgaaagtggagaaagaggaagcgtcggccctgaccgccgaggtgcgcgcaccttgttcccccgcgcgaggccctgaaaggtctcggcaacggttcagaggtttccggtatcccgaggctgctggaccacgggaagccctcagccgcctgcgtgagctgtgcgggcaatggctacagcctgagatgcatagcaaggagcaaatcttagagctgctggtgttggaacagttccttactatcctcccaggtaacctgcagtcatgggtgagagagcagcaccccgaaagtggagaggaagtagtcgttttgctggagtatctggaaagacagctggacgagccagctccccaagtccctgtaggcgaccaggggcaggagctgctgtgttgcaaaatggcactgctgacacagactcagggatcgcaatcttcccagtgtcagcccatgaaggcgctgtttaagcatgaaagcctgggcagtcagccccttcatgacagagtcttgcaggtgccaggcctcgcccaaggcgggtgctgtcgcgaggatgcaatggtcgcaagtagattaaccccaggcagtcaagggctgctgaagatggaggatgtggccctaaccctaacccctggatggacacagctcgactcctctcaggtgaatctttatcgagatgaaaagcaggaaaatcactcttctctcgtctccctgggtggtgaaattcagactaaatcacgcgatctgccacctgtgaagaagttgccagagaaagaacacggcaagatttgtcacctgcgcgaggacattgcgcagattccgacccacgccgaagctggcgagcaggaagggcggctgcagaggaagcagaaaaacgcgattggatctcgacggcactactgccacgagtgtggcaaatcattcgctcagagcagcggcttgaccaagcaccgacgcatacataccggtgagaagccttacgaatgtgaagattgtggaaagaccttcattgggtctagtgccctggtgatccatcaaagggtgcataccggcgagaagccctatgaatgtgaggagtgtggcaaggtgttctcccactcttctaaccttatcaagcaccagcgaacacacaccggcgagaagccgtacgagtgtgatgactgcgggaagactttcagccaatcttgcagcttactcgagcatcacaagattcatactggcgagaaaccttatcagtgtaatatgtgcggcaaagcgtttcgcagaaatagccatctgctccggcaccagcgcatccacggcgataagaacgtgcagaatcccgaacatggtgagtcttgggaaagccagggccggacagagtcacaatgggagaacactgaggccccggtgtcttataaatgcaacgaatgtgaaaggtcattcactaggaacaggtctttgatcgaacaccagaaaatccacaccggcgaaaagccttatcagtgcgacacgtgcggtaaaggattcacccgcacctcttacctggttcagcaccaacggagccacgtcgggaaaaagaccctctcccagtag

SEQ ID NO: 141678 - DNA, 1173 bp, Artificial Sequence
  Description of Artificial Sequence: Synthetic coding sequence
atggcgctgttaacacagacccagggttcccagtcttcgcagtgccaacctatgaaggccttgttcaaacacgagtcactcggctcacagccactacacgatagagtgttgcaggttcccggcttggcccagggaggatgctgcagggaagacgccatggtggcatcccgcctgactccaggatcgcaggggttactcaagatggaagacgtcgctctgacactcacaccaggttggacgcagctcgattctagccaggtgaatctctatcgggacgagaagcaggagaatcattcttctctggtgagcctgggaggggaaatccaaacgaaatccagagatctgccaccagttaagaaactccccgagaaggaacatggcaaaatatgtcatctaagggaagatattgcccaaatacctactcacgcagaggccggtgaacaagaaggccgtctccagcgaaaacagaagaacgccatcggatctcgtcgccactattgtcatgaatgtggcaaaagctttgcccaaagttcaggcttaactaaacaccggcggattcacactggagagaaaccatatgaatgtgaggattgcgggaaaacattcatcgggagtagcgcactggtaatccatcagcgagtgcatactggggagaaaccttatgaatgcgaagaatgcggaaaggtgttctctcacagttcaaacctcataaaacaccagcgcactcatacaggcgagaagccttatgagtgtgacgattgcggtaagactttctctcaatcttgttcactgctagaacaccacaagatacacacaggcgaaaagccctaccaatgtaatatgtgcgggaaagcatttagacggaattctcatcttttgagacaccaacgtatccatggtgacaaaaatgtacagaatccggagcacggcgagtcatgggagtctcaaggccggactgagtcacagtgggagaataccgaagcaccggtaagctacaagtgtaacgaatgcgagagaagcttcacccgtaatcgaagtctgatcgaacaccagaaaatccacactggtgaaaagccatatcagtgtgatacctgtgggaaggggttcacaaggacgtcatacttagtccagcaccaacgttcacacgtggggaagaaaactcttagccagtag

SEQ ID NO: 141679 - DNA, 501 bp, Artificial Sequence
  Description of Artificial Sequence: Synthetic coding sequence
cctacgcacgccgaagctggggaacaagaaggccgccttcaaagaaaacaaaagaatgctatcgggtcccggcgccactactgccacgaatgtgggaagagcttcgctcagagctctgggttgaccaagcacaggcggatccatacgggcgagaaaccatatgagtgtgaggactgcgggaaaacttttatcggctcctctgctttggtcattcatcaacgcgtgcacaccggcgagaaaccgtatgagtgcgaggagtgtgggaaggtgttctctcattcctcgaatctgatcaagcatcagcgcactcacactggcgaaaaaccctatgagtgcgacgactgcggaaaaactttctcacagtcgtgttcactcctcgagcatcataagattcacacaggggagaaaccctaccaatgcaatatgtgcggcaaggctttcagacgaaactctcacctcctgcggcaccagaggatccatgtagtgacagaaatcgtgtag

SEQ ID NO: 141680 - DNA, 438 bp, Artificial Sequence
  Description of Artificial Sequence: Synthetic coding sequence
atggaatttcctgatctaggcaaacattgcagcgaaaagacctgcaaacagctcgacttcctaccagtcaagtgtgacgcctgtaagcaagacttctgtaaggaccactttccctacgctgctcacaagtgtccgttcgccttccagaaggacgtccacgtgcccgtctgccccctgtgcaatacccccattcctgtaaaaaaagggcagatacccgacgtagtggtgggcgaccacatcgacagggattgtgatagccatccaggtaaaaagaaagagaagattttcacataccgatgttctaaggaaggctgcaaaaaaaaagaaatgctgcaaatggtgtgcgcgcagtgtcacggaaatttctgcattcagcacagacacccattggaccacagctgcaggcacgggtcccgacctacaatcaaggccggatag

SEQ ID NO: 141681 - DNA, 543 bp, Artificial Sequence
  Description of Artificial Sequence: Synthetic coding sequence
atggagtttccagaccttggaaaacactgcagcgaaaagacctgtaagcaacttgatttcttaccagtgaaatgcgatgcatgcaagcaggacttttgtaaagaccactttccctatgccgcacataagtgtccgttcgcgtttcaaaaagacgtacatgtccccgtgtgtccgttatgtaatacccccatccctgtgaagaagggacaaatcccagacgtggttgtcggcgatcatatcgatcgggactgcgactctcatcccggtaaaaagaaagagaagatatttacctacaggtgctcgaaagagggttgcaaaaagaaagaaatgctacagatggtttgcgctcagtgccacggaaatttttgtattcagcatcgacatccacttgatcacagttgtaggcacggctccaggccgactattaaggcaggatgcagtcctatgacagtgagcgagagcagacctctgggcgacttcctgactttggcaccaggcgggctggcccagcggctgggctattggtttactcggcttatgtag

SEQ ID NO: 141682 - DNA, 774 bp, Artificial Sequence
  Description of Artificial Sequence: Synthetic coding sequence
atggagttcccggacctgggtgcccactgtagtgaaccttcatgtcagaggctggatttcttgcctcttaagtgtgacgcctgctcaggaatcttctgtgccgatcatgtggcttatgcacagcaccattgtgggagcgcttaccagaaggatatccaggtgcctgtgtgccccctttgtaacgtgcccgtgcctgtggcacggggggagccccctgacagagcagtcggtgaacacatcgatagagattgtagaagtgatccggctcaacagaaaaggaagattttcacaaacaagtgcgaacgagccgggtgccgccagcgcgagatgatgaagttgacctgtgagaggtgttcaagaaatttttgcatcaaacataggcatcctttggaccacgactgctctggggagggccatccgacttcccgtgctggccttgctgcaatcagtcgagctcaggccgtagctagtacaagtaccgtgccaagtcccagtcagaccatgcctagctgtacatctccttctagagccactactagatcgcccagttggaccgcaccacctgtaattgccctccagaatggacttagtgaggatgaggcccttcagcgcgcattggaaatgtcattggccgaaacgaaaccacaggtccctagctgccaggaagaagaagacctcgcactggcacaggcactctccgcctctgaggcggaataccagcgacagcaggcacagtccagatcgtccaagccctccaattgtagcctgtgttag

SEQ ID NO: 141683 - DNA, 531 bp, Artificial Sequence
  Description of Artificial Sequence: Synthetic coding sequence
atggagttccccgatctgggcgctcattgctccgagccaagctgccagcggttagatttcctcccattaaagtgcgacgcctgctcggggattttttgcgcggatcatgtagcctacgcccagcaccattgcggcagtgcctaccagaaagacatccaggtccctgtctgccccctttgcaacgtccccgtccctgtcgcacgtggagaacctcctgaccgagcagtgggcgaacacattgaccgggattgccgctccgatccagcccagcagaaacgcaagatatttaccaacaagtgcgaaagagctggctgtcgacaaagagaaatgatgaagcttacatgcgaaaggtgctcgaggaatttctgcattaagcacaggcacccgctagaccacgactgctctggggaaggccatccaacgtctagggccggcctggctgccatctctagggcacaggccgtggcctccacatctactgtcccatcgccctcccagacaatgcctagttgcacttctccctctaggtag

SEQ ID NO: 141684 - DNA, 774 bp, Artificial Sequence
  Description of Artificial Sequence: Synthetic coding sequence
atggaattccccgaccttggagcccactgcagtgagcccagctgccagagactggatttcctacctctcaagtgtgacgcatgcagcggtatattttgtgccgaccacgtggcttacgcccaacatcattgcggatcagcctaccagaaggatattcaggtgccggtttgtcccttgtgtaatgtgcccgtgcctgttgcccgcggtgaacccccagaccgggccgtcggagaacatattgatcgagactgccgctccgatcccgcgcagcagaagagaaagatcttcactaacaaatgcgagagagccggctgtagacagcgcgaaatgatgaaactcacatgtgagcgttgttccagaaacttttgtataaagcaccgccatcctctggaccatgattgtagtggggagggacaccctacaagtagagccggcctagcagctatctcacgcgctcaggctgttgcctcaacatccaccgtcccctccccgagtcagactatgcctagctgcaccagcccatcgcgagccactacacgatctcccagctggaccgccccacccgtgattgcgcttcagaacggattgtccgaggacgaagcactgcagagagccctggaaatgtcactggcagagacaaaacctcaggtgccaagttgtcaggaggaggaagatctcgctctggcccaggccctgtccgctagtgaggccgagtatcagcgccagcaggcacagtcccgctcatccaagccctccaactgctcgttgtgttag

SEQ ID NO: 141685 - DNA, 531 bp, Artificial Sequence
  Description of Artificial Sequence: Synthetic coding sequence
atggaattcccagacctcggggcccattgttctgagccctcttgccaacgcttggatttcctccctctgaagtgcgatgcctgttctggcattttctgtgccgaccacgtggcctatgcccaacaccactgcggctcggcttatcagaaggacatacaggtgcccgtttgccccctatgcaatgtgccagtcccagtcgcccgaggagagccccctgaccgggcggtaggagagcacatagaccgtgactgccggtccgatccagcacagcagaaacggaaaatttttactaacaagtgcgagcgtgccggttgtaggcaaagagagatgatgaaactcacctgcgagcggtgctctcgaaacttctgcatcaaacaccgtcatccgttggatcatgactgtagcggcgagggccacccaacgagtagggctggcctggccgctatttcgcgcgcccaggctgtagcctctacttctaccgtgccctcaccttcacagacaatgccttcatgcacaagcccaagccgttag

SEQ ID NO: 141686 - DNA, 153 bp, Artificial Sequence
  Description of Artificial Sequence: Synthetic coding sequence
atggaatttcccgacttgggtgcgcactgctcagaaccaagctgtcagcgactcgattttctgccgctgaagtgcgatgcatgctccggaatattctgcgccgatcatgtggcctacgcccagcatcactgcggtagcgcatatcagaaatag

SEQ ID NO: 141687 - DNA, 678 bp, Artificial Sequence
  Description of Artificial Sequence: Synthetic coding sequence
atggagttccctgatctgggggctcactgttctgaaccttcgtgtcagaggctagatttcctgcccctcaagtgtgatgcttgctcagggatcttctgtgccgaccatgtggcttatgcccagcaccattgtggtagcgcatatcaaaaggacatacaggtccctgtgtgtcccctatgtaatgtgcccgtcccggtggcccggggggaacccccagatagggctgttggagagcacattgatcgtgactgccggtctgacccagcccagcagaaaagaaagatctttactaacaaatgcgaaagagctggctgtcgccagcgggagatgatgaaactcacctgcgagcggtgttctcgtaacttttgcattaaacatcgacatccactggatcacgactgcagcggtgaggggcaccctacctctcgcgctggcctggccgccatctcgagagctcaggctgtagcttcaacctcaactgtaccatctccaagccagaccatgccttcatgcacttcaccctctagggcaacaacacgaagcccatcatggaccgcaccacctgtgattgccttacagaacggccttgtgtcatgggccgaagtgggctggactgagacaaacacacagcgagtcaaaagcaaagacgccggacttctatcaccatttgtcgagtag

SEQ ID NO: 141688 - DNA, 684 bp, Artificial Sequence
  Description of Artificial Sequence: Synthetic coding sequence
atgggagacgctggctccgagcgcagcaaggcaccatcactgccaccccgctgcccttgtggcttctggggcagctcaaagaccatgaatctgtgttccaaatgtttcgcagattttcaaaagaagcagcctgatgacgactccgctcccagtacctccaacagtcaatccgacctgttcagcgaagagactaccagcgataataataatacgagcattaccactccaacactgtctccctcccagcagcctctcccgactgagctcaacgtgaccagcccaagtaaggaagaatgtggtccctgcacagataccgctcacgtgtctctgatcacccccacaaagagatcttgcggcacagactcacagagcgagaacgaggctagccctgttaaaagacctcggctgctggaaaacaccgagcgctctgaggaaaccagccgtagcaagcagaagagccggcgaaggtgctttcagtgccagactaagctggagttggtgcaacaggagttgggcagctgcagatgcgggtacgttttttgtatgcttcatagactccccgagcaacatgattgtacttttgaccatatgggtcggggccgcgaagaagctataatgaagatggttaaactggataggaaggtgggcagatcctgccagcgtattggcgagggctgtagctag

SEQ ID NO: 141689 - DNA, 642 bp, Artificial Sequence
  Description of Artificial Sequence: Synthetic coding sequence
atggcacaggaaaccaatcagacaccaggaccgatgctctgctcgacagggtgtggattctatggcaacccccgtacgaatgggatgtgctctgtatgttacaaggaacatcttcagagacaacagaatagcgggcgcatgagccctatggggacggctagtggatccaacagccctacttctgatagcgcgtcagtgcagagggcagacacaagtttaaataattgtgagggcgccgctgggagcaccagtgagaagagtagaaacgtgccagttgcggcacttccagtgactcagcagatgaccgaaatgagtataagtcgggaagataagatcacaactcctaagactgaagtctcggaacctgtggttactcaaccatcaccatccgtaagccaaccatcaaccagccagagcgaggaaaaggccccggaattacctaagccgaaaaaaaaccgctgcttcatgtgtcgcaaaaaagtgggcctgacagggtttgactgcaggtgtggcaacctgttctgtggccttcatcgttactcggacaaacataattgtccatatgattacaaagcagaagccgctgccaagattaggaaggagaatcctgtggtggtcgccgaaaagattcaacgcatatag

SEQ ID NO: 141690 - DNA, 642 bp, Artificial Sequence
  Description of Artificial Sequence: Synthetic coding sequence
atggcccaggagactaatcagacccctggtcctatgctttgcagtacaggctgtggcttttacggcaatccccgcactaacggaatgtgcagtgtgtgttacaaggaacatctgcagagacagcagaattcagggagaatgagtccaatgggcactgcgagcggttcaaacagccctacttcagactcagcctccgtgcagagagccgatacttcgcttaacaattgcgaaggagctgccggcagcacctccgaaaaaagccggaacgtaccagtggccgctctccctgtgactcagcaaatgacagagatgtctatctctcgtgaggataagattactacacctaagacagaggtgtcagaaccggtggtaactcaacctagtcctagcgtgtctcaaccctccactagtcagtccgaagagaaagctcccgagctccctaaaccaaagaaaaatagatgttttatgtgccgaaaaaaggtcggcctgaccggatttgactgcagatgcggaaaccttttttgcggcctacatcggtattctgataaacacaactgcccatacgattataaagcggaggcagctgcaaagatcaggaaagaaaaccctgtagtcgtggccgaaaagatccagagaatctag

SEQ ID NO: 141691 - DNA, 636 bp, Artificial Sequence
  Description of Artificial Sequence: Synthetic coding sequence
atggcaaaacccgagcaggcagcagacggtggtgttcgcggtcgcggagcccgcccccctgcgcaagaggcccaacgaaggcgccggcacccggtcgtcgtagctcgtgatctagcaccgggcgtgccaggatctttgcactcgacccagaagaatatggcccaagagactaaccagactcctggaccgatgctgtgctccactggctgtggattttacgggaatcctcgaaccaacggaatgtgctctgtatgctacaaggagcatcttcaacggcagcagaactctggacgtatgagccccatgggaacagcctctggatcgaatagtcctacatctgattcagcctcagtgcagagagccgatacttcactcaataactgtgagggggctgccggtagtacatcggaaaagtcaaggaatgtcccagttgccgctctgccagtgacacagcaaatgacagagatgagcatatctcgggaggacaaaattaccactcctaagactgaggtatccgagcctgtggtgacccagccgagccccagcgtctctcagcctagtacctctcaatcagaagaaaaagcgccagagctgcccaagcccaagaaaaacagatgcttcatgtgccggaaatag

SEQ ID NO: 141692 - DNA, 642 bp, Artificial Sequence
  Description of Artificial Sequence: Synthetic coding sequence
atggcccaggaaacaaaccaaacacccggccccatgctgtgttcaaccgggtgtgggttctatgggaacccgagaactaacggcatgtgttcagtctgctacaaagaacatttacagaggcaacagaattcaggccggatgtctcctatgggcactgcctcaggcagtaattcccccaccagcgactccgcgagcgtccagagggcagatacttccttgaataactgtgagggggccgccgggtccacaagcgagaagtcacgcaacgtcccagtggccgccctgcctgtcacacagcagatgactgaaatgagcatcagtcgtgaagacaaaatcacgacacccaagactgaggtgtccgagccagtggtgacccagcccagcccctcagtgagtcagccaagcaccagccagtcagaagagaaggctcctgagcttcctaagcccaaaaaaaacaggtgtttcatgtgcagaaagaaggtgggactgaccggctttgactgtagatgcgggaaccttttttgtggactgcacagatattcagacaagcacaactgtccttacgattacaaggcagaggctgcagctaagataagaaaagagaatcccgtggtggtcgctgagaagatccagcgcatttag

SEQ ID NO: 141693 - DNA, 642 bp, Artificial Sequence
  Description of Artificial Sequence: Synthetic coding sequence
atggcccaggagaccaatcagactcccggtcctatgctatgttccactggatgtgggttctacggaaacccccggacaaatggaatgtgttcggtgtgttacaaggagcacctacagaggcaacaaaattccggccgaatgtctcccatggggactgcctctggctctaactcccctacgagcgactctgccagcgttcagagggccgacaccagtttgaataattgcgagggcgcagctgggagtacctctgagaagtcacgtaacgtcccggtagctgcgttgccagtgactcaacagatgaccgaaatgtctatctctagagaagacaaaataaccacccccaaaacagaggtctccgagccagtggtaacacagccaagcccaagcgtcagccagccatccacttcccagagcgaagaaaaggcacccgagcttccaaaaccaaagaagaataggtgctttatgtgtaggaaaaaggtgggactcactggttttgactgtagatgcggcaacctgttctgtgggctccaccggtatagcgataagcacaattgcccctatgactacaaggcggaggccgccgccaaaattagaaaagaaaacccagtggttgttgcggagaaaatacagcggatttag

SEQ ID NO: 141694 - DNA, 627 bp, Artificial Sequence
  Description of Artificial Sequence: Synthetic coding sequence
atggctcaggaaacgaaccatagtcaggtgcccatgctgtgctccacgggatgtggtttttacggaaatccgcgaactaatggtatgtgcagtgtgtgctacaaagagcatttgcaacgacagaactcctctaacggcagaatcagcccacccgccaccagcgtatccagcttgtccgagagcctacccgttcagtgcaccgacggttccgttccagaagcccagagtgcacttgactccacgagttcatctatgcaacctagccctgtgtccaatcagtcactgctgagcgaaagcgtcgcgagttctcagctggatagtacctccgttgacaaggcggttcctgaaacagaggacgtccaggcctctgtgtcagacacagcccagcagcccagtgaggagcagtccaaatctcttgagaaacctaagcagaagaagaatagatgctttatgtgcagaaaaaaggttggactgaccggctttgaatgcagatgtggaaatgtgtattgtggagtgcacagatatagcgacgtccacaattgttcctataattacaaagcagatgctgctgaaaagatcagaaaggaaaatcctgtggtggtaggggagaaaatccaaaagatctag

SEQ ID NO: 141695 - DNA, 627 bp, Artificial Sequence
  Description of Artificial Sequence: Synthetic coding sequence
atggctcaggaaaccaatcattctcaagtgcctatgctgtgcagtacaggttgtggattttacggaaacccaagaactaatggaatgtgcagcgtttgctataaggaacacttgcagaggcaaaacagtagcaacgggcgcatatccccacccgctacttccgtgtccagtctatcagagagtcttccagtgcaatgcactgacggcagcgtacctgaggcgcagagcgcgctggactccacctccagcagcatgcagccatcgcctgtttctaaccagagtctgctgagtgagtcagtcgcctccagtcaactcgactcgacttctgtcgacaaggccgtcccagaaacagaggatgtgcaggcctcagtgagcgacacagcacagcaacccagtgaggagcagtccaaaagcctggagaaaccgaagcagaagaagaaccggtgttttatgtgtcggaaaaaagtgggacttacggggtttgaatgtcgttgcggaaacgtgtattgcggggtccatcggtatagcgacgttcacaactgttcctacaactataaagcagacgccgcagaaaagattcgcaaagaaaacccggttgtcgtgggagaaaagatacagaaaatatag

SEQ ID NO: 141696 - DNA, 591 bp, Artificial Sequence
  Description of Artificial Sequence: Synthetic coding sequence
atggcccaggaaacaaatcacagccaggtgcctatgctgtgtagtaccgggtgcggattctatgggaacccacgcaccaatggtatgtgtagtgtgtgttataaggaacacctacagaggcagaacagctctaacggccgcattagcccacctgtccagtgcaccgatggaagcgtaccggaggcccagtccgccctggattctacgtctagttccatgcagccttctccagtctcaaaccaatccctattgtcggagagcgtggcttcctctcagctcgattctacatctgtcgacaaagccgtccccgagacagaagacgtgcaggcaagcgtctctgatacagcacagcagcctagcgaagagcagtctaaaagcctggaaaagcccaagcagaaaaagaatcgctgtttcatgtgtcgcaaaaaggtggggctgacagggtttgagtgtcgctgcggtaacgtttactgcggagtgcacagatactctgacgtgcacaactgctcctacaactacaaggcagacgccgcggaaaaaattcggaaagagaatcctgttgtcgtgggcgagaagattcagaagatctag

SEQ ID NO: 141697 - DNA, 627 bp, Artificial Sequence
  Description of Artificial Sequence: Synthetic coding sequence
atggcccaggaaactaatcactcacaggtgccaatgttatgttcaacaggatgtggattttatgggaacccacgaaccaatggcatgtgttccgtgtgctataaagaacacctgcaaagacaaaacagctcaaatgggcggatttcaccccctgctacctctgtcagctccctgtctgagtccctccctgtgcaatgcaccgatggctctgtgcccgaggctcaatcagcactggactcaacatccagttccatgcagccctcgcccgtcagcaaccagagcctgctgtccgaatcggtggcgtctagccagctggatagcacaagcgtggacaaagccgtaccagaaaccgaggacgtccaggcctctgtctcggacacggcacagcagccaagtgaggagcaatccaaaagcttagagaaaccaaagcagaaaaaaaataggtgcttcatgtgccgaaagaaggtgggactgaccgggttcgagtgccgatgtggaaacgtgtattgcggcgtgcacagatattctgacgtgcataactgttcctacaactacaaggccgacgccgcagaaaagatccgtaaggagaacccagtagtcgttggcgagaaaatccagaaaatttag

SEQ ID NO: 141698 - DNA, 627 bp, Artificial Sequence
  Description of Artificial Sequence: Synthetic coding sequence
atggcccaggagaccaatcactctcaagtgccaatgctgtgcagcaccggttgtggtttctacggtaacccccgcactaacggcatgtgctcagtgtgctacaaggaacatctgcagagacagaatagtagtaatgggagaataagtccaccagccacgagcgtgagttccctttccgaaagtcttccagtgcagtgcacggacgggtccgtgcccgaggcccagtctgcgctggactccacctcatctagtatgcaaccttcccctgtgtctaatcagtcactgctctccgagagcgtggctagttctcaactggactctacatcagtcgataaggccgtccctgagacggaagatgttcaggccagtgtgagtgacacagctcaacagccaagcgaagaacaaagtaagagccttgagaagcccaaacagaagaaaaatcgctgctttatgtgtcgcaaaaaagtcgggctcacggggttcgaatgcagatgcgggaatgtctattgcggtgtccacaggtactccgatgtgcacaactgcagctacaactataaggcagacgccgccgaaaagatacggaaagagaatcccgtcgtggtgggagagaaaatccaaaaaatctag

SEQ ID NO: 141699 - DNA, 627 bp, Artificial Sequence
  Description of Artificial Sequence: Synthetic coding sequence
atggcccaggaaacaaatcacagccaagttccgatgctgtgttccacaggctgtggcttttacggcaaccctaggactaacggaatgtgttccgtgtgctacaaagagcacctacaaagacagaattcctccaatggccgaatctcaccaccagccacatccgtctcatccctgtctgagtcactacctgtccagtgtacagatggtagtgtgccggaggctcagagcgcacttgactcgacatcttctagtatgcagccgagtcctgtaagcaatcaaagtttgctgtcagagtccgttgcatcctcccaattggactctactagcgtcgataaggccgtgcccgagacagaagacgtgcaagcatctgtgagtgacaccgcccagcagccatccgaggagcagtccaagagtctggaaaagcccaaacagaagaaaaacagatgtttcatgtgccggaagaaagtcggactcacaggattcgagtgtcgctgtggaaatgtgtattgcggcgtccaccgctacagcgacgttcacaactgtagctacaattataaggctgacgctgctgaaaagataagaaaggagaaccccgtcgtggtgggcgagaagattcaaaagatctag

SEQ ID NO: 141700 - DNA, 2085 bp, Artificial Sequence
  Description of Artificial Sequence: Synthetic coding sequence
atggaaaacaaaagcttggagagcagccaaactgacttaaagctggttgctcaccctagagccaaaagcaaggtatggaagtatttcgggtttgatactaatgccgaaggctgtattctgcaatggaagaagatctattgtagaatatgcatggcccaaatcgcctacagcggaaacacatctaatctgtcataccatttggagaagaatcatcccgaggagttttgcgagttcgtgaagtccaataccgaacagatgagagaggcgttcgctacagctttctcaaaactgaaaccagaaagcagtcagcagcctgggcaggatgccctggcggtgaaggcagggcacgggtacgattcaaagaaacagcaggaactgactgctgcggtgctggggcttatctgtgaaggcctgtatccagcctcaattgtggatgagccgacctttaaggtattgctcaagacggcggatccaagatatgagctgcccagcagaaagtatatctccactaaggccattcccgaaaagtacggtgctgtacgcgaggtaatactcaaggagcttgctgaagctacttggtgtggcatttcaaccgatatgtggcgaagcgagaatcagaatagagcatacgtgactctggctgcacacttcttggggctaggagcacccaattgtctgtcaatggggtcacgctgcttgaagacatttgaggtgcctgaggagaatactgcagaaaccataacgcgtgtgctgtacgaagttttcatcgagtgggggatctccgcaaaggtttttggcgctactaccaactacggtaaggacattgtgaaggcttgtagcttgctggatgtggcggttcacatgccttgcctcgggcacacctttaacgccggaatacaacaggcctttcagttgcccaagctgggcgcgctattgtctcggtgccggaagttggtggaatacttccagcaatctgctgtagcaatgtatatgctgtacgagaagcagaaacagcagaatgtcgctcattgcatgttggtttctaatcgcgtatcatggtgggggtcaactctcgccatgctacagaggttaaaagagcaacagttcgttattgccggagtgttggtggaagatagcaataatcaccatctgatgctggaggcttcagagtgggccactattgaaggactcgtggaactgctccagcccttcaagcaggttgccgagatgctatccgccagtcggtatcctaccatttccatggtgaagccactcctccatatgttgctgaacacaaccttgaacatcaaggaaactgacagtaaggaactcagtatggccaaggaggttatagcaaaagaattgagcaagacctaccaggaaacgcccgaaattgatatgtttttaaatgttgccacatttttagacccccggtataagagactcccgttcctctcagcgttcgaaaggcaacaggttgaaaacagggtggtggaggaggctaagggcttgctggacaaagtcaaggacggtggataccgacccgcagaggacaaaatattccccgtgccagaagagccacctgtgaagaaactgatgaggacaagcacacctccacctgcaagcgtcattaataacatgctggcagagatcttttgtcaaaccggcggtgtggaggatcaggaggaatggcacgcccaagttgtggaggaactgtctaactttaagtcccagaaagtcctcgggctaaatgaggatcccctgaagtggtggtctgataggctggcgctgtttccactgctgcctaaggtgcttcaaaagtactggtgcgtgacggctactagggtggctcccgagaggctgttcggctccgctgccaacgtggtgtcagccaagagaaatcgcctcgctcctgcacacgtagatgagcaggtcttcctgtatgaaaatgcacggtcaggcgccgaggccgaaccagaagatcaggacgagggggaatggggtctggatcaagaacaagtcttcagcctgggcgacggggtctctggcggattcttcggcattagggattcttcctttttgtag

SEQ ID NO: 141701 - DNA, 2085 bp, Artificial Sequence
  Description of Artificial Sequence: Synthetic coding sequence
atggaaaacaagtcactggaatcatcccagacagacctcaagctggttgcccacccccgggcgaagagcaaagtgtggaagtacttcggatttgatacaaatgcagaagggtgtatactccagtggaagaagatctattgcagaatctgcatggcccagatagcttactcaggcaacaccagcaacctgtcatatcatctggaaaaaaatcatcccgaagagttctgcgaattcgtgaaatcaaacaccgagcagatgagagaggccttcgccacagctttctctaaactcaaacccgaatcttctcagcagccgggtcaggacgcattggctgtgaaggctgggcatggttacgactctaagaagcagcaggaattgacagccgcagttctgggactgatctgtgaaggactatatcctgcttctatcgtcgacgagcccacgttcaaagtgctactcaagactgccgatccccgatatgagctccctagtcgtaagtacattagtaccaaagcgatccccgagaaatatggtgccgtaagggaagtgatcctgaaggagttagctgaagctacatggtgcggtatttctacagatatgtggaggtccgaaaatcagaatagagcgtacgtcactctcgccgcgcactttcttggattgggcgcaccaaactgtctctccatgggctctcggtgcctgaaaacattcgaagtgcctgaggagaacaccgcagagacgattaccagagtgctctatgaggtattcatagagtggggaatatcggccaaggtgtttggcgctaccacaaattacggcaaagatattgtgaaggcttgtagcctgctggatgttgccgtgcatatgccctgtctgggacacacctttaatgcaggcatccagcaggccttccagctgcccaaactcggagcgctgctgtcccgatgccgaaagctggttgaatacttccagcagtctgcagtggccatgtacatgctgtacgagaaacagaagcagcaaaacgtggcacattgtatgctggtctccaatcgagttagctggtggggatccaccctcgcgatgctccagaggttgaaagagcaacagttcgtgattgctggagtcctggtcgaagacagtaataatcatcatctgatgctcgaggcttctgaatgggcaaccatcgagggactagtagaactgctgcagcctttcaagcaagtggcagaaatgctctcagcgtccagatatcctaccataagtatggtcaagccactactacacatgcttctgaacacaactctgaatatcaaggagacagatagtaaggagctctctatggctaaagaggttattgccaaagaactcagcaaaacatatcaggagacccccgaaattgatatgtttctcaatgtggctacgtttctggatccccggtataagagattaccattcctctctgctttcgaacgacaacaagtggagaatcgagtcgtagaagaagctaaaggactgctggacaaagtcaaagacggcgggtatagaccggccgaagataagattttccccgtacccgaagaacctccagtgaagaaactcatgagaacatccaccccgccacctgcctcagtcatcaataatatgctggctgaaattttttgtcagacaggaggggtagaagaccaggaggaatggcatgcccaagtggttgaggaactcagcaacttcaaaagccaaaaggtccttggccttaacgaggatcctctgaagtggtggtctgatcggttggcccttttccctttgctgcctaaggttctccagaagtactggtgcgtcacagctacacgcgtcgcacctgagagacttttcgggagtgcagccaatgtggttagcgccaagagaaacagacttgcccccgcccacgttgacgagcaggtattcttgtatgagaacgctcggtccggcgcagaagccgaacccgaagaccaagacgaaggtgaatggggactagatcaggagcaggtgttctccctgggggatggagtgagcggaggcttcttcgggatcagagattctagttttttatag

SEQ ID NO: 141702 - DNA, 2085 bp, Artificial Sequence
  Description of Artificial Sequence: Synthetic coding sequence
atggaaaataagagtctcgagagttcccaaactgacctaaagcttgtggcccatcctcgggccaagagcaaggtttggaagtatttcgggttcgatacgaatgctgagggatgtattcttcaatggaagaaaatatattgccggatctgtatggcccagattgcatattccggaaacacatccaaccttagctaccatcttgaaaagaatcacccagaagagttctgtgagttcgtgaagagcaatactgagcagatgagggaggctttcgccaccgccttttcaaagctgaaaccagaaagttcgcaacagcctggtcaggatgccttagctgtcaaagctggccatgggtatgactcaaagaaacagcaggaattgaccgcagctgtgctcggtctgatctgcgaaggtctgtaccctgcctccattgttgacgaacccacattcaaggttttactgaaaacagcagaccccagatacgaactgccaagtcgtaagtatataagcacaaaagcaatacctgagaagtatggggccgtacgcgaggtcattctcaaagaactagctgaagccacctggtgtggcatttctactgacatgtggagatccgaaaatcagaaccgggcttacgtgactctagctgcccatttcttgggcctcggagctcctaattgtctgagcatgggctcacgctgtctgaagaccttcgaggtacctgaggagaacactgccgaaacgattacgagagtgctctacgaggttttcattgagtggggtatttcagctaaggtattcggtgccacaactaattacggcaaagacatcgtgaaggcgtgcagtctcctggacgtcgcggtgcacatgccgtgtctggggcacactttcaatgccggaatccagcaggctttccaactgcccaagcttggcgccttgctgtcacgctgcaggaaactagtggaatactttcaacagagcgccgtggcaatgtatatgctttacgaaaaacagaagcaacagaacgtagcacattgtatgcttgtgtccaatcgggtgtcttggtggggatctacattagccatgctgcagagactgaaggagcagcagttcgtcatcgccggtgttctggtcgaggattcaaacaaccatcacttgatgcttgaagcaagcgagtgggccacaatcgagggtctggtggagctgttgcagccttttaagcaagttgccgaaatgctaagcgcctcaagataccccaccatatccatggtgaagcccctccttcacatgctcctgaatacaacccttaacatcaaagagaccgatagcaaagagctatccatggctaaagaagtaattgcaaaagagctctccaagacctaccaggaaacacctgagattgacatgttcctcaatgttgccacattcttggaccctcgctataagagactgccctttctgtcagcatttgagcggcagcaggttgagaaccgagtggtggaggaggctaagggcctcctcgacaaagtgaaggacggaggataccggccagccgaggacaaaattttcccagtgccggaggaaccccccgtgaagaaactcatgagaactagcactcccccacccgcctctgtcatcaacaacatgctggcagaaattttctgtcagaccggaggcgtggaagaccaagaggagtggcatgctcaggtggtggaggagctgagtaatttcaaaagtcagaaagtgttgggtctcaatgaagacccgcttaagtggtggtccgatagactcgctctgtttcccctgctgccgaaagttctgcagaagtactggtgtgtgaccgccacgcgcgtagccccagaacgtctgtttggctcagctgccaacgttgtgagtgcaaagagaaaccgactcgctcctgcgcacgtggatgagcaggtattcctgtatgagaatgcacggtctggggccgaggcagagcccgaagaccaagacgagggggagtggggcctcgatcaggaacaggtatttagcctgggtgatggtgtctctggcggtttcttcgggatcagggattcaagcttcctctag

SEQ ID NO: 141703 - DNA, 819 bp, Artificial Sequence
  Description of Artificial Sequence: Synthetic coding sequence
atggagaataaaagcctggaatcttcccaaaccgacctgaagttggtcgcccatcctcgcgccaagagcaaggtgtggaaatattttggcttcgatacaaacgctgagggctgcatacttcagtggaagaaaatctattgtcgaatctgtatggcccagatagcatatagcggaaacaccagcaacctctcatatcacctggagaagaaccacccggaggaattctgcgaatttgttaagagcaatactgaacaaatgagggaagcttttgccactgccttctcaaagctgaagccagaatcttcccagcagccgggccaggacgctctggccgtcaaggccggccacggctatgactccaagaaacagcaggaattaaccgccgcggtgcttggtctgatctgtgagggcctgtatcctgccagcattgtggacgagccaaccttcaaagtccttttaaagacagccgacccacggtatgaattaccatcgcgaaagtacataagcacaaaggccattccggaaaagtatggcgctgttagagaagtgatcctgaaggaactggctgaagccacctggtgtgggatcagcacagacatgtggcggtcagaaaaccaaaatcgggcctacgtgacactggctgctcacttcctcggcctgggtgctcccaactgcttgtccatgggttccagatgtttgaagacgttcgaagtgcccgaggagaacacagcagagactatcaccagagtgttgtacgaggtatttatcgagtggggtataagtgcaaaggtgttcggagctactaccaactacgggtag

SEQ ID NO: 141704 - DNA, 3177 bp, Artificial Sequence
  Description of Artificial Sequence: Synthetic coding sequence
atgagacgcaaggggcggtgccacaggggttcagctgcacggcaccccagctcaccctgcagcgttaaacattcaccaactcgtgagacgctgacctatgcccaggcacaacgtatggtcgagatcgaaatagagggtcgcttgcataggatctcgattttcgaccccctggagatcattctcgaagatgacctcacagcccaggaaatgtccgagtgcaattccaacaaggaaaattccgagcggccaccagtgtgcctgagaaccaagcgccacaagaacaatcgcgtgaagaagaaaaacgaggccctcccctccgcccacggtactcctgctagtgctagcgcattgcctgaaccgaaagttaggatcgtcgaatactctccccctagcgctccaaggagaccgcccgtgtactataagtttatcgagaagtccgctgaggaactcgataacgaagttgagtacgatatggatgaggaggactacgcatggctggagatcgtgaatgaaaaacgaaagggagactgtgtgcccgctgtgtcacagagcatgtttgaattcctgatggacaggtttgagaaggaaagccattgtgagaaccagaaacagggtgagcagcagtcccttattgatgaagacgccgtctgctgcatctgtatggacggggaatgtcagaactcaaatgttatcttattttgtgatatgtgtaatctggcagtccatcaggagtgctatggtgtgccatacattcctgaaggacagtggctgtgcaggcattgtctccaaagcagagctaggccagccgattgtgtgctgtgccctaataaaggcggggcttttaaaaaaaccgatgatgacaggtggggacacgttgtctgcgctttatggatccccgaagtgggctttgctaatactgtttttattgaacccattgacggcgtccgtaatatccctcctgccagatggaagctgacgtgttacctctgcaagcagaaaggcgtgggcgcatgcatacagtgccacaaagcaaactgctacacggcatttcacgtgacatgtgctcagaaggccgggctgtacatgaagatggaacccgtcaaggaacttaccggcggaggtactacattcagtgtgaggaaaacagcctattgcgacgttcatactccgcctggctgtacaagaaggcctctaaacatctacggcgacgttgaaatgaagaacggggtatgtagaaaggagtcaagtgtgaaaacagtgcgctcaacctctaaggtgagaaaaaaagccaagaaagcaaagaaggctctggctgagccttgcgccgtgttacccaccgtttgcgccccctatatcccaccacagcgtctgaacagaatcgcaaaccaggtggcgattcagcggaagaagcagtttgtcgaacgcgcccactcctattggctcttaaagcgccttagtcggaacggcgcacctctcctccgccgcttgcaaagttcgctgcagtctcaacggagcagtcaacaaagagagaatgatgaggaaatgaaagctgcaaaagagaaactgaagtactggcaacgcctgagacatgacttggaacgcgcacgtcttctgatcgagctcctgagaaagagggagaaactgaagcgggagcaagtcaaagtggaacaggtcgcaatggaactcagactgacccccctgacagtcctactgaggtcagtgctcgatcagctccaggacaaggaccctgcccgaatcttcgcacagccagtttccctgaaggaagtgccggattatcttgaccatatcaagcatccaatggacttcgctaccatgcggaagaggctggaggcgcagggctacaaaaatctccatgaatttgaggaagactttgacctcatcatagataactgcatgaagtacaacgcacgggacactgttttttacagggcggccgtgagactccgcgaccagggaggcgtggttcttcgacaggcaaggcgcgaggtcgatagtataggtctggaagaggcgtcgggcatgcacctgcccgagcgtccagcagccgcaccaaggaggccatttagctgggaggacgtggataggttacttgaccctgccaaccgggcccatcttggactcgaagagcaactgcgagaactgctagacatgctcgatcttacatgcgctatgaagagtagcggttcccgctctaagagggcaaagctcttgaaaaaggaaatcgctttgttacggaacaagctgagccagcagcatagtcagcctttgcccaccggacctggcctagagggattcgaagaggatggggcagcactgggacctgaggccggagaggaggtcttgcctagactcgagaccctgttgcaaccacgcaagcgctcgcgttcaacatgtggtgatagtgaagtggaggaggagtctccaggaaaacgattggatgctgggctgactaacggatttggcggggcaaggtccgaacaggagcctggaggtgggctgggcagaaaggccaccccgcgcaggcggtgcgctagcgaaagttcaattagctctagcaatagtcccctgtgtgattcttccttcaacgcacctaaatgcggccggggcaagccggccctggtgagaaggcataccctggaagataggtcagagcttatcagctgtatcgagaatgggaattatgccaaggcagcacggattgccgcagaagttgggcagtcaagtatgtggatttctaccgacgctgccgcctcagtgctggagccattgaaggttgtttgggcgaaatgcagtggctacccttcctatcccgccttgatcatcgatcctaagatgccacgtgtgccaggccaccacaacggtgtgacgattccagccccgcccttagatgtcttgaagatcggagaacacatgcagacaaagtccgacgaaaaactttttctggtgctgttctttgataataagagatcctggcagtggttacctaagtctaagatggtgcccctcggcattgacgaaacgatcgataagctgaagatgatggaaggacgcaattcatctattcgaaaagccgtgcgtattgcttttgatagggcgatgaaccacttatctcgggtgcacggcgagcctacaagtgatctaagtgatattgactag

SEQ ID NO: 141705 - DNA, 2940 bp, Artificial Sequence
  Description of Artificial Sequence: Synthetic coding sequence
atgtctgtctgcaccctgagtgtgcctgtgtcaagtttgtcccccggtcgtagatgcaacacattctcagacagcggcatcctcggttgtgtgcccatcaactctaacacagatgaagaagacgtagttgaagaaaagatggtcgcggaaggcgttaacaaggaggccaagcagccagctaagaagaagagaaagaaagggttacggataaagggcaagagacggcgcaagaagctaatcttagcgaagaagttctcgaaggacctgggaagtgggcggccagttgccgatgctccagcgttgttggcttccaacgacccagaacaggacgaggagtcgctgtttgagagcaacattgaaaagcagatatacctgccttccacacgggctaagacatctatcgtctggcactttttccatgtagacccccagtatacgtggagagccatatgtaacctatgcgagaaatcagtatcgcgggggaagccaggttcccatttgggaacttccacccttcagcggcatctccaggcgcggcactccccccactggactcgcgcaaacaagtttggtgtagcgtctggagaggaagatttcaccctggacgttagcttgtccccctctagcggttccaatgggagtttcgaatatatacccaccgaccctctggacgataataggatgggcaaaaagcatgataaatccgcatcagatgcgttgagagctgagaggggcaggtttttgatcaagtccaatatagttaaacacgctctgatccctggaacgcgggctaagaccagcgctgtttggaatttcttctacaccgatcctcagcacatatcaagagctgtttgcaacatctgtaagcggagtgtgtcacgcggtcgtcccgggtctcacctcggcaccagtacccttcagaggcacctccaagctactcatcctatacattgggcagtggcaaataaagattctggcgctgtggctaacgggttagacgaggctgagactgaaagaagtgatttactatctgacaccctacatggcgaaaagtctacaggatctcaagatctcacggcagaggacctgtctgactctgactccgacgaacccatgcttgaagtcgagaacaggtcagagtctcccattccagtagcagagcaagggacgctcatgcgggcacaggaaagagagactacctgttgtggaaacccggtgtcatcccatatctctcaggcgattattcagatgatagtggaggacatgcatccatataactacttttctactccggccttccaacggtttatgcaaatagttgcaccagactacagactcccaagtgagacatattttttcaccaaggctgttccccagctgtatgattgcgtgagggagaagatctttttgacactggagaatgttcagagtcaaaagattcacctgactgttgacatttggacccacgacccatctaccgattactttatcgttacagttcactgggtgagcttggagactgcatccttcctgaataatgggagaatcccagatttcaggaagtgggccgttttatgtgtcacaggtttggctaaggactgcttgatcacgaatatcttacaggaactgaatgaccaaataggtttatggctatcacccaacttcttaattccgagcttcattgtctccgacaattccagtaacgtggtgcacgctatcaaagacgggggattcacccatgtcccatgcttcctccattgccttaacatggtgatccaagacttcttctgcgaacacaagagtatcgagaacatgctggtcgcagccaggaagacttgccaccattttagccacagtgtgaaggctcgccagatcctccaggaatttcagaatgatcaccagcttccatggaaaaacctgaagcaggatgagacaggacattggatttccaccttttacatgttaaagtggctcctggaacactgctactctgtccatcattccctcggccgcgcttccggcgtggtgctcacaagcctgcagtggactcttatgacttacgtttgtgacattcttaagccctttgaagaagctacccagaaagtgagcgttaaaacagctggacttaaccaggttctccctctgatccaccacctccttctttctctgcaaaagttgcgcgaggatttccaagtgagagggataacgcaagcactcaacctggttgactctctatctctgaagctggagacggacactctgctgtcggccatgctgaagtccaagccatgtattctggccactctcctggacccgtgcttcaaaaacagtctcgaagacttctttcctcagggcgccgatctggagacctataagcagtttctggctgaggaggtttgtaactatatggagtcctctcccgaaatatgtcagataccgacctccgaggcatcttgtcccagcgtgactgtcggggcagattcctttacatcctccctgaaggaaggaaccagctcatcgggctctgtagattcctccgctgttgacaacgtcgcactcggctccaaatcatttatgttcccgtccgctgtggctgtggtggacgagtacttcaaggagaaatacagtgagttcagcggaggagatgacccgctgatttactggcagaggaaaatctcaatttggccagccttgacccaggtcgccattcagtatctatcctgcccaatgtgcagctggcagtccgaatgcatcttcactaagaactcgcatttccatccaaagcagatcatgagtttagactttgacaacatcgaacagctgatgtttctgaagatgaacttaaagaacgtgaactacgactacagcactctggtcctcagctgggacccagaacagaacgaggtggtgcagtcctctgaaaaggagattctgccatag

SEQ ID NO: 141706 - DNA, 4938 bp, Artificial Sequence
  Description of Artificial Sequence: Synthetic coding sequence
atggaggaaagtaaaacactcaagagtgagaatcatgagcccaagaaaaacgtgatttgcgaagaatccaaagcggtgcaagtgatcgggaatcagactttgaaggccaggaacgacaagtcagtcaaggagatagagaatagcagtccaaacaggaacagctccaagaaaaataaacagaacgacatatgtatcgaaaagaccgaggtgaaatcatgcaaagttaatgccgctaacttgcccggccccaaggacctcgggctcgttctgcgggatcagtctcattgcaaggcaaaaaaatttccgaacagccccgtaaaggctgagaaagctaccatcagtcaggctaagagcgagaaggcaacgagtctgcaggcaaaggcagagaagagccccaagagccccaacagtgtgaaagcagagaaggcttcatcctaccaaatgaagtcggagaaggtgccttctagtcccgccgaagcagaaaagggcccctcgctcctgctcaaggacatgcggcagaagaccgaactccagcaaatcggaaagaaaataccttcatcttttacgagcgtggacaaagtgaatatcgaggcggtgggaggcgaaaaatgcgccctgcagaactcacctagaagccaaaaacaacagacttgcacggataataccggggattccgatgacagcgcctccgggattgaggatgtaagcgacgacctgagtaaaatgaaaaatgatgagtccaataaagaaaactctagtgaaatggactacctggagaacgcaacagtgattgacgagtccgctttgacccctgaacagcgcttgggcctaaagcaggcagaagagagacttgaacgtgaccatatatttcgcttggaaaaaagatcccctgagtataccaactgtcgatacctttgcaaactgtgcctcatccatatcgaaaatattcagggagcacataaacacatcaaggaaaagaggcacaagaagaacattctcgagaaacaagaggagtctgagctgcggtctctgcctcccccttctcctgctcatctggctgcactcagtgtcgccgttatcgagctggctaaagaacacggcatcacggacgatgacctgagggtgcggcaggaaattgttgaggaaatgtccaaggtgataactacgtttctccccgaatgcagccttcggctctacggctcttccctgacacgcttcgctctgaagtcctcagatgtgaatatcgacatcaaatttccacccaaaatgaaccacccagatctcctgattaaggtccttggaatattgaaaaaaaacgtcctctacgtggatgtggagtcagacttccacgctaaggttcctgtagtggtctgtcgtgaccggaaaagtggtctcttatgtcgagtcagtgccggaaacgacatggcatgcctgactacagacctgttgactgctcttggtaaaattgaaccagtctttattccccttgtgctcgcatttcggtattgggccaaactctgttacatcgattcacaaactgacggcggcattccctcttattgttttgcactgatggtcatgtttttcctgcagcagcgcaaaccgccgttactcccatgcctacttggatcctggatagagggatttgatccaaaacggatggatgactttcagttaaagggtattgtcgaagagaagttcgtcaagtgggagtgtaattcgagctcagccactgagaaaaattcaatcgccgaagagaacaaggctaaagctgaccaacccaaagatgacacgaagaaaaccgagacagataaccagtctaacgcaatgaaggaaaagcatgggaagagcccactggctctcgaaaccccaaatagagtgagccttggtcagttgtggctagagctgctgaagttctatactctcgacttcgctttggaggagtatgtaatctgcgtgcggatacaggacattctgaccagggaaaacaagaactggcccaaacgacgcatcgccatcgaggatcctttctccgtcaaacggaacgtcgcacgaagcttgaactctcaattagtgtacgagtacgtggtggagagattccgagctgcctatcgctattttgcttgtccacaaacaaaaggaggcaacaagagcactgtggacttcaaaaaaagagaaaagggtaagatctccaacaagaaacctgtgaagagcaataatatggcaacaaacggatgcatcctgctcggggagactacagagaaaattaatgccgaaagggaacagcccgtgcagtgtgatgaaatggattgcacaagtcagagatgtatcattgacaataacaatctgttagtgaatgagttagacttcgcagaccacggccaggactcatcttctctgtccactagtaaatcatctgagatagaacctaagctggacaagaagcaggatgatctggcgccctcagagacatgtctgaagaaagagctgagccaatgtaattgcatcgacttgtctaagtcacccgatccagataaatccaccggaaccgattgccgctctaatctcgagacagaaagttctcaccagtcggtgtgcacagacacctccgcaacaagttgtaattgtaaggccaccgaggatgccagtgatcttaacgacgatgacaacctccccacccaggagctctattatgtcttcgataagtttatcctgacatcaggcaaaccaccaaccattgtttgtagcatctgcaagaaggatggacactctaaaaacgattgtcctgaagatttccgtaagatcgacctcaaaccactgcctcccatgaccaatcgtttcagggaaatcctggacctagtttgcaagagatgtttcgacgagctttcgcctccctgttcagaacaacataatagagaacagattctgattgggctggagaagtttatccaaaaggaatacgacgaaaaggctagattgtgtctttttggtagctcaaagaacgggtttggctttagggatagcgacttggatatctgcatgacactggaaggccatgaaaacgcagagaagctgaactgcaaggagatcattgaaaatctggccaagatcctgaaacgacaccccggcctgagaaacatcctcccaatcacaacagcaaaggtcccaatcgtgaaattcgaacatagacgatctgggctggagggagacattagcctttataacacattggcccagcacaacactaggatgctggcaacatacgccgctatagaccctagagttcagtacttgggctacacaatgaaggtttttgccaagcgctgcgacatcggcgacgcttcgcgcggatccctgagcagctacgcatatattcttatggttctgtactttctccagcagcggaagccaccagtcatccctgtcctccaagaaatcttcgatggcaagcagattccacagaggatggtggatggctggaatgccttcttctttgacaagactgaggagttgaagaagagactccctagtctcggcaaaaatacagagtctctgggagaattatggcttggcttgctgcgcttctacactgaagaattcgattttaaggagtatgtgatctccattcgccagaagaagcttctaactacctttgagaaacagtggacttcgaaatgcatcgcgattgaagaccctttcgacctgaaccataatctgggtgccggagtgtccaggaagatgaccaattttatcatgaaggcattcatcaacggccgcaagcttttcggtacccctttctatccactcatcgggcgcgaagcggaatacttttttgacagccgcgtgctcaccgatggagagctggcccccaacgacagatgttgtcgcgtgtgcgggaagatagggcattacatgaaggactgccctaaacgcaagagctccttactgttcaggctgaaaaagaaagactctgaagaagagaaggaaggcaacgaagaggaaaaggacagccgcgacgtcctggacccccgggatcttcacgatacgcgcgattttcgtgatcccagggatcttaggtgttttatatgcggcgacgcaggccacgttcggagggagtgtcccgaggttaaattggcccgacagcggaattcctctgtggccgctgcccaactggtgcgtaatctcgtcaacgcccagcaggtagcgggcagcgcacagcagcagggagatcaatcaattagaacgcgacagagtagcgagtgctcagaaagccctagttattccccacaacctcagccatttccacagaattcatctcagtcggcagcaattactcagccgtcttctcagccaggttctcaacctaagctaggaccccctcaacaaggggcccagcctccgcatcaggtgcagatgcccctgtataacttcccccagtctccaccggcccagtatagccccatgcacaacatgggactcctccctatgcatcccttacagattcccgcaccctcatggccgatacatgggcccgtaatccattctgcacccgggtctgcgccctctaacatagggctgaatgacccttcgatcatatttgcccagccggcagctcggcccgtggccatccctaatactagtcatgacggacactggccgagaactgtggcacctaacagcctagtcaactcgggagccgtgggtaacagtgaacccggctttcgcgggctgacccctcccattccatgggaacacgccccccgcccgcacttcccgctggtccccgccagctggccctacggcttacaccaaaactttatgcatcagggaaatgctagatttcagcctaacaagcctttctacacacaggataggtgcgctactcggcgctgccgagagagatgcccccacccgcccagaggaaacgtgtccgaatag

SEQ ID NO: 141707 - DNA, 4935 bp, Artificial Sequence
  Description of Artificial Sequence: Synthetic coding sequence
atggaagaatcaaagacactcaagtctgagaatcatgagccaaagaagaatgttatttgcgaggaaagcaaggctgtccaggtgatcggtaaccaaacactgaaggcgcgcaacgataaatctgttaaagagattgaaaactctagccctaatcgaaacagctctaagaagaataagcagaatgacatatgtatcgagaaaacggaggtaaaaagttgcaaggttaatgcggcaaaccttcctggtcctaaggatctgggcctcgtcctgcgcgatcagtcccactgcaaggctaaaaaattcccaaactctcctgtgaaggccgaaaaagccaccatcagccaagctaagagcgagaaagctacctcactgcaagcgaaagccgagaagtctccgaagtctccaaattctgtaaaagccgaaaaggcttcttcctaccagatgaagagtgaaaaggtcccctcatctccagccgaggcagaaaaaggcccctctcttttactcaaggatatgagacaaaagaccgaactgcagcagattggtaagaaaatccctagtagtttcacttctgtcgataaggtgaatatcgaggcagttggcggagaaaaatgcgcactccagaacagtcctcggtctcaaaagcagcagacgtgcaccgataacacgggtgactccgatgacagtgcttcagggatcgaggacgtatctgatgacttgagcaaaatgaaaaatgatgaaagcaacaaagagaacagcagcgaaatggactatctggagaacgctaccgtcatcgacgaaagcgcactgacgcccgaacagagattgggcctgaagcaggccgaggaacgtcttgaacgcgatcacattttcaggctagaaaaacggtctcccgagtatacgaactgtcgctatctgtgtaagctttgtttgatccacatcgaaaacattcaaggcgctcataagcacatcaaagaaaagcgtcacaagaagaatatattagagaagcaagaggaatccgagctgaggagcctgccaccaccaagtccagcccacctggctgcattgtctgtggccgtcatcgaactggccaaagaacacgggatcaccgatgatgatctgcgcgtgcggcaggagatcgtcgaggagatgagcaaggtcattactaccttcttaccagagtgctccttgaggctctacggtagctcattgacacggttcgccttgaaatcgagcgacgtcaacattgacatcaaatttcctcccaagatgaaccaccctgacttattgatcaaggttctcgggatcctaaagaaaaacgtcttgtacgtggatgtggagagtgactttcatgctaaggtacctgtggttgtgtgtagagataggaaaagcggcctcctttgtcgggtctctgctgggaatgatatggcgtgccttacaacagacttgctgaccgccttggggaagattgagccggtatttatcccattagtgcttgctttccggtattgggccaaactgtgttacattgattcacaaacagatggagggatcccctcctactgtttcgcgctgatggtaatgttcttcctgcagcagcgcaagcctcccctgcttccatgtttactgggttcttggattgaagggttcgaccccaaacgcatggacgactttcaactgaaaggcattgtggaagaaaaatttgtgaagtgggagtgcaactctagtagtgcaacggagaagaatagtattgccgaggaaaacaaggccaaggctgatcagccaaaggatgatacgaaaaagaccgagaccgacaaccagagtaatgccatgaaagagaaacacggtaaatccccactggcattagagactcctaaccgagtcagtttgggccagttgtggctggaactcctgaagttttatactttagacttcgccctggaggaatacgtgatttgcgtgcgcatccaggatattctcacccgagagaataaaaattggcctaagagaagaatcgctatagaagaccccttctccgtaaaacgtaatgtggcgcggtctctgaatagtcagctcgtgtacgagtatgttgttgaacgttttcgcgccgcctaccggtattttgcctgcccacagactaagggcggtaacaaatcaactgtggatttcaaaaaacgagaaaaaggaaagattagtaacaagaagcctgtaaagagcaacaacatggccactaatggttgtatattactgggcgagacgaccgaaaagatcaacgccgaacgggagcagcctgtgcaatgtgacgagatggactgcacaagccagcgctgtatcatcgacaataataaccttttagtgaatgagttagatttcgccgatcatggacaggactcaagttccctgtcgacatcaaaatcatctgagatcgagcctaaactggacaagaagcaggatgacttggccccatccgaaacttgcctgaagaaggagctgagccagtgtaattgtatagatctgtcaaagtcgcctgacccagacaaatcgacaggaaccgattgtaggagcaacctcgaaacggagtctagtcatcaaagcgtgtgcactgatacgagcgccacttcttgtaactgcaaggcaactgaggacgcgtccgatctaaacgacgacgataatctgccaacccaagagttgtactatgtgttcgataagttcatcctgactagcgggaaaccccccactatcgtatgttctatatgcaaaaaggatggtcattcgaagaacgactgtcccgaggacttcaggaagatcgacctgaagccactgcctcctatgaccaatcggttccgcgagatactggatctcgtctgtaagaggtgttttgatgagttgtcaccgccatgctctgagcaacacaacagagaacagatcctgatcggattagaaaagtttatccaaaaagaatatgatgagaaggccaggctgtgtctgtttggaagcagtaaaaacgggttcggctttcgcgactctgacctggatatttgtatgacgttggaagggcatgagaacgcggaaaaactgaactgcaaagaaatcatcgaaaatttggccaagatcctgaagcggcaccctggcctcaggaacattctgccaattaccaccgcaaaggttcccattgttaaattcgagcatcgcaggtcaggcctagagggcgacattagcctgtacaacacactggctcagcataacacaagaatgctggcaacgtatgctgcaatcgacccccgcgtgcaatatctaggctataccatgaaagtttttgctaaacgatgtgacatcggtgacgccagtcgcggttctctctcatcttacgcctacatcctcatggtgttgtatttccttcaacagcgaaagccccccgtcattccagtgctccaggagatattcgacggcaagcaaattccccaaagaatggtggatggctggaatgcgttcttcttcgataagacagaagagctaaaaaagcggttgcccagtctcggcaagaatactgagtctttgggcgaattgtggctcgggctgctgcgattctacacggaagaatttgacttcaaagagtatgtgatctcgatcagacagaagaagttgctgacgaccttcgagaaacagtggaccagtaaatgcatagcgatcgaggacccatttgacctgaaccataatctaggcgctggagtgagtaggaagatgacaaacttcatcatgaaggcattcattaatggccgcaaactgttcggcacacctttttaccctttaataggccgagaagccgaatactttttcgactcacgggtgctgacggacggcgaactggcccccaacgatcgctgttgtcgggtttgcggtaaaatcggccattatatgaaggactgtcctaagcgaaaatcgctgttatttcgcttaaaaaagaaagattccgaggaggagaaagagggaaatgaggaggaaaaagatagtagagatgtgcttgacccccgcgacctgcatgatacccgagattttagagacccacgtgaccttcggtgttttatctgcggcgatgcaggtcacgtccgccgcgaatgcccagaagtcaaacttgcgcggcagcggaactccagcgtcgccgccgctcagctggtcagaaacctcgtcaacgcccagcaggtcgccggatccgcccagcaacagggcgatcagagcatacggactaggcagtcctccgaatgctccgagtctccatcatacagcccccagccccagccgtttccccagaatagttcacagtctgccgcgatcacacagccgagtagtcagcctggatcccagccaaaactcggccctcctcagcaaggggcccagccccctcaccaggtgcagatgcccctttacaacttccctcagtcccctcctgcacagtattcccccatgcacaacatgggccttttacctatgcaccctctccagatcccagccccttcatggcccatccacggcccagtcatccactccgctcctggaagcgcgccatccaatatcgggctgaacgatccatccataatcttcgcccagccggccgcccggcctgtggcaatcccaaacacctcccacgatggccattggccccgcacagtcgcgcccaactctttggttaattcaggagctgtgggcaattcggagcctggtttccggggtctgacgcctcctataccatgggagcatgctcccagacctcatttcccattggtgccggcaagctggccctacgggctccatcagaacttcatgcaccaaggcaacgcaaggttccagccaaacaagccattttatacgcaggatcggtgtgcgacccgtcggtgtcgagaaaggtgtccacaccccccccgggggaatgtgtcagagtag

SEQ ID NO: 141708 - DNA, 264 bp, Artificial Sequence
  Description of Artificial Sequence: Synthetic coding sequence
atggaggaatccaaaactctcaagtccgagaaccacgaaccaaagaagaacgtgatttgcgaagaaagtaaagcggtgcaggtgataggcaatcagacccttaaggccaggaatgataagagtgtgaaagagatagagaactcctcccccaatcgcaactcaagcaagaagaataagcagaatgacatctgtatcgaaaaaaccgaagtgaagagctgtaaagtaaacgcggctaacctgccaggccctaaggacctgggctag

SEQ ID NO: 141709 - DNA, 234 bp, Artificial Sequence
  Description of Artificial Sequence: Synthetic coding sequence
atggaggagtctaagaccctcaagtccgaaaatcatgagcccaaaaaaaatgtgatttgcgaggaatccaaggctgttcaagtcattgggaatcaaacactcaaagcgaggaacgacaagtccgtgaaggagattgagaactcttctccaaacagaaacagtagtaagaaaaacaagcagaacgatatttgcattgaaaagaccgaggtgaagtcatgcaaagtgaatgcatag

SEQ ID NO: 141710 - DNA, 1209 bp, Artificial Sequence
  Description of Artificial Sequence: Synthetic coding sequence
atggcctccatcattgcaagagtgggcaatagccgaaggttgaacgcgcccctgccgccctgggcacacagtatgctgcgttcactgggtaggtccctaggacccattatggcgtcaatggccgacagaaatatgaaactgttctccgggcgcgtggtgcctgcgcaaggggaagaaacctttgaaaattggctgacccaggttaacggcgtgctccctgactggaatatgtcggaggaggaaaagctgaaaagattgatgaagacgcttcgcgggccagcccgtgaagtgatgcgggtcctacaagcaacaaacccgaacctcagtgtcgccgacttcttgcgagcaatgaaactggtatttggggagagtgagtccagtgtgactgcccatggtaagtttttcaatacactgcaagcccagggagaaaaggcaagcctctatgtaatcaggctggaggttcagctgcagaatgcaattcaggccgggattatagctgagaaggatgcgaacaggaccagattgcagcaactgcttctgggtggggagttgtctcgagatctgcggctgcgactgaaagatttcttacggatgtatgctaacgaacaggaaaggctgcccaattttttggagcttattcgcatggtgagggaagaggaggattgggacgatgccttcataaaacgaaaacggccaaagaggtccgagagtatggtggagagagcagtgagtcctgtggcgtttcaggggtcaccacccatcgtgatagggtccgccgactgcaatgtcatagagatcgacgacactctggacgattcagatgaggacgtgattttagttgagtcacaagacccgcccctgcccagctggggggctcctccacttagggaccgcgctcgccctcaggatgaagtgctggtgattgatagcccccacaactctcgggctcaatttccttccacttcaggaggcagcggatacaaaaacaatgggcctggggaaatgcgaagggcccggaaacgtaaacacacgattagatgtagttactgtggagaggagggccattccaaagagacttgcgacaacgagtccgacaaggcccaggtgtttgagaacctcattatcacactgcaggagctgacgcatacagaaatggagcgctccagggtggcccccggcgaatacaacgactttagtgagccactgtag

SEQ ID NO: 141711 - DNA, 1542 bp, Artificial Sequence
  Description of Artificial Sequence: Synthetic coding sequence
atggccgcctctcgcaacggatttgaggcggtagaggcagaaggatcggccggatgtcgtggatcctctggcatggaagtggttctgcctctcgacccagctgtccctgcccccctttgcccccacggcccaactttacttttcgtgaaagtaacccaggggaaggaagaaacgagaagattctatgcttgctctgcatgtagggataggaaagactgcaacttttttcagtgggaggatgagaaactaagtggcgccaggcttgccgcccgcgaagcacacaatcgacgatgccagcctcctctgtctcggactcagtgcgtggagcgatatttgaaattcattgaactcccactcacccagcgcaagttctgccaaacctgtcaacagctactgctgcccgacgactggggtcagcacagcgagcaccaagtgctgggaaatgtgagcattacccagctgaggaggcctagtcagctactgtatccgctggaaaataagaaaacaaatgcacagtacctatttgcggataggagctgtcagttcttggtggatctgctgtccgcactgggatttcggcgggtgctgtgtgtcggaaccccaagactgcacgaattgatcaagttgaccgccagtggcgataaaaaaagcaatatcaagagcttattattagacattgatttccgatactcccagttctatatggaggacagcttttgccactacaacatgtttaaccaccacttctttgacggaaaaacagcactggaggtgtgccgcgctttcctgcaggaagataagggggagggaataatcatggtgacggaccccccttttggaggactggtcgagcctttagcaatcacatttaagaagctcatcgcgatgtggaaggaaggtcagtcccaggacgacagtcacaaagaactgccgatcttctggatcttcccatacttcttcgaaagccgaatttgtcaattcttccctagctttcagatgctggattatcaggttgattatgataatcatgccctctacaagcacggcaagacgggtcgcaagcagtcacccgtgagaatttttacaaatatcccccccaacaagattatcctgcctacagaagagggttatcgtttctgctccccttgccagcggtacgttagcctggagaatcagcattgcgagctgtgcaatagttgcacaagtaaagatggtcgcaaatggaaccattgtttcttgtgcaagaaatgtgtgaaaccgagctggatccattgttccatctgcaaccattgcgcggtgcccgatcactcttgcgaaggaccgaaacacgggtgttttatttgtggagaactcgatcacaagcgcagcacatgccctaacatcgcaacttcaaaacgggcaaataaagccgtccgcaaacagaagcagcgcaaaagcaacaagatgaagatggagactactaagggtcagtcaatgaatcatactagcgccaccagacgaaagaagcgcagagagagagcccaccagtatcttgggtcatag

SEQ ID NO: 141712 - DNA, 384 bp, Artificial Sequence
  Description of Artificial Sequence: Synthetic coding sequence
atggaggtcgtgctccccctcgaccccgcggttcctgcacccctctgccctcacggtcccaccctcctcttcgtgaaagtgacccaaggcaaagaggaaacacgccggttctacgcctgctccgcttgtcgtgaccggaaagactgtaatttctttcagtgggaagacgagaaactgagtggagccaggctcgccgcccgtgaggcacacaaccgacggtgccagcctcccctttctagaactcaatgtggcaggtacttgaaattcatcgagttgcctctgactcagcgcaagttctgtcaaacatgtcagcagcttcttttgcctgatgactggggccagcattctgagcaccagttttgggtctgcgtcatcacttcatag

SEQ ID NO: 141713 - DNA, 1479 bp, Artificial Sequence
  Description of Artificial Sequence: Synthetic coding sequence
atggtaattctgctgttgcagcacggggcagaccccaccctgattgacggagaaggtttctcctccatacatcttgcggtgctctttcagcatatgcccattatcgcctacctgatcagcaagggccagtccgttaatatgacagacgtaaatgggcaaacacctctgatgctgagtgcacacaaagtaatcgggccagaacccactggctttttacttaaattcaatccatcactgaatgtagtggataagatccaccaaaacacgccacttcactgggctgtggcggctggaaacgttaacgctgttgataaactcttggaggcagggagttctctggatatacaaaatgtgaagggcgagacaccgctggacatggccttgcagaataaaaaccagctgataatccatatgctcaagaccgaagccaaaatgcgggctaaccagaaatttcgcctgtggaggtggttgcagaaatgcgaactttttttgctgttgatgctgtcagtgatcacaatgtgggcgatcggctacatactggacttcaattcggattcgtggcttctaaagggatgtctgttggttacgctgttcttcttgacatccctgttcccgaggtttctggtgggttacaagaatctggtgtatctcccaactgccttcttgcttagctccgtgttctggatctttatgacgtggtttattttgttttttccagatctggccggagctccgttctacttcagcttcatctttagcatcgtggcattcctgtactttttttacaagacctgggccacagatccagggtttaccaaggccagcgaggaggagaaaaaggtcaatatcataaccctcgcagaaaccggctctctggacttccggaccttttgcacatcatgtctcatccggaagccactcagatcgctacactgtcacgtttgcaattgttgtgtggctagatacgaccagcattgcttgtggactggacggtgcattggtttcgggaatcatcactattatatattctttctgttttttctgagcatggtctgtggatggattatttatgggtcctttatctaccttagctcgcattgtgccacaacctttaaggaagacggactatggacgtatctgaaccagatcgtagcatgttctccatgggtgttgtacattctgatgctggcaactttccatttcagctggagcacctttctgctgttgaaccagctgttccaaatcgcatttctgggactgacctcacatgagagaattagcttgcaaaagcagagcaagcatatgaaacagaccctcagcctccggaaaaccccatacaatctcggcttcatgcagaacctggccgacttcttccagtgtgggtgcttcggcctcgtgaagccatgcgtcgtggattggacgtctcagtacacaatggtttttcatccagctcgtgagaaagtgttgaggtccgtgtag

SEQ ID NO: 141714 - DNA, 1869 bp, Artificial Sequence
  Description of Artificial Sequence: Synthetic coding sequence
atggagggaccgggcttggggtctcagtgtagaaatcactcacacgggccccaccctcccggctttgggcgctacggtatttgcgcacatgagaacaaagaacttgccaacgctagggaagcacttccactgatcgaggattcgtccaattgcgatatcgtcaaggccacccagtacgggatattcgagcggtgcaaggaactagttgaagccggctacgacgtcagacaacctgataaagaaaacgtgagtctgctgcactgggccgctatcaacaatcggttggacttggtcaagttctacatctctaagggcgcagttgtggaccaactgggaggcgacctgaatagcacgcctctgcactgggcaattcggcaagggcacttaccaatggtaatcctgttgcttcagcatggcgcggaccctaccctgatagatggggaaggcttctcttctattcacctagctgtcttgtttcaacatatgccaatcatagcttacttgatctccaagggccagtccgtgaacatgacagacgtgaacgggcaaacgccgcttatgttgtccgcacacaaggtgattgggccagagcctactgggttcttgctgaagtttaacccaagtctgaatgttgtggacaagattcaccaaaatacacccctgcattgggctgtagctgccggcaacgtcaacgctgtggacaaattgcttgaggctggttcatcgctcgacattcagaacgttaaaggtgagaccccacttgacatggcactacagaacaaaaatcaattgattattcacatgctaaagaccgaggccaaaatgagggccaatcagaaatttaggctgtggcggtggttgcagaagtgcgaactgttcctccttttgatgctctccgtgatcaccatgtgggcgattggttatatcctagacttcaacagtgattcctggctgctgaaaggctgtctgcttgtaaccctgttctttctgacatcattgtttcccagatttttagtgggttacaagaacttggtctacctccccacagccttcctcttatcgagtgtgttctggatctttatgacatggttcatcctgttctttccagacctcgccggggctccattttacttctcttttatcttttcgattgttgcatttctctatttcttctataagacctgggccacggatccaggattcaccaaagcatccgaggaagaaaaaaaagtgaatataatcaccctggccgagacagggagtttggacttccgcaccttttgcactagctgtcttattagaaagcctttgcgatccctgcactgccacgtctgcaactgttgtgtagcccgatacgaccagcactgcctatggacaggtcggtgcatcggatttggcaaccaccactattacattttcttcctgtttttcttgagcatggtctgcggctggattatctacggaagcttcatctacctgagcagccattgtgcaaccacattcaaggaggacggcctttggacctatctaaatcagattgtcgcttgtagtccatgggtgctttacattctgatgctggccacttttcatttttcatggagcacgttcttgttgctgaatcagctgtttcagatcgcattcctgggactcacctcacacgagcggatctcccttcagaaacaaagcaagcacatgaagcagacactgtccctgcggaagaccccttataacctcggctttatgcagaacctggcggatttcttccagtgcggttgcttcgggcttgttaaaccttgtgtggttgactggacatcacaatatactatggtctttcacccagctagagagaaggtgcttcgaagcgtatag

SEQ ID NO: 141715 - DNA, 564 bp, Artificial Sequence
  Description of Artificial Sequence: Synthetic coding sequence
atgaggagaggctggaagatggcccttagcggcggtctaagatgctgtaggcgggttctgtcttgggtgcccgtgctggtgattgtcctggtagtgctatggtcttactatgcctacgttttcgagctttgcctagtcaccgtgctgtccccagccgagaaagttatttacctgatcctataccacgccatttttgtgttttttacgtggacgtactggaaaagcattttcacattaccacaacagccgaatcagaagtttcatctttcatataccgacaaggaaagatacgagaacgaggaaagaccagaggttcaaaagcaaatgctggtcgacatggcgaagaagctgcctgtgtatacccggacggggtctggggcagtgcgcttctgtgaccgctgtcacttgatcaaacctgataggtgccaccattgttcagtgtgcgccatgtgtgtgttgaagatggatcatcactgcccgtggggaaattatcccgtattcgctctgtcttccatgagcttcttctttagcctctggcccgcctgttttctctcggccctatag

SEQ ID NO: 141716 - DNA, 1014 bp, Artificial Sequence
  Description of Artificial Sequence: Synthetic coding sequence
atgcgacggggatggaaaatggccttgtccggtggcctccgatgctgtcgccgggtgctatcatgggtacctgtgcttgtcatcgttctggtagtgttatggtcgtattatgcctacgtgttcgaactctgcctcgtcactgtcctctcccctgccgagaaggtaatctacctgattctctatcacgcaatcttcgtgtttttcacctggacctattggaagtccatcttcaccctgccacaacagcccaaccaaaaatttcatttaagctacacagacaaagagcgatacgagaacgaggagcgaccagaggttcaaaagcaaatgctcgtggatatggctaagaagctgccggtgtacacccggaccggcagcggagctgtcaggttctgtgatcgatgtcacctgataaaacccgatcggtgccaccattgcagcgtctgtgcaatgtgtgtactgaagatggatcaccattgtccgtgggtgaataactgtatcggtttctctaattataaattctttctgcaatttctggcctacagcgtgctatattgtctttatattgcgactaccgtttttagctacttcatcaagtattggcggggagaactccctagcgttaggagtaagttccacgtgctatttctgttattcgtcgcttgcatgttctttgtttcattggtaattttattcggttatcattgttggctcgttagtcgcaacaagaccacgctggaggccttctgcacaccagtatttacctccggtcccgagaagaatggttttaacttggggttcattaaaaacatacagcaggtgtttggcgacaagaaaaagttctggctcattccaatcgggagctcgccaggggatggacactccttcccaatgcggagcatgaacgagagtcagaatccacttctggctaatgaggagacttgggaggataatgaagacgacaaccaagactacccagaagggagttcatccctcgctgttgagacagagacatag

SEQ ID NO: 141717 - DNA, 987 bp, Artificial Sequence
  Description of Artificial Sequence: Synthetic coding sequence
atgcgccgcggctggaagatggcgcttagcggagggctcagatgttgtaggagagtgttgtcatgggtgcccgttctcgtgattgtgctcgtggtgctctggtcatattatgcgtatgtttttgaactgtgtctcgtcatctatctgattttgtaccacgcgattttcgttttttttacctggacgtactggaagtctatttttaccctcccgcagcagcctaatcagaaattccatctgtcctataccgacaaggaaaggtacgaaaacgaagaacgcccagaagtccaaaaacagatgctcgtcgatatggcgaagaagctgcccgtgtatactagaactggttccggtgctgtgcgcttttgtgatagatgccacctgatcaagcctgatcggtgccaccattgtagtgtgtgcgcgatgtgtgttctcaagatggatcatcattgcccctgggttaataactgtatcggtttctctaattacaaattcttcttgcagtttcttgcctactcagtgctgtattgcctctacatcgctactactgtttttagctactttattaagtactggcgcggagaactaccgtctgtgcggtccaagtttcacgttctattcctgcttttcgtggcatgcatgttttttgtcagcctggtgatactttttggttatcattgttggcttgtgtcacgcaataaaacgacattagaagcgttctgcactcctgtgtttacttcagggcccgagaaaaatggattcaacctgggctttattaaaaacatccaacaggtgttcggagataagaaaaaattctggctcattcctatcgggagtagcccaggggatgggcacagtttcccgatgcgttctatgaacgagtcccagaacccactgctggctaatgaggagacttgggaagacaacgaggatgacaaccaggactacccggaaggtagttcttccctcgccgtggaaaccgaaacatag

SEQ ID NO: 141718 - DNA, 2022 bp, Artificial Sequence
  Description of Artificial Sequence: Synthetic coding sequence
atgccccgctcacccggcaccaggctgaagcctgccaaatatattccagttgctactgcagcggccctgctcgtgggctcttctacattgttctttgtcttcacgtgtccttggctcacaagggctgttagtcctgcggttccagtgtacaacggcattatcttcttattcgtgctcgccaattttagtatggccacgttcatggatcccggggtgttccccagagccgatgaggacgaggataaggaagacgacttccgcgctccactgtataaaaacgtagacgtcagaggcatccaggtgcgcatgaagtggtgtgctacatgtcatttctatcgcccgccacgttgctcacactgctcagtctgtgacaactgcgtggaggtgaccggcaaattccgaggcggtgtaaatccttttacacgcggctgctgtggaaacgtagaacatgtgctgtgttctccgctcgcaccccgatacgtggtggagccaccccggctccccctggccgtatccctcaagcctccgtttctgcggccagaacttctggaccgcgcagctccattgaaagtgaagctgtcggataatggactgaaggccggcctggggcgctcaaaatccaaggggagtctggacaggcttgacgaaaaaccccttgacctgggtccacctttaccacctaaaattgaggcaggaacgttcagctcagacttgcagacccctcgccccggatctgcagaaagcgccctctcagtgcagcgcacgagccctccaacacctgccatgtataagttccgacccgcgttccctaccggcccaaaggttccgttttgcgggcccggggagcaagtgccagggccagactcactcaccctgggtgacgacagtattcgctccctggacttcgtctcggagccttccttggaccttcccgactatggccctggtgggctacacgcagcttaccccccttcaccaccgctgtccgcttcggatgcttttagtggggctttacgtagcctgagcttaaaagccagcagtaggcgggggggagaccatgtggcgcttcagcccctccgctcagaaggtgggccccccacgccccaccggtccatcttcgccccacacgccctgcctaaccggaatgggagtctcagttacgattctctgctcaatcctggatcaccaggaggccacgcttgcccagctcaccccgcagttggagtggccggctatcactctccttatctgcaccccggtgcaacgggggaccccccccggcctctccctcgtagctttagcccagtgctagggccaaggccccgcgagccttcaccagttcgttatgataacttgagtcggactatcatggcgtcaatccaggagcggaaggatcgtgaagagcgagagagactcttgcggtctcaggccgattctctgttcggtgactccggcgtttacgatgccccctcctcttacagtctccaacaagcatctgttctcagcgaaggtccaagggggccagccttaaggtacggaagtcgggacgatctagtggccgggccgggatttggcggtgcaaggaacccagctcttcagacttctctcagtagtctgagttcatccgtttctagggctccaaggacctcttcatctagcctgcaggccgaccaagctagctcgaatgctcctgggcctcgccccagttctggctcacacaggtcccctgctaggcaggggctgcccagtccgccagggactcctcattccccaagctatgccggacctaaggctgttgccttcatccatactgatcttccagagcccccccccagcctcaccgttcagcgtgatcacccccagctaaaaacaccgcccagcaaactgaacggccaaagtcctggtcttgccaggctgggaccggccacaggacctccaggccctagcgcgagtccgactcgccatactttggtaaagaaggtgtctggtgtggggggaactacgtatgagatctccgtgtag

SEQ ID NO: 141719 - DNA, 2298 bp, Artificial Sequence
  Description of Artificial Sequence: Synthetic coding sequence
atgcctaggtccccagggacccggttaaagccagccaagtatatccctgtcgcgaccgccgccgccctactcgttggttcttcgacactgttcttcgtgtttacctgtccgtggctaacccgtgctgtgtctccagcagtgccagtttacaacggcatcattttcttatttgtcctggccaatttcagtatggcaacttttatggatccgggggtgtttccccgagccgacgaggatgaagataaggaggatgattttcgggccccattgtacaagaacgttgatgttcgaggcatccaggtccggatgaaatggtgtgcgacatgccacttttaccgtccaccccggtgctcacactgctctgtgtgcgataactgcgttgaggattttgaccatcactgtccttgggtgaataattgcattggccgaaggaattaccggtacttctttctgtttctgctcagcctttcggctcacatggtcggagtggtggccttcgggctggtgtatgtgctgaaccacgcggagggcttgggggcagcccacacgacaataactatggccgtcatgtgcgtggctggcctgtttttcataccagtgatcgggttgaccggcttccatgttgtgctggtgactagaggccggacgactaacgagcaggtcactggcaaattccgcggcggagtgaatccgtttacccggggttgctgtgggaatgtagaacacgtcttgtgtagtcctttggctcccagatatgtggtggagcccccacggctacctcttgccgtgtcccttaaaccccccttcctccggccggaactcttagaccgcgctgcaccacttaaggtgaaactctccgacaatggcctcaaggcagggctgggacgctcgaaaagtaagggttccctggacaggctcgacgaaaagcccctggatctgggccctcccctacctcccaaaattgaagccggcacattctcctcggatctccaaactccacgcccaggcagcgccgaaagcgcactgagtgtacagcggactagcccccctacgcctgccatgtataaattccggcctgccttcccaaccgggcccaaagtaccattctgtggacctggtgaacaggtgcctggacctgatagcctgactctgggggatgactcgatcaggtcattggacttcgtctctgaacctagtctggatcttcctgactatggaccaggcggactccatgcagcatatcccccatcaccccccctcagtgcgagtgacgccttttccggtgcactgcggtccctcagtctaaaggcgtcctcccggcgagggggcgatcatgtcgctctgcagcccttgcgcagcgaaggtggcccaccaacacctcatagatcaatttttgccccacatgcactgcctaaccgcaatgggagcctgtcctatgactctctcctgaaccctggttctccaggtgggcatgcttgtccagcacacccagctgttggcgtggccggctaccactcaccgtatctgcatcccggggccacgggagacccacccagacccctccctagatccttctctccagtcctaggaccccgtccacgagagccttctcccgtccggtatgacaatttaagcagaactatcatggcctctattcaagaacgtaaagacagggaagagcgggaacggttactgcgctcgcaggcagattctctgttcggagactctggggtctatgacgcaccttcatcttattctctgcagcaggcttctgtgctgtcagaagggcctcgcggtcctgccttaaggtacgggagcagagatgatcttgtcgcggggcccggcttcggcggagctaggaaccctgccttgcagaccagcctgtccagtctctcgtccagtgtttcacgcgccccccgtacctccagcagttctctgcaagcagatcaagccagttctaatgctcccggcccgcggccatcctcagggagccaccgttctccagccaggcagggcctgccaagcccgcccggcacacctcattctccctcctatgccgggcccaaggccgtagccttcatacatactgacctacctgaaccacctccgtccctcactgtgcaaagggatcacccccaactgaaaacaccaccttctaaactcaacggccaaagccctggactggccaggctcgggcctgctaccggccctccaggcccttctgctagtccaacaagacatacccttgttaagaaagtcagtggcgttggaggaacaacttacgagatatcagtctag

SEQ ID NO: 141720 - DNA, 2337 bp, Artificial Sequence
  Description of Artificial Sequence: Synthetic coding sequence
atgccccgcagccctgggacaagactcaaaccggcgaagtacattcccgttgcgactgcagctgcactgttagttggaagttctacgctattcttcgtgtttacttgcccttggctgacccgtgctgtttcaccagcagtgccagtttacaacggaatcatttttctgtttgtgctggccaacttttctatggctacatttatggaccccggagtttttccacgcgccgacgaagatgaggacaaggaggatgatttccgggctcccttgtataagaacgtcgacgtgcgtggtatccaggtgcgcatgaaatggtgtgcaacatgtcacttctatcgtccacctaggtgcagccactgttccgtgtgtgacaattgcgtagaggactttgaccaccattgcccatgggtcaataactgcatcggaaggcggaactaccggtattttttcttgtttctcctgtctctgtccgcccatatggttggagttgtggcctttggtcttgtgtatgtgctgaatcatgctgaagggctaggcgcagctcataccaccattaccatggccgttatgtgcgtcgctggcttgttctttatcccggtaatcggcttgacgggcttccacgttgttttggtcacgaggggcagaacgaccaatgagcaggtgaccggcaaattccggggcggcgtcaacccttttacaagaggatgctgcggaaacgtggagcacgtgctgtgttcaccattggctccgaggtacgtcgtggaacctccgcggcttcctctcgctgttagcctgaagccgccatttcttagaccagagctgctggatcgagcagcccccctgaaggtgaagctgtcggataatggcctgaaggctggccttggtcgatctaaaagcaagggaagcctggatcgactcgatgagaagcccctcgacctgggaccccctctgcctcctaaaatcgaagccgggacattcagcagcgatctccagacgccaagacctggctccgctgagtctgccttaagtgtgcagaggacatcacccccaacgcctgctatgtacaagtttcggccagcatttcctacaggccccaaagttcctttctgtggccctggagagcaggtgccgggccccgatagcttaactctgggcgatgactccatcagatctctggactttgtgagcgaaccatctttagatttgccagactacggaccaggaggactacacgcagcatacccccccagccctcctctgagcgcttcagacgcatttagcggtgccttgaggtccctatcgctgaaggcgtcttccagacgtggcggggaccacgttgctctccagccgctgcgttctgagggagggccgcccacacctcatcgtagtatcttcgccccccatgcactgcccaaccgaaatggatctctcagttacgattctctcctgaacccagggagtcctggcgggcacgcatgccccgcacaccccgcagtgggagtggccgggtaccactccccatatctgcatccaggggctaccggagatccgcctagaccactgcctaggagcttttcccctgtcctgggacctagacctagagagcccagccccgtccggtatgataatctatctcggaccatcatggcaagcatccaagaacgaaaagaccgtgaggagcgcgaaaggctgctgaggtcccaggctgacagcttgttcggcgattcaggtgtttacgacgcaccttcctcttattctctccaacaggccagcgttctctccgagggccccagagggcctgccctgcggtatggcagtagagatgatctggttgccggcccagggttcggtggggcaaggaatcccgcattgcaaacgagcttgtcgtcgctgagctcgtcagtttccagagccccacgaaccagctcgagtagcctgcaagctgaccaggcaagcagcaatgcacccggcccgcgcccatcttccgggtcccatagatcaccagcccggcagggtctgcccagcccacctggcaccccacatagcccgagctacgctggccccaaggcagtcgcctttattcacacagatctgcctgaaccccctccaagcctaaccgttcagcgcggcaggatcggcacctgcacccggggatggggcagacgaggccagccatgggtgccacctggtctacatctgtgccacctgggccggcctgaggaccgcccaccgctgcgagctccttggtcacaagctgccggagcccctcctagaggcgccatgtgccggcttcatctggccgcatcttcactgttccccagcctgagtggcccatag

SEQ ID NO: 141721 - DNA, 1095 bp, Artificial Sequence
  Description of Artificial Sequence: Synthetic coding sequence
atgtcggttatggtggtacgcaagaaagtgacgcggaaatgggagaaacttcccgggcgcaacacattctgctgtgatggcagagtcatgatggctaggcagaagggcattttctatttgaccctgtttcttattctgggaacatgcacactgttttttgcattcgagtgtcgctatttggccgtgcagctatctcccgctattcccgtgtttgcggctatgcttttcctgttctctatggctacgcttctgaggacctctttttccgatccaggcgtgatccccagagccttacccgacgaagctgcgttcatagaaatggagatcgaggccacaaatggagcggtgccccagggtcaaagaccaccgcctagaataaagaatttccagatcaacaaccagattgtcaagctgaagtattgttatacctgtaaaattttccgccctcctcgcgcttctcactgttcaatctgtgacaactgcgtggagcgctttgaccaccactgtccttgggtggggaactgtgtcggcaaacgaaactaccgatacttttacctctttatcctctccctcagcctgcttacaatctacgtgttcgcttttaatatcgtgtacgtcgccctcaaatccttgaagatcgggtttctggagacactcaaggagacgccaggcaccgttttggaagtcctcatctgttttttcaccctgtggtctgtggttggactgacagggtttcacaccttcctggtcgcgttgaaccagacaactaacgaagacatcaagggatcctggacggggaagaacagagtgcaaaatccttactcccacggtaacatcgttaagaactgctgcgaggttttgtgcgggccactgcccccaagcgttctggacaggcggggaattctgccccttgaggaaagcggaagtaggccgccctccacccaggagacatcaagcagcctgctgccccagtccccggctccaacagagcacctgaatagcaatgaaatgcccgaagacagtagcacccctgaagagatgcctccgccagaacctcctgagccaccccaagaagctgccgaagccgagaaatag

SEQ ID NO: 141722 - DNA, 1095 bp, Artificial Sequence
  Description of Artificial Sequence: Synthetic coding sequence
atgagcgtaatggtggtgagaaagaaggtgacaagaaaatgggagaaactacccgggaggaatacattctgctgcgatggacgggtgatgatggctcgacaaaaggggatattctacctcaccctgttcctgatacttggtacctgtaccctctttttcgcttttgagtgcagatatctcgctgtccaactttcccctgcaataccagtttttgctgccatgctgtttctcttcagcatggcgacccttttgaggacgtcattctcagaccctggcgttatcccccgcgccttgcccgacgaggcagcctttatagagatggaaattgaagcaaccaacggggccgttcctcaagggcagagacccccaccccggataaagaactttcagatcaataaccaaatcgtgaaactgaagtattgctatacatgtaagatctttcggccgccaagagcttcacattgctctatttgcgacaactgtgtcgagagattcgaccaccactgtccctgggtaggcaattgtgtgggcaagaggaattaccgttatttctatctgtttatcctatctctgtcactcttaaccatctacgtttttgcatttaatatcgtttacgtggccttgaaatccctgaaaatagggttcttggaaacgctgaaagagacacctggcactgtccttgaagtgctaatctgcttttttacactgtggtccgttgtgggactgacaggctttcatacatttttagtggctctcaatcagactactaacgaagatatcaaaggaagctggacggggaaaaatcgggtacagaatccttactcacacgggaacattgtgaagaattgttgtgaggtcttgtgcggacctttgcctccgagcgtgctggacaggaggggtatcctgccactcgaagagtccggctcccggccaccgagcacacaggaaacctcctcgtccctgcttccccaatcccctgctcccactgagcatttgaactccaatgagatgccagaggattcttcaactccggaggaaatgcctcctcccgaacccccagagcccccccaggaggccgccgaagcagagaagtag

SEQ ID NO: 141723 - DNA, 513 bp, Artificial Sequence
  Description of Artificial Sequence: Synthetic coding sequence
atgagcgtaatggtggtccggaagaaggtgacgcgtaagtgggagaagcttccgggaaggaacacattctgttgcgatggacgggttatgatggctcggcaaaaagggatattttacctcacattgttccttattttaggcacctgtactctattttttgcgttcgagtgccgatacttggccgtccagctgagccccgccatcccagtttttgccgctatgttgttcctgttctctatggccacactcttacgcacatccttcagcgacccaggcgtgattcctagggccttaccagatgaagcggctttcatagaaatggaaattgaagccactaacggagctgtgccccaagggcagaggccacccccccgtatcaagaactttcagattaataatcagatcgtcaagttgaagtattgctatacctgtaagatcttcagaccaccgagggcaagccactgtagtatctgtgacaattgtgttgaacgcttcgaccatcactgtccttag

SEQ ID NO: 141724 - DNA, 585 bp, Artificial Sequence
  Description of Artificial Sequence: Synthetic coding sequence
tagctttttcttattctcggtacttgcacactttttttcgctttcgaatgtagatacctcgctgtgcagctaagtcccgctatccccgtttttgctgcaatgcttttcctgttctccatggcaacccttttgcgtaccagcttctcagatccaggcgtcattccacgcgccctcccagacgaagcagcattcatagagatggagatcgaagccaccaacggggccgtgcctcaaggacagcgacctccccctagaatcaaaaactttcaaataaataaccagattgtcaagctcaaatactgttatacatgtaagattttcagaccccccagagcttcccactgcagtatttgtgataattgcgtcgaatccctgaaaattggctttctcgagaccttaaaggagacacccggcacggtgttggaggtcctgatctgcttcttcactctgtggtctgtcgtcgggctcactgggttccacaccttcttagtggcgctgaatcaaaccacaaacgaggatatcaaaggatcctggacagggaagaatagagtgcaaaatccctattcgcacggcaatattgtatag

SEQ ID NO: 141725 - DNA, 897 bp, Artificial Sequence
  Description of Artificial Sequence: Synthetic coding sequence
atggaacgcgggatttcagacgtcaccgaccgcaagttgacaatggaggaggaggaggcgaaacgaattgctgaaatgggaaagccagtgcttggggaacacccaaagctggaggtcattatagaagaaagctatgagttcaagaccaccgtcgacaaactgattaagaagacaaatttggctttggtagtcgggactcattcttggcgcgatcagttcatggaggctattaccgtttctgcagcgggcgatgaggacgaggatgaatccggagaggagaggctcccgtcttgcttcgactacgtgatgcacttcctgacagtgttctggaaggtcttgtttgcatgcgtccctccaaccgagtactgtcatggatgggcctgttttgccgtgtcaatcctcattatagggatgctgacagccatcataggggatcttgcctctcactttggctgcaccattggcctaaaggatagcgtcacggcagtggtcttcgttgccttcggcacatccgtcccggacacgtttgcttccaaggccgccgctctgcaggatgtctatgctgatgcctccatcggaaatgttaccgggtccaacgccgttaatgtgtttctgggaattggcctcgcctggtccgtggccgccatctattgggcattgcaggggcaggagtttcacgtgagcgccgggacactcgctttttctgtgaccttgtttacgatcttcgcctttgtgtgtatttcagtgctactttatcggaggagaccgcacctgggaggtgaactgggaggcccacgcggatgtaagctggcaaccacatggctcttcgtgtcactttggctgctatatatattattcgccacgctggaagcttattgctatataaaggggttttag

SEQ ID NO: 141726 - DNA, 705 bp, Artificial Sequence
  Description of Artificial Sequence: Synthetic coding sequence
atgagcagtgaggtgtctgcacggagggacgcaaagaagcttgttaggagcccctccggacttagaatggtccccgagcaccgagcctttgggtcgccttttggtctggaggagccccaatgggtccccgacaaggagtgtcgcaggtgtatgcaatgtgatgcgaaattcgactttctgacccgcaagcaccactgccggagatgcggcaagtgtttctgtgaccgatgctgctcacagaaggtgccactgcggcgtatgtgtttcgtcgaccctgtcagacagtgtgccgaatgtgccctggtcagccttaaagaggcagagttctatgataagcagctgaaggtactgctgtccggcgcaacttttctggtgacctttggtaacagcgagaaacctgaaaccatgacctgtcggctctcgaataatcaacggtacctgtttttggacggagactcgcattacgagatcgagatcgtgcacatctctactgtacagatattgacggaaggcttcccaccaggcggcggaaacgcaagagcgacaggaatgttcttacagtataccgtgccagggactgagggcgtgactcagctcaaactgactgttgtggaggacgtcaccgtaggtagaaggcaggccgttgcatggctggtagcaatgcacaaagcagcaaagcttttgtacgaatcaagggatcagtag

SEQ ID NO: 141727 - DNA, 7620 bp, Artificial Sequence
  Description of Artificial Sequence: Synthetic coding sequence
atgaaccatccgttcgggaaggaagaagccgcaagtcagaagcagttattcggctttttttgcgagtgcttgagaagaggggagtgggagctagcgcaggcctgcgttccccaactgcaagagggccagggggacatccctaaacgcgtcgaggatatattgcaggctctggtggtatgtccaaatctgctcaggtgtggccaggatatcaatccgcagcgggttgcttgggtctggttgttagtgctagagaagtggttggcacgagagaagaagctcctgccggtggtcttccgcagaaaactcgaatttcttctcctctccgaggatctgcagggggacatccctgagaacattctggaggaactgtacgaaaccctaacgcagggggcagtgggtcacgtcccagacggcaacccccgacgcgaaagctggaccccaagactctcttctgaggccgtgtcggtcctgtgggatctcctcaggcagagccctcagccagcccaggcactgctcgagctgttgctcgaagaggacgatggaacaggcttatgtcattggcctcttcagaatgcactcgttgatttgatcagaaaggccctgcgagctctccagggcccagactctgtgccccctggtgtggtcgacgccatctatggcgcgctccggacccttaggtgtccagccgagcctctaggggtagaactccatctgctgtgcgaggaattactggaagcctgcagaacggaagggtctcctttgcgagaggaaaggctactctcttgcctcctccataaagcttctagaggactactgtccctttatggccacacctacgcagagaaggtgaccgaaaaaccacctcgagccacggcttctgggaaggtcagtcctgatcacctcgatcccgagagggcgatgctggccctgttcagtaatccaaatcccgccgaggcttggaaagtggcatacttttactgtcttagcaacaacaagcacttcttggagcaaattctggtgacagcgcttacgctactgaaggaggaggatttccccaatctggggtgcctgttggaccgcgagttcagacccctgtcctgtctcttggtgttactcggatggacacactgtcagagtctggaatctgcaaaacgacttctccagaccctccaccgtacccagggtccaggctgtgacgaattactgagagacgcctgtgatggtctctgggctcacctggaagtcttggagtggtgtattcagcagagcagtaatcctatccctaagagggacttgctctatcatctgcacggcggcgacagccacagcgttttgtacactctgcaccacctgaccaatcttcctgctctccgagaagaagacgtcctgaagttgctgcagaaagtccccgctaaggatcctcagcaggagccagacgcagtggatgcccccgtcccagagcatctatcccagtgtcagaacctaacactgtatcaaggcttctgcgccatgaagtacgcaatctatgcgctgtgcgtgaactcacatcaacactctcaatgccaggactgcaaggacagcctatctgaagacctcgcctccgccaccgaacctgccaatgacagtttaagcagcccaggcgctgccaacctgttttcaacttatctcgcacgatgtcagcagtatttgtgttccatccccgattcattatgtctggagctgctggaaaacattttttccctcctgctcatcactagcgcagatctgcatccggaaccacacttgcccgaggattatgccgaggacgacgacatagagggtaaaagcccatccgggctgcgtagcccgtctgaatcacctcagcacatcgctcaccctgaaagaaaatctgaacggggctccctgggagtgcctaaaacgctcgcatacacaatgcctagtcacgtgaaggctgagcccaaggacagttatcctggcccacaccgccacagttttctggacctgaagcatttcacaagcggtattagtggcttcctggccgacgagtttgcgatcggtgcatttctgcggctgctacaggagcagctggacgagatttcgtcaaggagtccccccgaaaaaccaaagcaagaaagccagagctgtagcggaagccgcgacgggctccagagtcgcctacacaggttatctaaagtggtgagtgaggctcagtggagacataaagtcgtgacttctaaccatcgctcagaggagcagccttctcgaagataccagcctgctacccgtcacccctccctgcggcgcgggcgcagaacaaggcggtctcaggccgatggacgcgaccgtgggagcaatccaagcctggagtctacaagctctgagctgagcacttcaacgtcagaggggtcactctccgcaatgtccggccggaacgagctccacagtcgactgcaccctcaccctcaatcctcactgattcccatgatgttttccccccctgaatcattgttggcgagctgcatcctgaggggcaacttcgccgaagcccatcaggtgctgttcacctttaatctgaagagttccccttcttccggggaattaatgtttatggaaaggtaccaggaggtgattcaggagctggcccaggtggaacacaagatcgagaaccagaactctgatgctggtagttctacaatcagaagaactggctccggaagatctacattgcaggcgatcggatccgccgctgcggctggcatggtattctatagcattagtgacgtcaccgataagctgctcaacacctcaggcgatcccatacctatgttacaggaggatttctggatttcaacggctcttgtggagcctaccgctcctctaagggaggttctcgaagatctgagcccacctgccatggccgcctttgatttagcatgtagccagtgccagctgtggaaaacttgtaaacagctgttggagacagcagaacggaggctcaattcatcgctggaaaggagaggccgtaggatcgatcacgttctactgaacgccgatggcattcgtggattccctgtggttcttcagcaaatcagtaagagtttgaactacctcctgatgagtgcctcccaaactaagagcgagtcagttgaggaaaaagggggcggccctccgcggtgctcaattacagagttacttcagatgtgctggccatccctgagcgaagactgtgtggcaagccatactaccttaagtcagcagcttgatcaggttttacagtccttgcgtgaggccctcgaactcccagaacctcgcacacccccgctctcctcattggtagagcaggcagcccagaaggctcccgaagcagaggcacatcctgtccaaatacaaactcagctcctccagaaaaacttaggcaaacagactccgagcggctctagacagatggactacctgggtactttcttctcatactgtagcacgctggccgcagtgctactgcagtccctgtcgtcagaacctgaccatgtcgaggtgaaggtgggcaatccatttgtgctgttgcagcagagttcttcccagctggtgagtcatctgttgttcgaaagacaggttcccccagaaagactggctgcgctgctggcacaagagaacctatctttgagtgtcccacaggtgattgtatcgtgctgctgtgaacccctggctctgtgtagttctaggcaatcacaacagaccagttccctgttgacacggctgggaactcttgcgcagctacatgctagtcactgcctagatgacctgccactgtccacaccaagctctccgcgcacgacagaaaatccgactctggagagaaaaccgtactcctctcccagggatagtagcctcccagcactcacctctagcgcattggcatttttgaagtctagatctaagctccttgccaccgtggcttgcttgggcgctagcccacgcctgaaagtttcgaaaccttctctgtcttggaaagagctgcgcgggcggagggaagtgcccctcgcggcagaacaggtggcaagagagtgcgagagacttctggagcagtttcctctgtttgaggccttcttgctggcggcttgggaacccctgaggggatcccttcagcagggccagtctctggcggtaaatctgtgtggctgggcttccctgtcaaccgtgctcttaggccttcacagccctatcgccctggacgttttgtcagaggctttcgaggagagtctggtagcccgggactggtcacgggcactgcaattaactgaggtgtatggcagagacgtcgacgacctgtcatccattaaggatgctgtcctctcatgtgcagtggcttgtgataaagagggttggcagtacctgtttcccgtaaaagacgctagcctgcggtctagactagctctccagtttgtggaccgctggcccctggagagttgtctggagattctggcctattgcatctctgacaccgcggtgcaggaagggcttaagtgtgagctgcagcgcaagctggccgagctgcaggtctaccagaagatcctggggctccagtctccccccgtgtggtgcgattggcagaccctgcgcagttgttgtgtggaagacccaagtactgtgatgaacatgattttagaagctcaagagtacgaactctgcgaagagtggggatgcctgtaccctatacccagggaacatttaatttccctgcaccagaagcacttactgcatctactggagcggcgggaccatgataaagccctacagctcctcaggagaatccccgaccctacgatgtgtctggaagtgacagaacagtccctggaccaacatacatcgctggctacatcccacttcctggctaattacctgacgacccacttctatggccagttaacagcggtccggcatcgcgagatccaggcactgtacgttggcagtaagatcctgctcacactccctgaacagcaccgagcttcctactcacatttgtcctcaaatccgctttttatgcttgagcagctgcttatgaacatgaaggtagattgggccaccgtcgctgtccagactttacaacaactgctagtgggtcaggagatcggtttcaccatggacgaagtcgactctctcttgtcaagatacgctgagaaggccctcgactttccttatcctcaacgagaaaagcggtccgactctgtgatacatctgcaggaaattgtacaccaggcagcagatccggaaacattaccacggagccccagtgcagagttctcccctgccgcccccccggggatctcatcaatccactccccaagtttgcgcgagcgctcttttccgccaacccagccatcccaggaattcgtacctcccgcgacacccccggcgcgtcatcagtgggttccagatgagactgagtccatctgtatggtgtgctgccgcgagcactttacaatgtttaaccgacggcatcattgccgcagatgcggccggctggtctgttcgtcatgtagcactaaaaagatggtggtggagggctgtcgcgagaatcccgcccgagtttgtgaccagtgttatagctattgtaacaaggatgttcctgaggaacctagcgaaaagcccgaagccctggattcatctaagaacgagagcccgccatatagttttgtggtgagagtccctaaagcagacgaggtcgaatggattctcgatttgaaagaagaagagaacgaactagttcgcagcgaattctactatgaacaagcacccagcgcctctctgtgcatcgccattctgaacctacacagggattccatagcatgtggccatcagctgatcgagcattgttgcagattgtcgaaagggctgaccaacccggaggtggacgccgggctgctcactgatattatgaagcagctgctattttctgctaagatgatgtttgttaaagcagggcagagccaggacctggctctctgtgattcctacatctctaaagtagatgtcttaaacatcctggtcgcagcagcctatcgccacgttccttccctggaccagatcttgcagcccgccgccgttacacgcttgcgtaatcaactcctagaggcagagtattatcagttgggtgttgaagtatccaccaaaaccggcctcgacactaccggagcgtggcatgcctgggggatggcgtgtctcaaggccgggaacctgaccgcagcgagagagaagttcagcagatgtctaaaaccaccattcgatcttaatcagttgaaccacggtagtaggcttgttcaggatgtcgtcgagtacctggagtccacagtgcggcccttcgttagccttcaggatgatgattactttgcgacactccgcgagcttgaggccacactacgtacacagtcactctccctggctgtgatacccgaggggaaaatcatgaataacacatactaccaggaatgtctgttctaccttcataactatagcacaaacctggcaataatctcattctatgtccgtcactcatgtctgcgcgaagccctgcttcacctcctgaataaggagtcccccccggaagttttcatagaagggatttttcagcctagttataaatccggcaagctgcacaccctggaaaatttgctggaatcaatcgatcccaccctggagagctggggaaagtatctgattgccgcttgccagcatctccagaaaaaaaattactatcacatcctgtacgagctgcaacaatttatgaaagaccaggtgcgcgccgcaatgacctgtatccggtttttctcccataaagcaaagtcttatactgaattaggggagaaattgagctggcttctgaaagccaaggatcacttgaagatctacttacaagagacgagtagatcctcaggtcggaagaagacaacgtttttccgcaagaagatgactgcagccgatgtcagccggcatatgaataccctgcaattacagatggaggtgacacgatttctgcatcggtgtgaaagtgctggtacatcccagatcactacccttcccctccccaccctctttggaaacaatcatatgaaaatggatgtggcctgtaaggtgatgctgggtggaaagaatgtagaggatggcttcggcattgcatttagagtcctgcaagactttcagcttgacgcagccatgacctactgccgcgctgctcgtcaactcgtcgagaaagagaagtattccgagatccaacagctgcttaagtgcgtgagcgagtctggtatggccgctaagtccgacggagatacaattctgctcaattgcctggaagcctttaaacgcatcccgccccaggaactcgagggcctgattcaggccattcacaatgatgacaacaaggtgagagcctatctgatctgctgcaagctccggtctgcttacttaatcgcggtgaaacaggaacacagccgggctaccgcactggttcagcaggtgcagcaggccgcaaagagttccggagacgccgtcgtgcaggatatatgtgcccagtggttgcttacgtctcatccccggggcgctcacggaccaggctcacgcaagtag

SEQ ID NO: 141728 - DNA, 7557 bp, Artificial Sequence
  Description of Artificial Sequence: Synthetic coding sequence
atgaaccatcctttcggaaaggaggaggcagcctcgcagaaacagctgttcggcttcttctgcgaatgcctgagacgcggagaatgggaactggcccaggcctgtgtgccccagctgcaggagggacagggggatatccccaaaagagttgaagacattctacaggctctggtagtctgccctaatctgctccgatgcggtcaggatatcaacccccaacgagtcgcatgggtgtggctcctggtgctcgaaaaatggcttgcaagagaaaaaaagctcttaccagtcgttttcaggagaaagctggaatttttactcttgtccgaagaccttcagggggacataccagaaaacatcctggaggagctatatgaaaccctcacccagggtgcagtcggtcacgtgccggatggcaacccccgacgggaaagttggacgcctagattatcctcagaggccgtcagcgttttatgggacttgctgcgccaaagtccccagccagctcaggctctcctcgagttgctgctggaagaggacgatgggaccggtctgtgtcattggcccctgcagaatgccctcgtagacttgattcggaaggcacttaggaccctgcggtgtccagccgaacccctgggagtggagctgcacctgctctgcgaggagctgttagaagcctgccgtaccgaagggagtccactgcgggaagagcgactacttagttgtttgctgcataaggcttctagaggtctgctgagcctctacggacacacttacgccgaaaaggtcaccgagaagccccctcgggccacagcctccggaaaagtctcacccgaccacctggatcctgagcgggcaatgctggctctcttttctaatcccaatccagcggaggcttggaaggtggcatatttctactgccttagtaataataaacattttctggagcagatcctggtgaccgctctcaccctgctgaaggaggaagatttcccaaaccttggatgccttttagacagggagtttaggcccttgagctgcctgttagtgttgctgggatggacgcactgccaatctttagagagcgctaagcgcttgctacagaccttacacagaacccagggtcctgggtgtgatgagctgctcagagacgcgtgcgacgggctgtgggcacacttagaggtgctggagtggtgcatccaacaaagcagcaatccaatccccaagcgggacttactgtatcaccttcatggcggtgattcccattccgtgctctacacccttcatcatttgacaaatctgcccgcgctccgcgaggaggacgtgctcaagctactgcagaaagtaccagcgaaagatccccaacaggaaccagatgctgtagatgcgccggtgcctgaacacctttcgcagtgccagaacctaaccctctatcagggattctgtgccatgaagtacgcaatatatgcactctgtgtgaattctcatcaacacagccagtgtcaagattgcaaggactcgttatctgaggacctcgcttctgctacagaaccggccaacgattccttatcctcgcctggcgctgccaacctgttctcaacctatctagccagatgccagcagtatctatgcagcatccctgattccttgtgcttggaacttttggagaatattttctctttgttgcttatcacctccgctgacttgcatccggagccccatctgcccgaagactatgcagaggatgacgacatcgaaggaaagtccccttcgggactcaggtcaccctctgagtctccccaacatatcgcccacccagaacgcaaaagcgagcgcggctccctgggcgtacccaaaaccctggcatacaccatgcctagccacgtcaaagccgaacccaaggactcatatcctggcccgcaccgccactctttccttgacctgaagcattttacaagcggcatctctggattcctggctgatgagttcgcgatcggcgcctttctgcgcttactgcaggagcaactagacgagatctcgagtcggagccccccagagaagcccaaacaggagtcccagtcttgctctgggtccagggatggtttgcagtcccgactgcatagactgagtaaggtcgtgagcgaggcacagtggcgacacaaggttgtgacctccaaccatcgcagtgaagagcaacctagcagacggtatcagcccgcaactcgtcacccctcgctgagacgggggcgaaggaccaggcgatctcaggccgatggaagagaccgcggctcaaacccttcgttggagtccacctcaagtgaactcagtacctcaacatcggagggatcactttccgctatgagcgggagaaatgaattgcacagtcgcctgcatccacacccgcaatcctcactgatacccatgatgttctcaccccccgagtctcttctggcgagctgcattctgcgcgggaacttcgccgaggcccatcaggtgctcttcacctttaatcttaaatctagccccagctccggcgaactgatgttcatggagcgctatcaagaggtgattcaagagctcgcccaggtggagcataaaattgagaaccagaactccgacgctgggagttcaaccattcgtcgaactgggtccgggcggtctacccttcaggctattggttctgcagccgctgctggcatggttttctactcaattagcgacgtgaccgacaagttgcttaacaccagcggcgacccaattcccatgcttcaggaagacttttggattagcactgccctcgtagaaccaaccgccccattgagagaggtgcttgaagatctgtcaccccctgcaatggccgcgttcgacctggcttgttctcagtgccagttgtggaagacctgcaaacagttgctcgagaccgcggaacgccgtttgaatagctcactggaaagacgtgggcgaagaattgaccatgttctgctgaacgccgatggaattcggggctttccagtggtactccagcaaatatccaagtccctgaattacctgctcatgagcgcctcgcagaccaagagcgagtctgtggaagaaaaaggtggtgggccaccacggtgctccattaccgaactgcttcagatgtgctggccgtctctctcagaagactgcgttgcctcccacaccaccttgagccagcagttagatcaagtactccaatccttacgggaggccttagaactgcctgagccgcggacccctccactgtctagcctggtggagcaggcagcgcagaaagctccggaagccgaagcccaccccgtgcagattcagactcagcttctgcagaagaatctagggaaacagactccgtcaggtagcagacagatggattaccttggcacattcttctcttactgctctacactagctgccgtgctgttacaatccctaagttcggaacctgaccacgtcgaggtcaaggttgggaacccatttgttctgctgcagcaatcctcgtcccagcttgtgtcacacctgttgttcgaaaggcaggtccctcccgagcgcttggccgccttactcgctcaggaaaatctgagtctgagtgtccctcaagtgatcgtcagctgttgttgtgagccgctggcactgtgctccagccgtcagtcgcagcagacaagtagcttgctgactcgcctgggaactctcgctcagctccatgccagtcactgtctagacgatctgccactgtccaccccgagcagcccacgtactacagagaaccccactcttgagaggaaaccgtactcttctccacgggatagttcactccccgctcttacctcctccgcattagccttcctcaaatctcggtcgaagcttctggccacagtcgcctgcttaggtgcatccccaaggctgaaggtgtcgaaaccttccctgtcttggaaagaactgaggggtagacgtgaagtgcctctggctgctgagcaggtggcccgcgagtgcgaaagactcctcgagcaatttcctctcttcgaagccttccttctcgccgcctgggagccattgcggggctccctgcagcagggtcaatccctggcagtgaatctctgtgggtgggcttccctctccacagtgctcttaggcctgcactcacccattgcccttgatgtgctgagtgaggcattcgaggaatccctcgttgccagggattggtcccgcgctctgcaactcaccgaggtgtacggccgggacgtggacgacctgtcgtccatcaaagacgctgtgctgagctgtgccgtggcctgcgacaaggagggatggcagtacctatttcccgttaaggacgccagcctgcgctcccgtctcgcactgcaatttgtagaccggtggccactggagagctgcctggagatactcgcttattgcatatccgacacagccgtgcaagagggtctgaaatgtgagctgcagagaaaactggcagagctgcaggtgtaccagaagatactgggtctacaaagcccacctgtatggtgcgactggcagacattgagatcgtgctgtgtggaggatccgtctacggttatgaacatgatcctcgaagcccaggaatatgagctgtgtgaagagtggggctgtttatatcctatcccaagagagcatctcatttctcttcaccagaagcaccttctgcatttgctggaacggagggaccacgacaaggccctgcagctcctgagaaggattcccgaccctacaatgtgtttagaagttaccgaacagtcacttgatcagcatacaagccttgctacctcccatttccttgctaactaccttaccacccatttctacggacagttgaccgcagtgcgacaccgtgaaatccaggccctctatgtgggctcaaaaatattactgactctcccagagcaacatcgcgcttcttacagtcacttgagtagtaatccccttttcatgcttgagcagctgcttatgaatatgaaggtggattgggctaccgtcgccgtgcagactctgcagcaactgctggtggggcaagaaattggcttcaccatggatgaggtggattcgctcctatcccggtacgccgagaaggcactggatttcccctaccctcaacgagagaaacgatctgattccgtgattcatctgcaggagatcgtccatcaggccgcagatcctgagactctgccccgatccccctccgcggagttcagtccggccgcaccccctggaattagcagcatacactcaccatccttaagagagcgtagctttccccccacccaaccctcccaggagttcgtgcctccagctacaccaccagcaaggcaccaatgggttcctgacgagaccgagagtatctgcatggtgtgctgccgagagcattttacaatgttcaatcggcggcaccattgcagacgctgcggcaggctggtgtgctcttcctgctccactaagaaaatggtggttgaaggatgccgtgaaaaccctgcccgtgtgtgtgaccaatgctacagctattgtaacaaggatgttccggaagagccgtctgagaagcccgaggccctggattcgagcaaaaatgagtccccgccctattctttcgtagttcgcgtacctaaggcggacgaggtggaatggatcttagaccttaaagaggaagaaaacgagctcgtgcgttcagagttttattacgaacaggccccgagtgcgtctctgtgtatcgcgattctgaacctacacagagacagtatcgcatgtggtcaccagctcatcgagcactgctgccgcctgtctaaagggctcaccaatccggaagtcgatgcagggctgctgaccgacattatgaaacagctcttgttcagcgcaaaaatgatgtttgtaaaagctggccagtctcaggacctggctctgtgcgattcctatatatctaaggtggacgtgttgaacatcctcgtggcggccgcgtaccgacatgtgccctccctggaccaaatcctgcagcctgctgctgtaacaaggttgcgcaatcagctgctcgaggcagagtactatcagctcggtgttgaggtttccaccaaaacaggattagacactactggcgcctggcatgcctggggcatggcatgcctgaaagctgggaacctcacggccgctagggagaaatttagtagatgtttaaaacccccctttgatctgaaccagctgaatcatggctcgagattagtccaggatgttgtggaatatctcgaaagcaccgtgcggccctttgtctcactgcaagacgacgactacttcgctacactgagagaactggaggccaccctgcgcacccagtcactgtccctcgcagttatccctgaggggaaaattatgaataatacatattatcaggagtgccttttctacctgcacaactactctacaaacttggctattatctctttctatgtgcgtcatagctgtctgcgagaagctctcctacacctgcttaataaggagagtccaccggaggtttttattgaggggattttccagccgtcttacaagtccgggaagctgcacacattggaaaacctccttgagagtatcgatccgacgctcgagagttggggtaagtacctaattgcagcttgccaacatctgcaaaagaagaactactatcatattctgtatgaactgcagcagttcatgaaagaccaggtgcgtgccgccatgacatgtatccggttttttagtcataaagccaaatcatacacagagctgggcgagaaattgagctggctgttgaaggccaaggatcatctaaaaatctatctgcaagagacatccagatcaagtgggcgtaaaaaaacaacattctttagaaagaagatgaccgcggctgatgtgtcacgccatatgaacacgctccagctccagatggaggttacgcgcttcctgcatcgctgcgagtccgcaggcacttcacaaatcaccactctgcctctaccaactctgtttgggaacaaccacatgaagatggacgttgcctgcaaggtaatgctgggcggaaagaatgttgaggatggatttggtatcgcttttcgggtccttcaggatttccagctcgacgcggccatgacatattgtagagccgctagacaactggtcgaaaaggagaagtatagcgaaattcagcaactccttaaatgcgtatccgaatccggaatggccgcaaaatcagacggcgataccatcctgctcaactgtctggaagcctttaagagaatcccaccccaggaactggaggggctgattcaagccatccataacgacgataataaagtgagggcttatctgatatgttgcaaacttcggtccgcatacctcatcgccgtaaagcaggaacatagcagagcaactgcgctggtccagcaagttcaacaggctgccaagtcctcgggcgatgctgtggtgcaggacatctgtgcacaatggcttcttacctctcaccctaggggggcccacggacccggcagccgaaaatag

SEQ ID NO: 141729 - DNA, 1119 bp, Artificial Sequence
  Description of Artificial Sequence: Synthetic coding sequence
atgcagaccagcgagcgtgagggctcaggccctgagctctcgccatctgtgatgcccgaggctcctctagaatctccaccattcccgaccaagtcgcccgctttcgacctattcaacctggtcctatcatataaaagactggaaatttacctggaaccactcaaagatgctggagcctggtactctgtcggcgctctgatgatttcagtcccagctctgctgggatacctacaagaggtctgccgagctaggttgcccgattcggagttgatgcgcagaaagtatcacagtgtgcggcaggaggatctgcagaggggcagactatccaggccagaagctgtggctgaggtgaaaagcttccttatccaactggaggctttcttgtctcggctgtgttgtacatgcgaggctgcctaccgagtcctgcactgggaaaatcctgttgttagcagtcagttttatggcgcattgctcggcacggtgtgcatgctctacctgcttccgctttgctgggtgttaacactcctcaacagtactctttttctgggaaatgtcgaattctttcgggtagtttccgagtatcgcgcctctctgcagcaaaggatgaatccaaagcaggaggaacatgctttcgagtcacctcctcctccagatgttgggggcaaggacggattaatggatagtacccccgctctgactccaacagaagatttaactcccggctccgtcgaagaggccgaggaggcggagcccgacgaagaattcaaggacgccatagaagaggatgacgaaggcgcgccctgccccgccgaggacgagctggccctgcaggacaacggttttctgtctaagaacgaagtgctccgatctaaagtttctagattgacagaacggttgcggaagaggtaccccacgaacaacttcggcaattgtaccggctgttcagctactttctcagtgctgaagaagaggagatcctgctccaattgtggcaattccttctgtagccggtgctgcagcttcaaggttccaaaatccagcatgggtgcaactgcgcctgaggcccagcgggaaacagtgtttgtgtgcgcgtcgtgcaaccagaccctgagcaaatag

SEQ ID NO: 141730 - DNA, 1251 bp, Artificial Sequence
  Description of Artificial Sequence: Synthetic coding sequence
atgcagacctctgagcgggagggtagtggccctgaattatccccaagtgtgatgcctgaagcacctctggagtcacctccttttcccaccaaatctccagcttttgatcttttcaacctggtgctatcctacaagcggctggaaatctatctggaaccccttaaggatgcaggagatggagttaggtatttactccggtggcagatgcccttgtgctccctgctgacgtgcctcggactaaacgttctgttcttgacgctcaatgagggagcatggtatagcgtgggcgccctcatgatatccgttccagccttacttggatatctgcaggaggtctgtcgagcacgactccccgacagcgaactgatgaggcggaaataccatagcgttaggcaggaagacctgcagaggggtcggttgtccagacccgaggctgttgccgaagtcaagtcattcctgatccagcttgaagccttcctctcccggctttgttgcacatgtgaagccgcttaccgcgttttgcattgggagaatccagtggtctctagccagttctatggggcattgctggggacggtgtgcatgctgtatttgcttcccttgtgctgggtcttgactttgcttaatagcaccctgtttctcggcaacgttgagttcttccgagtcgtgagcgagtaccgtgcctcattgcagcagaggatgaatccaaagcaagaagaacacgcctttgagtccccaccacccccggacgttggcggaaaagacgggctgatggactcaacaccagctttgacccctaccgagtccctttccagtcaggatctgaccccaggatcagtggaggaagctgaggaagcagagccagatgaggagttcaaagacgccatagaggagactcacctggtggtgctagaggatgacgagggcgcaccttgcccggccgaggatgagctcgccctgcaggataacggcttcctgtcaaaaaacgaagtcctccgctcaaaggtttccagactcactgagagacttagaaaacggtatccaaccaataactttgggaattgcactggatgtagcgccaccttcagcgtactgaaaaaaaggcgtagctgcagcaactgcggtaacagcttttgtagcaggtgctgcagctttaaagtgccaaagtcctcaatgggtgctactgcaccggaagcgcagcgagaaacagtgttcgtttgtgcttcctgtaatcagacactgtcaaagtag

SEQ ID NO: 141731 - DNA, 957 bp, Artificial Sequence
  Description of Artificial Sequence: Synthetic coding sequence
atgcagacatccgagcgggagggttcagggcctgaactgagcccttctgtgatgcccgaggcaccgttagagtcaccaccattccctaccaaatcgcctgccttcgatctttttaacctagtgttgagctataaaagacttgagatctacctcgaacccctgaaggacgccggcgatggggtgcgctacctgctgtcacttatccagttggaggcctttctaagcaggctgtgctgcacgtgcgaagcagcgtatagagtactgcactgggagaatcctgttgtgtcgtctcagttttatggggcgttgctgggcaccgtgtgtatgctgtacctactgccactgtgttgggtgcttacgctcctgaacagcacactgttcttggggaacgtggaatttttccgtgtggtgtctgaataccgcgcgtccctgcaacagcgcatgaatcccaagcaagaggagcacgcgtttgaatctccccctccaccggacgtgggcgggaaagacggactaatggactccaccccggctctgacgcctaccgaagatctgactcccggatcagtcgaggaagcggaggaggccgaaccagacgaggagttcaaggatgccatcgaagaggacgacgagggagcaccttgtcccgctgaggatgagctggcgctccaggataatggtttcctgtctaagaacgaggttttaagatctaaagtcagccggttgaccgaacgccttaggaagcgctatcctacgaataatttcggcaattgtacaggctgcagcgccacatttagcgtcctgaaaaagaggagatcttgctccaactgcggcaacagcttctgctcccgctgctgtagcttcaaagtcccgaagagttcaatgggtgcaaccgcccctgaggcacaaagagagacggtcttcgtgtgtgcgtcatgcaaccaaaccttgtccaaatag

SEQ ID NO: 141732 - DNA, 1215 bp, Artificial Sequence
  Description of Artificial Sequence: Synthetic coding sequence
atgcaaaccagtgagcgcgaaggatctgggcccgaactctctccctcggttatgcctgaggccccactcgaatcccctcccttcccaaccaaatctccggccttcgacctattcaatctggtgcttagttataagaggctcgaaatttacctcgaaccgctcaaggacgccggagatggtgtgcgatacctactaaggtggcagatgccactttgctccctcctcacatgcttaggtctcaacgtgctgttcctgactttgaacgagggagcctggtattcagtgggcgccctgatgatctctgtccccgcactgctgggatacctgcaggaagtgtgccgggcgcggctgccagatagcgaactgatgagaagaaaataccattcagtgagacaggaagacctgcaaagaggacgcctctccagacctgaagctgtcgccgaagtcaagtcttttctcattcagctcgaagcctttcttagtcggctgtgctgcacctgcgaggcggcttaccgggtactccactgggaaaacccagtcgtttcttctcagttctatggtgccctactgggaaccgtgtgtatgctctatctcctgccactctgttgggtgctcaccctcctaaattccaccctctttcttgggaatgtggagtttttccgggtagtgagcgagtacagagcatccctgcaacagaggatgaacccaaaacaggaggagcatgccttcgagtcccccccacctccggacgttggggggaaagatggtctgatggactccactccagctctaaccccgaccgaggacttgacccctgggagtgttgaagaggccgaggaagctgagcccgacgaagaattcaaagatgccatcgaagaggacgacgagggtgccccgtgccccgcagaagatgaattggctctgcaagacaacgggtttctcagcaaaaatgaagtgctgcgcagtaaagtgtctcgtctgacagagagactgcgcaagaggtacccgacaaataatttcgggaattgcacagggtgcagtgctacattcagcgtactgaagaagaggcgcagttgttcgaattgtgggaacagtttctgttcccgctgttgctcctttaaggtgcccaaaagtagtatgggcgctaccgcccctgaagcgcagagagagacggtgtttgtttgcgccagctgtaaccagacgctctctaagtag

SEQ ID NO: 141733 - DNA, 936 bp, Artificial Sequence
  Description of Artificial Sequence: Synthetic coding sequence
atgatatcagtacccgcgttgcttgggtatttgcaggaggtttgtagagctcgcctgcctgactcagaacttatgcgtcgaaaatatcattccgtacggcaagaggatctacagcggggtaggctctctcgacccgaggctgtggctgaggtgaaaagcttcctcattcagctggaggcattcctgagtcgcctctgctgtacctgcgaagccgcttacagggttctccactgggaaaatccagtcgtgagcagtcagttctacggggcattgcttgggacagtgtgtatgttgtacctcctccctctctgttgggtgctaaccctcctgaactccactctcttcttagggaacgtggagttcttcagagtggtgtcagagtaccgcgcaagtctgcagcagcggatgaatcccaagcaagaagaacacgcgtttgagtcgcctccaccccctgacgtgggaggtaaggacggtctcatggattccaccccggccctgactccaacagagagtctgtcaagtcaggacctgactcctggatctgtggaggaagctgaggaggctgaacccgatgaagagttcaaagatgcaattgaagaagacgatgagggcgctccatgtcccgcagaagacgagcttgccctgcaagataacggttttctttccaaaaatgaggtcctgcgttccaaagtgagtagacttaccgagagattgcgtaagagatatccgaccaacaatttcggtaactgcaccggttgttctgcaactttttccgtattgaagaaacgcagatcgtgctctaactgtgggaacagcttttgcagtcggtgctgcagttttaaggtgcccaagtcatctatgggtgctacagctccggaggcacagagagagactgtgttcgtgtgcgcaagttgtaaccagaccctgtccaaatag

SEQ ID NO: 141734 - DNA, 861 bp, Artificial Sequence
  Description of Artificial Sequence: Synthetic coding sequence
atgcaaacaagcgaaagggagggaagcgggcctgaactgagccccagtgtcatgcctgaggcccccttggagagcccaccttttcctacaaaaagtccagcttttgacctgttcaatctcgtactgtcttacaaaagactcgagatctatctggagcctttaaaggatgctggtgatggcgtacgctatcttttacggttttatggtgctctactcggaaccgtgtgcatgttatatttgttaccactatgttgggtgcttacgctcctgaattccaccttgtttctagggaacgttgagttttttcgcgtggtgagcgaatacagagcatctttacagcagcgaatgaacccaaaacaggaggaacatgcgtttgagtccccaccaccccctgacgtgggcggaaaggatggcctgatggactcaactccggcactgacaccaaccgaagaccttacgccgggtagcgtagaggaagccgaggaagcagaaccagatgaagagttcaaggatgctattgaagaggacgatgagggagccccctgccctgccgaggatgagctcgccctccaagacaacggattcttaagcaagaacgaagtactgcggtcaaaggtctctcgcctgactgagcgcctgaggaaacgctatccaaccaacaacttcgggaactgtaccgggtgtagcgctacgttctcagttctgaagaagcgcagatcctgttccaattgcggcaacagcttttgttcacggtgctgtagttttaaggtgcctaagtcctccatgggtgccactgctccggaagcacagcgggaaactgttttcgtgtgcgcgagctgcaaccaaacactgagcaagtag

SEQ ID NO: 141735 - DNA, 1236 bp, Artificial Sequence
  Description of Artificial Sequence: Synthetic coding sequence
atgcagacaagcgagcgggaaggaagtgggcccgagctgtcgccttcagtgatgcctgaggcaccattggagagtcctccgttcccaactaaatctcccgccttcgacctgtttaatctagtgctgtcctataagcgtctcgaaatttatctggagccgctcaaagatgctggcgacggggtcagatacttgctgcgctggcagatgcctctgtgctcactcctgacttgccttggccttaacgtgctgttccttactctcaatgaaggtgcttggtacagcgtgggcgccctgatgatttctgtgcccgctctgttgggctatcttcaggaggtctgccgcgcaaggctgcccgattctgagctcatgcggagaaaatatcacagtgtgcggcaggaggacctgcaaagggggaggctctcacgacctgaggccgttgcagaagtcaaatcttttttgattcaactggaggccttcctgagcaggttgtgttgtacctgcgaggcggcttaccgggttctgcattgggaaaatccggtcgtgtcttcccagttctatggtgcactcctcgggactgtctgtatgctgtatctcctgcccctttgctgggtactgaccctccttaacagcactctgttcctgggcaatgtagagtttttccgggttgtgtcagaatatagggccagcttgcagcagcggatgaatcccaagcaagaggagcacgcctttgagagcccaccacccccggatgtaggcgggaaggacgggctgatggattctacacccgcgctgacacctactgaagatcttacacccggaagcgtagaagaagccgaagaagccgagccagacgaggaattcaaggacgctattgaagagactcatttagtcgtgctggaagacgatgagggcgctccttgtccggccgaagacgagttggccttacaagacaatggcttcctgagcaagaacgaagtgttgcgaagcaaggtgtctcgactgacagagcggttacggaagagataccctaccaataatttcggaaattgcaccggatgctcagcgacttttagtgtccttaaaaagcggcggagctgcagcaactgcggcaattccttctgttccaggtgttgcagtttcaaggtgccaaagtcatccatgggggcaacagcccctgaagcacaacgcgagacagtatttgtatgtgcttcctgtaatcaaacactttccaaatag

SEQ ID NO: 141736 - DNA, 1185 bp, Artificial Sequence
  Description of Artificial Sequence: Synthetic coding sequence
cttgaaagcccaccattccccacaaagtctcccgcatttgatcttttcaatttagtgctctcttacaaaagactggagatatacctggagcctttgaaggacgccggggacggggttagatacctgctgcgctggcagatgccactctgcagcttacttacatgcttgggactgaatgtactttttcttaccctgaatgagggggcctggtatagtgtcggcgccctgatgataagcgtccctgcactgctgggatacctccaggaagtttgccgcgccaggctgcctgattcagaactgatgcgccggaagtaccattcagttcgacaagaagatctgcaaagaggccgcttatcgagacccgaggcggtcgctgaggtaaagagctttctgatccagttggaagccttcctgagcagactgtgttgcacgtgtgaagcagcctacagagtgctgcattgggaaaaccccgtggttagcagccagttctatggcgcgctgcttggcacggtttgcatgctgtatctgcttccgctgtgctgggtcctgactttacttaattcaactctattcctcggcaacgtggagtttttcagggtggtgtcagagtacagggcaagccttcagcagcggatgaatccaaagcaggaagagcacgcctttgaatcgcctcctccccccgatgtcggaggtaaggacggtctcatggacagtacgccggctctgacacccacagagagcttgtctagtcaggatttaacccctggcagcgtggaagaggcggaagaggcggaaccggacgaagaattcaaggatgccattgaggagacccacctggtcgtgctggaagatgacgagggtgcaccatgtcccgctgaggacgagcttgctctgcaagataacgggtttcttagtaagaatgaggttctgaggtcaaaggtctcccggctgaccgagaggctgaggaaacgttatccaaccaacaactttggtaactgtactggctgttcagccacattctccgtgttgaaaaagagaaggagctgctctaactgcggcaactctttttgcagtcgatgctgcagtttcaaggtgccgaagtcatctatgggcgctactgcacctgaggcacagagggaaactgtgttcgtctgtgccagttgcaatcagaccttatccaaatag

SEQ ID NO: 141737 - DNA, 1047 bp, Artificial Sequence
  Description of Artificial Sequence: Synthetic coding sequence
atgcagaccagcgaacgagagggctccggccccgagctctctccaagcgttatgcctgaggccccccttgaaagtcctccctttcccactaaaagccctgccttcgatctgtttaatcttgtgctaagttacaaaagactcgagatatacctggagcccttaaaagatgcaggggatggggtgagatacctgcttcgctggcaaatgcccctgtgttctttgcttacttgcctgggcttgaacgtcctgttcttgactttgaatgagggagcatggtattcagtgggtgccctcatgattagcgtgcccgcgctcttgggctatttgcaggaggtatgtagggctaggctgcctgatagtgagctgatgcgccgcaaataccatagcgtacgccaggaagatctgcagcgcggtaggcttagtcggcccgaagctgtggccgaggttaagagtttccttattcagttagaggcgtttttgtctcgcctgtgctgcacctgcgaggcggcttacagagtgctgcattgggagaacccggtggtttcctcacagttttatggggcccttctgggaaccgtttgcatgctgtatctactgcccctctgctgggtactgacattactgaacagtaccctgttccttggaaacgtggagttttttcgagtcgttagcgagtacagggccagcctccaacagcgcatgaacccaaagcaggaagaacacgcctttgaaagcccacctccacccgatgtcgggggtaaagacggactgatggatagtaccccagcactgactcctactgaggacctcactccgggctcagtagaagaggcagaggaggccgaacccgatgaggagtttaaagacgctatcgaggaagacgatgagggagctccatgtcctgccgaggatgagctggcactccaggataatggcttcttaagtaagaatgaggtcctccgaagcaaggtgtctcggctgacggaaaggctcagaaagcggtatccgacaaataatttcggtgtgactggagccggaagctcctag

SEQ ID NO: 141738 - DNA, 2664 bp, Artificial Sequence
  Description of Artificial Sequence: Synthetic coding sequence
atgatgaatcggttccgcaaatggttgtataagcctaaaagatctgatccccagctgctggcccgcttttattatgccgacgaggagctgaatcaggtggctgccgagcttgattccctggacggcagaaaagatccacaaaggtgcactctgttggtgagccagttccggtcctgccaggacaatgtgctgaacattatcaatcagatcatggacgagtgtattcctcaagaccgggcgcctagagacttctgtgtgaaattccccgaggagatccggcacgataatctggccggccaactctggtttggggcagaatgtttagccgccggtagtataatcatgaacagggagcttgaatcaatggcaatgcgacctctggctaaagagcttacccgaagtctggaagacgtgcggggggccctcagggatcaagccttgagagacttgaacacctacaccgagaagatgagggaagccctcaggcacttcgacgtgctgtttgcagagtttgagcttagttacgtgtcggcaatggttcctgtcaaaagcccgcgggagtactatgtgcagcaggaagtcatcgttcttttctgtgaaactgttgaacgggccctggacttcggataccttacacaggatatgatcgatgactacgaacctgctctgatgttttctattcctcgcctcgctatcgtgtgtggcttagtagtttatgctgacggtcccttaaacctcgatcgaaaagtggaggatatgagcgagctgttcaggccattccacactctacttcgaaaaatacgggacctgctccagacactgacggaagaagaactccatacgctggagcgtaacctgtgtatatcacaggacgttgaattcccaatccgcgctgatgtccagggacccgccgcgctcgctccggcgctgagtgctcctctcccccctgagggaccgctcagtgccaaagccaaagacccggacgcagaactcgcgtgctcaatgcagtacgatgaccaggagcttgagcagctgtcaagaatggtgcaccgggccggcgatgagatgtctagccttctgtcgcctccaattgcctgtcagagcccggcgcaccgccctggggctgaggggtctcccggcggtgaggctagcccaggcagaccacgtctgcgttccgggtctgacgaggaagagcgagtgttctttatggacgacgtggaggggacagcagaagccctcgccaggccagagtcccccgcgggcccttttgggtgggccggcagcacatgggccgacccccaggagaagggccaaggaggtcccggtggagccgcagggatctcgctgcccgcaagtgaaaaggaagaagatctctctaataacaatctggaggccgaaggcacagacggagcatcactcgccgggacaagcagctgctcctgcttggatagtagactgcatctcgatgggtgggaagtgggggccgacgatgccgagacagccgagatgatcgctcacagaactggagggatgaaactaagtgcaacagtaatatttaatcccaagtctcccaccagtcttgactcagctgtggctacgcaggaagccgcctccgagcctgtcgcagagggcatggatggggggcctcacaaacttagtacaggggctaccaattgtctgttgcatagttgcgtgtgctgcgggagttgcggtgactctagggaagatgtggtagaaaggttgagggagaagtgttctccaggcggcgtgatcggggcgagttatgctgcagggctggcaaaagctagtgaccgagccccagaacggcaagaagaagctcctcctccaagcgaggatgctagcaacggccgagagccaaaggcacccaccagcgataagtgcctaccacacaccagcggttctcaggtggatacagcatcaggcttgcagggcgaagcaggcgtcgcagggcaacaagagcctgaagctcgggagttacatgcaggctcccccagcgcacacgaagcaccacaagctctctccggatcttcttcctctacagccggttcctgctcatctgataagatgggcccagaagccgcacctgcagccacccacgcagccccccaggccaccagagagaagattcgaagccggtttcacggtagccatgatttgatccatcggctcttcgtctgtatttccggagttgccgaccaactgcagaccaactacgcttccgatttgaggtctatattgaagacactctttgaggtcatggcgactaaacccgagaccgacgataaagaaaaactcagaaaggtgacccagaccttaaggtccgcagcccttgaagactgcgctctgtgtcaagaaacattgagcagttctgaactggccgctaagacgcgcgacggggacttcgaggatcccccagagtgggttccggacgaggcatgcggcttttgtacagcatgtaaagctccttttactgtgattcggaggaaacaccattgccgctcgtgtggcaaaatattctgcagccgatgctccagccatagcgcacctcttcctcggtatggccaggtgaagcccgtacgagtttgcacacactgctacatgtttcatgtcacccctttctacagtgacaaggctggcttgtag

SEQ ID NO: 141739 - DNA, 2574 bp, Artificial Sequence
  Description of Artificial Sequence: Synthetic coding sequence
atgatgaaccgctttcgaaaatggctatacaaacctaagagatctgatccacagttgctcgcacggttctactatgctgatgaggaactcaatcaggttgcagccgaactcgactctcttgatgggcgaaaggatccacagagatgtacgctcttggtcagccaattccgaagttgtcaggataatgtactaaatatcatcaaccagataatggatgagtgcattccacaagatcgagcccctcgagatttctgcgtgaaatttcccgaggaaatccgccacgataacctcgctggacagttatggttcggcgccgaatgtctggccgctggaagcatcattatgaaccgagagctggagagcatggccatgcggcctctggccaaggagctcacacgctcactagaggatgtgcgcggagcgttgagagatcaggcactgagggatcttaatacatacaccgaaaaaatgcgcgaggctctcaggcatttcgatgttctgtttgcagaattcgagctgagttacgtgagcgcgatggttccagtgaaaagtcctcgcgagtattacgtgcaacaggaagtcatcgtgctcttctgcgaaactgtcgaatcaggactggtggtctacgccgacggaccgctgaacttggataggaaagtcgaagatatgagcgaactgttccggccttttcacacattgctgagaaagattcgggatctcctgcagactctgactgaggaggaacttcacaccctggaacgcaatctgtgtatctcacaagacgtggagtttccaatccgagctgatgttcagggtccggctgcactggcccctgctctttcagctcctttgccccctgaagggccactgagtgctaaggcaaaggacccagatgcggaactggcttgtagtatgcagtacgatgaccaggaactggagcaactcagtagaatggtccaccgcgcaggggacgagatgtcaagcctgcttagtcctcctatcgcatgtcagtctccagcccaccgacccggggccgaggggtcccctggcggcgaggctagccccggccggcctagattgagaagtggtagtgacgaagaggagcgcgtgttctttatggatgacgtggagggcaccgcagaagcactcgctaggcctgagtctccggctggaccttttgggtgggcgggctccacctgggcggacccccaggagaaaggccagggggggccaggcggtgctgccggcatctcgcttcctgctagtgagaaagaagaagatttgagcaataacaaccttgaggccgagggaaccgacggcgcatcactggccggcaccagcagctgttcttgcttggattcacggctgcatcttgatgggtgggaggtaggggcagatgacgcagaaacagcggaaatgatcgcgcaccggacgggaggtatgaagttgagcgcaactgtgattttcaacccgaagagccctacatctcttgacagcgcggtggctactcaagaagctgcctccgagccagtggctgaaggcatggatggtggccctcacaaactgtcaaccggggcgactaactgcctcctgcacagttgcgtgtgttgtggaagctgtggtgatagtcgagaggatgtcgttgagaggctgcgagagaaatgcagcccagggggcgttataggagctagttatgccgccggattggctaaggccagcgacagggctccagaacggcaggaggaggcacctcccccatctgaagacgcaagcaatggtcgcgaaccaaaagccccaactagcgataaatgtctgccgcacacctccggcagtcaagtagacactgccagtggattacaaggtgaggctggcgtggcaggtcagcaggagcctgaggcacgcgagctgcatgccggctcccctagcgctcatgaggctcctcaagcactgtccggaagttcgagctccactgcaggatcctgtagctcagataaaatgggtcccgaggccgcccccgctgcaacccatgccgccccccaggccactagagagaaaataaggagcagatttcacggatctcacgacctgattcaccgactcttcgtctgcatttccggcgtcgcagaccagctgcagaccaattatgcttctgatttacggagcattcttaagacactgtttgaggtgatggcgacgaagccagaaacagacgataaagagaagctgaggaaggttacccagaccttacgctcagccgccctcgaggattgtgccctgtgccaagaaaccctcagttcttcggaacttgccgccaaaacccgcgacggcgattttgaagatcctcctgaatgggtgccagatgaagcctgtgggttttgcaccgcatgtaaagcacctttcacagtgatcaggcggaaacaccattgcaggagttgtgggaaaattttctgtagcaggtgcagtagccactcagctcctttgcctcgttacggtcaggtcaaacccgtgagggtttgcactcactgctatatgttccacgtgacacccttctacagcgacaaagctggcttgtag

SEQ ID NO: 141740 - DNA, 2454 bp, Artificial Sequence
  Description of Artificial Sequence: Synthetic coding sequence
atggatgaatgcataccccaagaccgcgcgcccagggacttctgcgtgaaatttcctgaggaaattaggcatgacaatttggcgggtcagctgtggttcggcgccgaatgcctggctgctggctcaatcatcatgaatagggaactggagtccatggctatgagaccacttgccaaagagctcacccgttcactggaggacgttaggggggcactacgcgatcaggccctcagggatctgaatacctatactgagaaaatgcgggaggcgcttcgacattttgacgtgcttttcgccgaattcgagttgtcctacgtttccgctatggtcccggtgaagtctccgcgagagtattatgtccagcaggaagtgattgtactattctgcgaaaccgtggaacgggcccttgactttggttatctcacgcaagatatgatagatgattacgaaccggcactaatgttcagtatccctcgcctggcaatcgtgtgcggcctcgtcgtgtacgccgatgggccgctgaatctggaccggaaagtcgaagacatgtcagagctctttcgaccatttcatacattactccgaaagattcgcgatcttctgcagaccctcacagaggaggagctgcacacactcgagagaaatctgtgtatcagtcaggacgtagagttcccaatccgagccgacgtgcaaggaccagccgcccttgcccccgctctgtccgccccgctgccccccgaggggcccttgtctgccaaagcaaaagaccctgatgcggaactcgcgtgctccatgcagtacgacgaccaggagctggaacaactcagcagaatggtgcaccgcgccggagacgagatgagcagcctgctgtctcccccaatagcgtgtcagagccccgcccaccgccctggagccgaggggtcaccgggtggagaggccagcccaggtcggccgaggctgcgctccggctccgatgaggaagagcgggttttctttatggatgatgtggagggcacagcggaagcactggcacggccagaaagtcctgccggccctttcggatgggccggttcaacctgggccgacccacaggaaaagggtcaaggcggccctggcggcgccgccggaataagcctgcccgcaagtgaaaaggaggaggatctgagcaataataatctcgaggcagagggaactgacggggcatctctcgctggtacctcgtcatgtagctgtctcgattcacgtctgcacctggacggctgggaggtaggagctgacgatgcggaaacggccgagatgattgcacaccgaacgggcggcatgaagttgagcgccacagtgatctttaatcccaaatcacctacatccctggatagtgcagtcgcaacccaggaggctgcttccgagcccgtggctgagggcatggacggtgggccacacaagctctcgaccggtgcaacgaattgtctgctgcacagctgtgtgtgttgcggctcgtgcggagattccagagaagacgttgtcgaaaggctgcgcgaaaaatgctcgcccggtggagttattggtgcatcatacgctgctggacttgcgaaagcctccgatcgcgccccagaaagacaagaggaagcgcctccccctagcgaggatgcaagcaatggccgggagcccaaggctcctacctccgataaatgcctaccacacacctctggcagccaggtcgatactgcttccggattacagggcgaggcgggggtcgctggccagcaagaaccagaggccagggaactgcacgctggcagcccaagcgcacacgaggcacctcaggctctgtcaggctcaagttcttccacagccgggagctgcagcagcgacaaaatgggacctgaggctgccccagcagccacccacgctgcaccacaagccacaagagaaaagatcagaagtcgattccacggttcccacgaccttatccatcggttgttcgtctgcatcagcggggtcgccgaccagctgcagaccaattatgcttccgatctcaggtcaatattaaaaacattattcgaagtgatggcaaccaagcctgaaacagatgacaaggagaagctgcgtaaggtgactcagactttgcggtcagccgccctcgaggattgtgccttgtgccaggagaccctgtcgagcagcgagttagccgccaagacacgggatggggattttgaagatcctcccgagtgggtacctgacgaagcttgcggattttgcacagcatgcaaggcgcccttcactgtcatccgccggaagcaccattgtagatcttgtggaaagatcttctgcagcaggtgttcatcacattccgcccccctgccaagatatggacaggttaagccagtccgcgtttgcacacattgctatatgtttcatgtcacacccttctattcggataaggcaggcctctag

SEQ ID NO: 141741 - DNA, 1212 bp, Artificial Sequence
  Description of Artificial Sequence: Synthetic coding sequence
atggagcctgcgggtccatgcggattttgcccggccggagaggttcagccggcacgctacacctgtcctcgatgcaacgctccctattgttctctgagatgctacaggacccacggaacatgtgcagaaaacttctatcgggatcaagttctgggggagttgagaggttgcagcgctcccccatcgcgcctagcgtcagccttacgtcgcctaagacagcagcgagagacggaagatgaacctggggaggctggcttatcctccggacccgcccctggcgggttgtccggtctgtgggagcggctggcccctggagagaaggcggcgtttgagcggctgctgagtagaggagaggccggaaggctacttcctccctggcgaccatggtggtggaacagaggggccggccctcagttgttggaagaactggataatgcccccgggagtgatgccgcggaactcgagctagcccccgccagaacgcctcctgacagcgtgaaggatgcttcagcagcggagcctgctgccgcagagcgggtcctgggtgacgtgcccggagcatgtactccagtggtgcctacgcgaatccccgcaatcgtgagtttatcccgggggcccgtgagtcccttagtgagattccagcttcccaacgtgctgttcgcttatgctcatactttggctttataccacggcggcgacgatgcccttctcagcgatttctgtgctaccctcctgggggtgtccggagctctgggcgctcagcaggtatttgctagtgccgaggaggcgttgcaagctgccgcccacgtccttgaggccggggaacatcctccaggccctctgggaacgcggggagccatgcacgaggtggcaagaatcctgctgggcgaaggcccaactaatcaaaaaggatacactctggctgccctgggagacctggcccagacactagggcgtgcccgcaagcaagcggtcgctagggaggaacgcgatcatctgtaccgagcgagaaagaagtgccagtttctcctggcctggacaaatgagaatgaagccgctttaactcctctggccctggattgtgccagagcccaccaagcacacgctgtcgtggcggaggaggtggccgctctcaccggggagctggagcgtctttggggaggccctgtgcctcctgcccccaggactctgatagaggaactaccttcctag

SEQ ID NO: 141742 - DNA, 1683 bp, Artificial Sequence
  Description of Artificial Sequence: Synthetic coding sequence
atggctggaccccagccgctagcattacagctggagcagttattgaatcccaggcctagcgaagccgaccccgaggcagacccggaggaagccaccgccgcccgagtcattgaccgatttgacgaaggggaggatggtgagggtgatttccttgtggtgggcagcatacggaaacttgcctctgcctcactactggacactgacaagcggtactgtgggaagactacctctagaaaagcgtggaatgaggatcactgggaacaaacgcttcccggtagcagcgacgaagagataagcgacgaggaagggtctggtgacgaagatagtgaagggctgggattggaggagtatgatgaggatgacctgggtgccgctgaggagcaggaatgtggagatcatagggaatcaaagaagagcagaagccactcagcgaaaactccgggcttttccgtacagtccataagtgattttgagaaattcaccaagggaatggatgatctgggatcaagtgaggaggaggaggatgaagaaagcggcatggaggaaggagacgacgccgaagactctcagggcgaatccgaggaggatagggcgggagaccgtaactcagaagacgatggagttgtaatgacattctcttcagtcaaggtgagcgaggaagtcgagaagggaagagctgtcaaaaatcaaatcgcgctgtgggaccaattgttggagggacggattaagctgcagaaggccctgttgactaccaaccagctgccacagccggacgtgttcccactctttaaggacaagggcgggccggagttctctagcgcattgaagaattcgcacaaagctttaaaagctctactgagaagcctagtaggacttcaggaagagcttctgtttcagtatccagataccaggtatctggttgacggtacaaaacccaatgctggatctgaagagatttcaagcgaagacgatgaactcgtggaagaaaaaaaacagcagcgccggcgagtgcctgccaagagaaaactagagatggaagattacccaagcttcatggcgaagcgatttgctgactttacagtgtaccgaaaccggactctgcagaagtggcacgataaaaccaaattagcatccggcaaactggggaaaggattcggcgccttcgaacggtctatccttactcagattgaccatattcttatggacaaagaacgcctcctccgccggactcagaccaagaggtccgtgtaccgtgtattaggtaagccggagccagccgcgcagcctgtccccgagagtcttcccggcgagcctgagatcctaccgcaagcccctgctaatgctcacctcaaggatctggatgaggaaattttcgacgatgatgacttttatcatcaactgctgcgagagcttatcgagagaaagacatcttcattagaccctaatgatcaagttgcgatggggcgccagtggctggctattcagaaactgcggtccaaaatccataagaaggtggatcgcaaagcctcaaaaggccggaagctcaggttccacgtactcagtaagctgctttcattcatggcaccgatagaccataccacgatgaatgatgacgcaaggacggagctctatagaagcctgttcgggcagctccaccccccagacgagggccacggagactag

SEQ ID NO: 141743 - DNA, 4134 bp, Artificial Sequence
  Description of Artificial Sequence: Synthetic coding sequence
atggatacctcctccgtcggggggctagagcttacagaccagactcccgtgcttctgggaagcacggcaatggccacaagcctgacgaatgtcggcaattctttcagcggtccagccaacccgttagtctcgcgctctaataagttccaaaatagctcagtagaggacgatgacgacgttgtgttcatagagccagtgcagccaccgcccccgtcagtgcccgtggttgcagatcagcggaccataaccttcacctcttccaagaatgaagaactccagggtaacgacagtaaaattactccatccagcaaggaactggcttcgcagaaaggctccgttagcgaaaccatcgtgatcgacgatgaggaagacatggaaaccaatcagggacaggaaaagaactcgagcaactttattgagcgtcgaccccctgagacaaagaaccgaacgaacgacgtggacttctccacgtctagcttctcacgctcaaaggtgaatgccgggatgggcaactctggcattactaccgaaccagactctgaaattcagatcgcgaacgttacaactctggagacaggggtctctagtgttaacgacggccagctggaaaataccgatggcagagatatgaacctgatgataacccatgtgacctccctccagaacactaacctcggcgacgtctcaaacggcctacagtcatcaaatttcggtgtgaatattcagacatacaccccctctttaacatctcagaccaaaactggggtcgggccttttaatccaggaaggatgaacgttgccggcgacgtatttcaaaatggagaatcagccacacatcacaaccccgactcctggatatcccagtcagccagcttcccaaggaatcagaagcaacctggcgtggattccctgtccccagtagctagtctgcccaaacaaatttttcaaccgtccgtgcagcaacagccaacaaaaccagtgaaagtaacctgtgccaattgtaagaaacccttgcaaaaaggacagacagcgtaccaaagaaagggaagcgcccatttgttctgttccaccacctgcctgtcctccttcagccacaagcctgcgcctaagaaattgtgtgtaatgtgcaaaaaggatatcacaacgatgaaaggcacgatcgtggctcaggtagactccagtgaatccttccaagagttctgttcaactagctgcctgagcctgtacgaggacaaacagaatcctacaaagggagccttgaataagtcaagatgcactatctgcggcaagttaaccgagatccggcacgaagttagtttcaaaaatatgacccataagctatgttctgaccattgcttcaaccggtacaggatggcaaatggcctaatcatgaactgttgtgaacagtgtggcgaatatctgccaagcaagggagccggaaataatgtgctggtgattgatggccaacagaagagattttgctgtcagagttgcgtgtccgagtacaagcaggtcggctcgcatccctcctttcttaaggaagtgcgcgatcacatgcaggactcctttttgatgcagccagagaagtacggtaagctcactacatgcacgggatgtagaactcagtgcagatttttcgatatgacccagtgcatcggtccaaatggctatatggaaccgtactgctctactgcctgtatgaactcccataagacaaaatacgccaaatcccagtctctaggcatcatatgtcacttctgcaagcgaaactccctcccccagtaccaggccacaatgcctgatggcaagctgtataacttctgtaatagctcgtgtgtggccaaattccaagcactgagcatgcagtcaagtcctaatggccagtttgtggctcctagtgatatacagttgaaatgcaactattgtaagaactccttctgctcaaaacctgagatcttagaatgggagaataaggtgcaccagttctgcagcaaaacatgctccgacgactataagaagttgcattgtattgtcacatactgtgaatactgtcaggaggagaagactctccatgagacggtgaactttagtggcgttaagaggcctttctgctctgaggggtgtaagttgctgtacaagcaagactttgcccgccgactaggactcagatgcgtcacctgcaactattgcagccagttatgcaaaaaaggtgctaccaaggagctggacggagtcgtgcgtgacttctgttctgaggactgctgcaaaaaattccaggactggtattacaaggcagcacggtgcgactgttgtaagtctcaaggaacgctgaaggagagagttcagtggcggggggagatgaaacacttttgcgatcagcactgcttgttaagattctactgtcagcaaaatgaacctaacatgactacccagaaaggtcctgagaatctgcattatgatcaaggatgccaaacttcgcgcaccaagatgaccggtagcgcccccccaccttcaccaactccgaacaaagagatgaagaataaggccgtgctgtgtaaaccccttacaatgacaaaagcaacctattgtaaacctcacatgcagacgaaatcctgccagacggatgacacctggcgtacagagtacgttcccgtgcccatcccagtgcccgtatacatccctgtgcctatgcatatgtactctcagaatattcccgtgcctaccaccgtccccgtgcccgtgcccgtgcccgtctttctcccagcccccctggactcctccgaaaagataccagctgcaattgaagaactgaaatcgaaagtctcatcagacgccctggacacagaactactgacgatgacagatatgatgagtgaagacgaggggaaaaccgaaacaacgaacataaacagtgttattatagaaactgacatcattggatccgatctactaaaaaattccgatcctgagacccagagctcaatgccagatgttccctatgagccagatctcgatattgagattgacttccctagggcggctgaggagctggacatggagaatgagttcctcctcccccccgtgttcggtgaggagtacgaggaacagccaaggcctcgcagcaaaaagaagggggcgaagaggaaagcagtctccggatatcagtcacacgacgattcctcggataactccgaatgctccttcccgttcaaatacacctatggggttaatgcctggaaacattgggttaaaaccaggcagctggatgaagacttgcttgtgctggacgagctcaagtcctctaagagcgtgaagctcaaggaagatttgctgagccacaccacggcagagcttaactacggcctggctcatttcgtcaatgagattcggcgccctaacggtgagaattatgcccccgactcaatctactacctttgcctgggcattcaagaatacttatgcgggagcaaccgaaaggacaatattttcatcgaccccggttaccagaccttcgagcaagaattaaataaaatcctgaggtcctggcaaccctccatcctccctgatggcagtattttttctcgcgttgaagaggactatctctggagaattaagcagcttggctcccattcgcctgtcgccctcctcaacaccctgttctattttaatacaaagtattttgggctgaaaacggtcgagcagcatttaagactgtcttttggcactgtgttcagacactggaaaaagaatccattaaccatggagaataaagcttgcctaagatatcaagtttcatctctgtgtgggactgacaatgaagacaaaatcaccaccgggaaacgcaaacatgaggacgacgaacccgtgtttgagcagatagaaaatactgccaatccatcgagatgccccgtcaagatgttcgaatgctacctgtcgaagtcgcctcagaaccttaaccagcggatggatgtgttttacttacaaccggaatgctcttcgtcaactgattcccccgtctggtacacttcaactagcctggaccgcaacaccctcgaaaacatgctcgtcagagtactgctagttaaggacatctatgacaaggataattacgaactggacgaggataccgactag

SEQ ID NO: 141744 - DNA, 4128 bp, Artificial Sequence
  Description of Artificial Sequence: Synthetic coding sequence
atggacacctctagcgtgggaggcctggagcttactgaccagactcctgtgcttctgggtagcacagccatggccaccagcctcaccaatgtaggcaactcctttagcgggccagccaaccctttagtttccagatcaaataaattccagaattcttcggttgaagatgatgacgacgtggtgttcatcgagccagtgcaaccacctccgccgagtgtgccggtcgttgccgatcagcgcactataacttttaccagtagtaaaaacgaagagttgcaagggaatgatagtaagatcactccatcttccaaagaacttgctagtcagaagggctctgtctccgaaactatcgtaatcgatgatgaggaggatatggagacaaaccagggccaggaaaaaaactccagtaattttatcgaacgacgtccccccgaaaccaagaaccgaacaaatgacgtggatttctccacgtcttccttttccagaagtaaggtgaatgcaggtatggggaactcaggtatcacaacagagcctgacagcgagatccaaattgctaatgtcacaactctggagacaggtgtctcatccgtgaacgatggtcagttggaaaacactgacggccgcgatatgaacctcatgatcacgcacgtaaccagcctacaaaacacaaaccttggtgacgtgagcaacgggctgcaatcctccaattttggggtgaatatccagacttatactccaagcctgacctcccaaacaaagaccggcgttggtccattcaacccagggcggatgaatgtggccggcgacgtatttcagaatggtgaaagcgccacccatcacaaccctgactcttggatctcccaaagcgcttccttcccaaggaatcagaaacaacctggggtcgatagtcttagccctgtggcctcactcccaaaacaaatctttcaaccttctgtccaacaacaacccacaaagcccgtgaaggtcacttgtgctaactgcaaaaagccattgcaaaagggtcagacagcctatcagcgaaagggcagcgcccatctcttttgcagtaccacatgcttgtccagcttcagccataaacctgcgcctaaaaagctatgtgtcatgtgcaaaaaagacatcactactatgaagggcaccattgtcgctcaggtggactcttctgagtcctttcaagagttttgttccaccagctgtctctccttgtacgaggataaacagaaccccaccaagggcgctctcaataagtcccggtgtacaatttgcggcaaactcacagagatcagacacgaagtgagcttcaagaatatgactcacaaactctgctcagatcactgcttcaataggtacagaatggctaatgggctgatcatgaattgctgcgaacaatgcggcgagtatttgccatctaagggcgctggaaataatgtgctggtgattgacgggcagcagaagaggttttgctgccaaagttgtgtgagtgagtacaagcaggtcggctcacatccaagttttttgaaggaagtgagggatcacatgcaggatagcttcctcatgcagccagaaaagtacgggaaacttacaacatgcacgggctgccggacacagtgtaggttctttgatatgactcagtgcatcgggcccaacggctatatggaaccgtactgctctaccgcttgtatgaactcccacaagaccaaatacgctaagtctcagagcttagggatcatctgccacttttgcaaaaggaacagcttgccacagtaccaggcaacaatgccagacggtaagctgtataacttctgtaacagttcatgtgttgcgaaatttcaggccctctccatgcagtcctcaccaaacgggcagttcgtggccccctctgacattcagcttaaatgcaactattgcaagaacagcttctgctcaaaaccagaaatcctcgagtgggaggcctccctgcatcagttttgcagcaaaacctgtagcgatgactacaaaaaactgcattgtatcgtgacttattgcgagtactgtcaggaggaaaagacgctgcatgagaccgtgaactttagtggagtgaaacggcctttctgcagcgaagggtgcaaactgctgtacaaacaagacttcgcccggagacttggcctgcgctgtgtaacctgtaattattgtagtcagctgtgtaaaaagggagccaccaaagagctagatggagtcgtacgagatttctgttctgaggattgttgtaagaagtttcaggactggtattacaaagcctgcgattgctgcaagtctcaggggaccctcaaggagcgggttcagtggcgcggcgaaatgaaacacttctgtgaccagcactgcctgctgcgtttttattgccagcagaacgagcccaatatgactacgcaaaaaggcccggaaaatctgcattacgatcagggctgtcagactagccggacaaagatgaccggctcagcaccacccccaagccctactcccaataaggaaatgaagaataaagccgtgctttgtaaaccactgaccatgaccaaggccacatactgcaaaccacacatgcaaactaagtcttgtcaaactgacgacacttggaggacggaatacgtgcctgtgcccatccctgtgcctgtgtacatacctgttccgatgcacatgtacagccagaatattcctgtgccaaccaccgtgcccgtcccagtgccagttccagttttcctccctgcacccttggattcctcagaaaagatccctgctgcaatcgaggaactcaagagcaaagtgtcaagcgatgctttggacaccgagcttctgacgatgacagacatgatgtctgaagatgaggggaaaactgagaccacaaatattaattcggtgattatagagacggatattattggctcagatctactgaagaatagtgaccctgagacacagtctagcatgccagatgtcccgtacgaacccgacctggatatcgaaattgatttcccccgcgccgccgaagagctggacatggaaaatgagttcctgctgcctccagtgttcggggaagaatatgaggagcagccaagacccaggtccaaaaaaaaaggtgctaaacggaaagcagtcagtggttaccagtcccacgacgacagctcagacaattccgaatgctcttttccttttaaatatacttatggggtgaacgcctggaagcactgggttaagacgagacagctggacgaagatttattggtgctggatgagctcaagagtagtaagtcagttaagctgaaggaggacctcctttcccataccacggcggaattgaattatgggctcgcccacttcgttaacgaaatacgaaggcctaacggagaaaattatgctccggactctatctactatctttgtttgggtattcaggagtatctttgcggatctaatcggaaagataacattttcatcgatcctgggtaccagactttcgagcaggagctgaacaaaattttgcggagctggcaaccgagcatcctgccagacggatccatcttttcaagagtcgaagaagactacttgtggaggatcaagcagctgggatcccactcccctgtggctctgctgaatacactgttctattttaataccaaatactttgggctaaagacagtggaacagcacttgcgtcttagcttcggaacagtctttcggcactggaaaaaaaatcctttgaccatggaaaacaaggcttgtctccgctatcaagtatcatcactctgcgggacggacaatgaggacaagatcactactggcaaaaggaagcacgaggacgatgagcccgtgtttgaacagatcgaaaacacggctaacccatcaaggtgtccagtgaagatgttcgaatgctacttatccaagtcccctcagaacctgaaccagaggatggacgtcttttaccttcagcccgagtgctcttcaagcaccgattcaccagtgtggtatacttctacatcactcgatcgtaacacgttggaaaacatgctagtgagagtcctgcttgtgaaagacatctatgataaggataactacgaactggacgaagacacagattag

SEQ ID NO: 141745 - DNA, 4128 bp, Artificial Sequence
  Description of Artificial Sequence: Synthetic coding sequence
atggacacgtcatccgtcggaggtcttgagctcacggaccagaccccagtccttctggggagcactgcaatggccaccagtctcaccaacgtcggtaactcgttttcaggcccagctaatccgctggtgtccaggtctaataagttccagaattccagcgtggaggacgatgatgatgtagtgttcatagaacccgtgcagccaccccctccatcagtgccagtggtggccgaccagcgtaccattactttcacgtcttccaagaacgaggagcttcagggtaatgacagcaaaataacgcccagctctaaggagttagccagtcagaaaggctcggtgtcagagaccatagtgatcgatgatgaggaggacatggagacgaaccaggggcaggaaaagaattcgtccaacttcatagagcgccgtccccccgagacaaagaacagaacgaacgacgtagacttcagtacatcgtccttttcccgttctaaggtgaatgcaggcatggggaactctggcatcaccacggagcctgattctgaaattcagatcgcgaacgtgaccaccctggagactggtgtttcctctgttaatgacggtcagctcgaaaatacagacggcagagatatgaatctcatgattacgcatgtgacctctctccaaaatacaaatctgggcgatgtgagtaatgggctgcagtcttccaatttcggggttaatattcagacttacacgccaagcttgacttctcaaacgaagacaggagtcgggccattcaatcccggccggatgaatgttgcaggagatgtgttccagaatggcgaatctgctacccaccataaccccgattcctggatcagccagtccgctagctttccaagaaatcagaagcagccgggggtcgactcactcagtcctgtcgcatcactgcctaaacagatattccagcccagtgtgcagcagcagcccaccaaaccggtgaaggtgacgtgtgctaactgcaagaagccactacaaaaagggcagactgcctaccagcggaaaggtagcgcacatctgttttgctctacaacctgcctttcttcatttagtcataagccagctcccaagaagctctgcgtgatgtgcaaaaaggatataaccaccatgaagggcactatcgtagcccaggtggattccagcgaaagctttcaagagttctgcagcacgtcatgcctaagtttatatgaggataagcagaatcccactaaaggcgcccttaataaaagtcggtgcacaatctgtggaaaactgaccgaaattagacacgaggtttccttcaagaacatgacacataagctttgcagtgatcactgtttcaatcgataccgaatggcaaacgggctcatcatgaactgttgcgagcagtgtggggagtacctgccttccaagggggccggcaacaatgttcttgttatcgacggtcaacaaaaacggttttgttgccaaagttgtgtgtccgagtataagcaggtcggcagccaccccagctttctaaaggaagtgcgagatcacatgcaggactcgttcttaatgcagcccgaaaagtacggaaagcttaccacatgcaccggctgtcggacacagtgtcgattttttgatatgacccaatgcatcggtccaaatggatatatggagccctactgctctacagcgtgtatgaacagccacaaaacaaaatatgccaaatcccagagtctcggaattatatgccacttttgtaagagaaactccctgcctcaatatcaagccacaatgcctgacgggaagctttataacttttgtaacagcagttgcgttgccaaattccaagctctgagtatgcaatcttctccgaacggtcagttcgttgcgcctagcgatatacagctcaaatgcaactattgtaaaaactctttctgttcaaaacccgagattctggaatgggaggctagcttacaccagttctgttccaagacatgttccgatgactataaaaagctgcattgtatcgtaacatactgcgaatactgccaggaagagaaaactcttcatgagactgtcaacttcagtggcgtaaaacggccattttgtagcgaaggttgtaaactgctgtataaacaggacttcgcaagacgactcggcctgagatgcgtaacctgcaattactgctcccagctgtgcaagaaaggtgctacaaaagagttggacggcgtggtgcgtgacttttgcagcgaagattgctgcaaaaaatttcaggattggtactataaagcatgcgattgttgcaaaagccagggcacactgaaagaacgcgtccagtggcggggagagatgaaacacttttgcgaccaacattgcctgctgagattttactgccagcagaatgaaccgaatatgactacccagaaggggccggaaaatctacattacgatcagggctgtcagacctcacgtacaaagatgactggctctgccccccccccctctcccacccccaacaaagaaatgaagaacaaagccgtactgtgcaagcctctgactatgactaaggcaacttactgcaagccacacatgcagactaagtcttgccagaccgacgatacctggcgtacagagtatgtccctgttccaatcccggtgcccgtgtacattcccgtgcccatgcacatgtacagtcagaacatcccagttcccactacagtgcctgtgccagtccccgtccccgtatttctccccgctcccttggacagttctgagaaaattcccgcagcgatagaggaactgaaatccaaggtgagtagcgatgccttggatactgaattattgaccatgactgacatgatgtctgaagacgaagggaaaacggagaccaccaacatcaactctgtgatcatcgaaactgacattattggttctgatctactgaaaaatagtgaccctgagacacagagttctatgccagacgtaccttacgaacccgatctcgacattgaaattgatttcccaagagccgccgaggaactggacatggagaatgaatttctcctgccgccggtgttcggagaagaatatgaggagcaacctaggcccagatcaaagaaaaaaggagcgaagcgaaaggcggtgtctggctaccagtcacatgatgactcctccgataatagtgagtgcagttttccctttaaatacacatacggcgttaacgcttggaagcactgggttaaaaccaggcagctcgacgaagacttgttggtgctcgatgagctgaaatcctctaagtctgttaagcttaaggaggatttgctttcacacacaactgctgagctgaactacggcctggcacacttcgtaaacgagatacggaggccaaatggtgagaattacgcccctgactccatctattatctctgtttgggtattcaggaatatctgtgtggctcaaacaggaaggataacatctttatagaccccgggtaccaaacattcgagcaggagctgaacaaaatcttacgctcctggcagccttctattctgcctgatggctcaattttcagcagagttgaagaagattatctgtggcgtattaaacagctggggagtcattcacctgtcgcccttctcaataccttattttactttaatacgaagtactttggcctgaaaaccgtggagcagcatctgagactgtcattcgggacagtgtttcggcactggaagaagaacccactcaccatggaaaacaaggcctgtctgagataccaggtatcctccttgtgtggaaccgataatgaggacaagattaccactgggaagagaaaacatgaagatgacgagccggtttttgagcagatcgagaataccgcaaatccttctagatgtcccgtgaaaatgtttgagtgctatctttctaagagccctcagaacctgaatcaaagaatggatgttttctacctgcaaccagaatgctccagctctactgatagccctgtctggtatacttctaccagcctcgaccgcaatactctggagaacatgttggtgcgagtactcctggtgaaagacatctacgataaagacaattatgagttggacgaggataccgactag

SEQ ID NO: 141746 - DNA, 1134 bp, Artificial Sequence
  Description of Artificial Sequence: Synthetic coding sequence
atgcaggattcctttctcatgcagcctgagaaatatggaaaactcacaacatgtaccgggtgccggactcagtgtcgcttttttgatatgacccagtgcatcgggcccaatggctacatggaaccatactgttcaaccgcatgtatgaactctcacaaaaccaaatacgccaaaagtcagagcttaggcataatctgccacttttgcaagcggaattcgctaccacaataccaggccacaatgcctgacggaaagctgtataatttctgcaatagttcatgcgttgctaagttccaggccctttccatgcagtcttcacctaatggtcagttcgttgccccttcggatattcagctcaaatgtaattactgtaagaattccttctgcagcaaaccagagatcttagaatgggaaaacaaggtgcatcagttttgttcaaaaacctgcagcgacgactataaaaagctgcactgtattgtaacatattgtgaatactgtcaagaggagaagaccctacatgagacggttaacttcagcggagtgaagcgccccttctgctcagaaggctgtaagcttctttataagcaggactttgcccgtcgtctcggcctccggtgcgtcacttgcaactactgtagtcaactgtgtaagaagggagctacaaaagagttagacggagttgtgcgcgatttttgttccgaagactgctgtaaaaaattccaagactggtactacaaagccgcccgatgcgactgctgcaaatcccaagggactcttaaggaacgagtgcagtggcgcggagaaatgaagcacttctgtgaccaacattgtttgctacggttctattgccagcagaacgagcctaacatgacaacccaaaaaggcccagaaaatctccactatgatcagggctgtcagacctctcgaaccaagatgactggcagcgctcctccaccttcaccaactccaaacaaggaaatgaagaacaaggccgtgctgtgtaaaccactgaccatgaccaaggccacatactgtaagccacatatgcaaaccaaatcgtgccaaaccgacattacctggcgtatccaacatctgatcctgaatcactacgatcagagcctcatcaaggcttag

SEQ ID NO: 141747 - DNA, 4134 bp, Artificial Sequence
  Description of Artificial Sequence: Synthetic coding sequence
atggatacttcatctgtgggcggcttagagctcacggaccagacccccgtgctgctggggtccactgccatggctacttcgctaacaaacgtgggtaactccttcagtggccctgccaatcccttggtgagcaggagcaataaatttcagaacagttcggttgaagatgatgatgacgtggtgttcatcgaacccgttcagccacccccaccttccgtgcctgtggtggcggatcagcgaactataaccttcacgagttccaagaacgaggagctgcagggaaacgacagcaaaattacaccaagctccaaagagctcgcctcacaaaagggctcggtctcagagaccatcgtgattgatgacgaggaggacatggaaacgaaccaggggcaagagaaaaattcaagcaattttatcgaacggcgccccccggaaaccaagaacagaactaatgacgtagatttctccacttccagctttagcagatccaaggtcaacgccgggatggggaactccggtataacaactgagccagattctgagattcagattgcgaacgtgactaccctggagactggggtatctagtgtcaatgacggccagttagaaaacactgacgggcgagacatgaatttaatgattacccacgtcacttcactacaaaatactaacttgggcgacgtttccaatggcctgcagtccagtaatttcggcgtgaacattcagacttatactccctctcttacaagccagacaaaaactggcgtggggcccttcaaccctgggcggatgaatgtggctggtgacgtcttccagaatggcgaaagcgctacgcatcacaacccggactcttggatttcacagtctgcctcatttccacgcaatcagaaacagccaggcgtagactccttgtcccccgtggcctctctcccaaaacagatatttcagccttcggttcagcaacagccaactaaacccgtgaaggtcacttgtgcaaactgtaagaaaccgcttcagaaaggacagactgcctatcagaggaaaggtagtgcacatctattctgctctaccacatgtctttcaagtttttcacacaagccagcccctaagaagttgtgtgtgatgtgcaaaaaagatatcaccacaatgaaaggtaccatagtggcacaggttgattcttctgaaagtttccaggagttctgctctacatcttgcctatctttatatgaggataagcagaatccaacaaagggcgccctgaacaaaagcaggtgcacaatctgcggtaaacttactgagatcagacacgaggtgtctttcaagaacatgacacataagctttgttccgatcactgttttaaccgctatcgaatggccaacggattaataatgaactgctgtgaacaatgtggggaatacctgccgtcaaaaggggcgggaaataatgtcctggtgatcgacgggcagcagaaaaggttctgttgccagagctgcgtgagcgaatacaagcaggtgggatcccacccatcattccttaaggaagtgagagaccatatgcaagactcatttctcatgcagcccgaaaagtatggaaaactcactacttgtactggatgtcgaacacagtgtcgcttcttcgatatgactcaatgtataggtccaaacggctatatggagccatattgctccaccgcctgtatgaactcccacaagacaaagtatgccaagagtcagtcactagggattatttgtcacttttgcaagcggaattccctgccacagtatcaggcaaccatgcctgacgggaagctctacaatttctgcaactcttcctgtgtggcaaaattccaggccctgagcatgcagtcctcacctaacggacagttcgtggcaccttctgatatacagctcaagtgtaactactgtaagaacagcttttgcagcaagcctgagatactagagtgggagaataaggttcatcagttttgtagcaagacctgctccgacgattataaaaagctgcactgtatcgtcacctattgtgagtattgccaagaggagaagacactgcacgagaccgtgaacttctccggcgtaaaacgtcctttctgtagtgagggatgtaaactgctgtacaagcaggacttcgctcgaagactggggctgcgatgcgtaacctgtaattactgctctcagctgtgcaagaaaggagcaaccaaggagctcgacggtgtggtgagggacttctgcagtgaagactgctgtaaaaaatttcaggactggtattataaggctgcacggtgtgactgctgtaaaagtcagggcacactaaaagagcgggttcagtggagaggtgagatgaagcatttttgcgaccagcactgcctcttacgcttctattgccaacagaacgagccgaatatgactactcaaaagggcccagaaaatctgcattacgaccagggatgtcagacctcccgaaccaaaatgaccgggagtgcccctcctcccagccctacccctaacaaggagatgaaaaacaaagctgttctgtgcaagcccctgacaatgaccaaagccacctactgtaagccacacatgcagacaaagagctgccagaccgatgatacttggcgcacagaatatgtgcctgtccccatcccagtcccagtgtacatacctgtccctatgcatatgtatagccagaacattcctgtccctaccacggtgcccgtgccggttccggtaccggtatttttgcccgccccgctcgacagctccgagaagattcctgccgccatagaagagctcaaatcaaaagtttcttccgatgccctggatactgagctcttgacaatgacagacatgatgtccgaggacgagggcaaaaccgagacgactaacattaacagtgtaattatcgagactgatatcatcggaagtgatttactgaagaactctgatcctgaaacacagtcatcgatgcccgacgtgccctacgaaccagatctagacatcgagatcgactttccccgcgccgccgaagagcttgatatggagaatgaattcttattgccacctgtgtttggggaagagtatgaggaacagcccaggccaagaagtaagaagaagggtgccaaacgcaaggccgtgtctggttaccagagtcacgacgatagtagcgacaatagtgagtgtagcttcccttttaagtacacatatggagtcaacgcatggaagcattgggtgaaaactcgccagctagatgaggatcttctggtcctcgacgaactcaagtcaagtaaatctgtaaaactgaaggaagaccttttgagtcacaccactgcggagttaaactacggcctggcccattttgtgaatgagatccggagaccaaacggagaaaattacgcccccgactccatatactatctgtgtctgggtatccaggagtatctgtgcggaagcaaccggaaggacaacatcttcatagacccggggtaccaaacgtttgagcaggagttaaacaaaatactccgatcctggcagccatcgatcttaccagacgggtccatcttttcacgagtagaggaagactacctgtggcgaatcaagcagttaggcagtcacagcccagtggctctgctgaacactttgttctattttaacactaaatattttgggctcaagacagtcgaacagcacctccgcctgagcttcggcacagtgttcaggcactggaagaagaaccccctgaccatggagaacaaggcttgccttagataccaggtgtcttctctatgtgggacggacaatgaggacaaaatcacgactgggaagagaaagcacgaagacgacgagccagtcttcgagcagattgaaaatactgctaatcccagtcgttgtcccgtgaagatgttcgagtgttacttatctaaatctccccagaacctcaatcagcggatggatgtgttttacctccagcctgagtgtagctcctcaacagatagtcccgtgtggtacacaagcacctccctcgatagaaataccctcgagaacatgctcgtccgagtcctcctcgtgaaagacatatacgataaagacaactacgagctcgacgaagataccgattag

SEQ ID NO: 141748 - DNA, 4113 bp, Artificial Sequence
  Description of Artificial Sequence: Synthetic coding sequence
atggatccgagtgatttcccctcacccttcgaccccctcacattacctgaaaaacctctggcaggggatctacctgtggatatggaatttggagaggacctcctagaaagccagacggccccaacgcgcgggtgggccccaccaggtccaagtccctcatcaggagctttagacctacttgatactcctgcaggactagagaaagatcccggggttttggatggagctaccgaactcctcgggctgggcggtctactgtacaaagctccaagtccacctgaggtcgatcacggtccagaaggaacacttgcttgggatgcaggggatcagacattggaacccgggccaggtggacagacgcctgaggtggtacccccggaccctggagccggagctaattcttgctcaccggaggggctactggaaccgcttgcccctgactctcctatcacactgcagtctccccacatcgaggaagaagaaactacctccatcgccactgcaagaaggggttcccctgggcaggaggaggaactcccccagggtcagcctcaatccccaaacgcccccccatctccttctgtcggagaaaccctcggcgatggcattaattctagtcagactaagcctggcggatccagcccccccgcccacccaagtcttcctggggacggtttgacggcgaaggcatctgagaaacctccagagcgcaagcggtcagaacgggtccgcagagctgagcccccaaaacccgaggtagtcgactccacggagtccatacccgtgtcagatgaagactcagatgccatggtcgatgaccctaatgacgaggacttcgttccatttagacccaggaggtctccccggatgtcattgcgatcgtccgtatcacaacgcgctggcaggtctgcagtggggacaaaaatgacctgcgcgcactgtagaacccctctgcagaagggacaaacagcttatcaacgaaaggggcttcctcaacttttctgtagcagctcttgcttgacgacattcagcaagaaaccctctggaaaaaaaacgtgcacattctgtaagaaggagatctggaacactaaggacagcgtggtggctcagaccggttctgggggctcctttcacgaattttgtacttcagtgtgcctctccttgtatgaagcgcaacaacaacgacctatcccccagagcggagaccccgcggatgccacccgctgctcaatttgtcaaaagactggggaagtcctgcacgaggtatcaaacgggtcagtggtgcaccgcctatgttccgactcatgctttagtaaatttcgggctaataagggccttaaaacgaattgttgtgaccagtgtggcgcctatatctataccaagactggctccccaggcccagagctgctgtttcatgaaggtcaacagaaacgcttttgcaatactacatgccttggagcgtataagaaaaaaaacacacgggtatatccttgcgtctggtgtaaaaccctttgtaaaaacttcgaaatgctttctcatgtagatcgcaacggcaaaacaagcctcttctgctctctgtgctgtacaaccagctataaagtgaagcaggcggggctgaccggtcctccgaggccttgtagcttctgccggaggagtctgtccgatccctgctactacaacaaggtggatcggacagtgtaccagttttgcagcccctcttgctggactaaattccagagaaccagccctgagggggggattcacctgtcatgtcattattgccactcactcttcagcggaaaacctgaggtcctcgactggcaagaccaggtgtttcaattttgctgtcgggactgctgcgaagatttcaaaaggctgaggggggtggtgtctcaatgcgagcactgcagacaggagaagctgcttcacgaaaaattgaggttctctggcgtcgagaaaagcttttgcagcgaaggttgtgtgctgctctacaagcaggactttacgaagaaactgggcctgtgttgcatcacttgtacttattgctctcagacgtgccaacggggagtcacagaacaactcgacgggagtacctgggacttctgcagcgaagactgcaagtctaaatacctgctgtggtactgtaaggcggcccgttgtcatgcttgtaagagacagggcaaactcttagagacaattcactggcgcgggcagattcgccacttttgtaaccagcagtgcttactgcgcttttacagccagcaaaaccaaccaaacctggatactcaaagcggtcctgaatccctgctaaacagccaatcgccggagagcaagccacagacaccgtctcagaccaaagttgagaacagtaatacagtgagaacccctgaggaaaacggaaacctaggcaagatccccgtaaaaacccgatcagcccctacagcccctacacctccgcctccccctcccccagccaccccaaggaagaacaaagccgccatgtgtaaaccacttatgcaaaacagaggcgtgtcctgtaaggtggagatgaaatctaagggtagccaaacagaggaatggaaaccccaagtgatagtcctgcctataccagtacctatcttcgtgcctgtcccgatgcacctgtactgtcaaaaagttcccgttcctttctcaatgcctattccagtgccggttcccatgttccttccgacgacgttggagtctacagataagatcgtggagacaattgaggaactgaaggtgaaaattcctagtaacccgctggaggccgacattctggctatggccgagatgattgcggaggctgaagaactcgataaggcaagttccgacttgtgcgatctcgtgtctaatcagtccgccgaaggcctcctcgaagactgtgatctcttcgggccagcccgagacgacgtcctggccatggcagtgaaaatggctaacgtcttagatgagcccgggcaagatctggaagcggacttcccgaagaatcccctggacataaatccatccgttgatttcctgtttgattgcggcctcgtgggcccagaagatgtgagcaccgaacaggatctgcctcgcaccatgcgcaaagggcaaaaaagactcgtcctaagcgagagttgctctagagacagtatgtcctcccagccctcttgtactggattgaattacagctacggcgtgaacgcttggaagtgctgggtgcagagcaagtatgcaaatggcgagactagcaaaggagatgaactgcggtttggccccaagccaatgaggattaaggaggacatcctagcatgctcagctgctgagctcaactacggcctcgcgcagttcgtgagagaaatcactaggcctaacggcgaacgatatgagcccgactccatttattacttatgcctcggtatacaacagtacctactggagaataatagaatggttaatatcttcacagacctatattaccttacattcgtgcaggagctcaacaaatcactatcaacgtggcagccgactctcctgcctaacaacacggtgttctctagagtggaagaggagcacctgtgggaatgcaaacagcttggtgtctactcaccttttgtcctgctaaacaccctgatgtttttcaataccaagtttttcgggcttcaaaccgcagaggagcacatgcagttatctttcacaaatgtcgtgagacagagcaggaaatgtaccacccccaggggcacaaccaaagttgtgtcaatccgatactatgcaccggtgcggcagcgaaaaggtcgggataccggtccaggaaaacgcaagcgcgaagatgaggcccccattttggaacagagagaaaatagaatgaaccccctgagatgtcccgttaaattttacgaattctacttgagcaagtgtccggagtcgctccgcactcggaatgacgtattctacttacaaccagagagatcttgtatcgcggagagtccattgtggtatagcgtgatcccaatggacagaagtatgcttgagtccatgcttaatagaatcttggcagtcagggagatttatgaagagttgggtaggcccggggaagaagacctggattag

SEQ ID NO: 141749 - DNA, 4113 bp, Artificial Sequence
  Description of Artificial Sequence: Synthetic coding sequence
atggacccaagcgactttccttctccattcgaccctctgactttgcctgagaagcctctcgctggcgatttacccgtggacatggagttcggggaagacctgctagaaagtcagacagcgccgaccaggggatgggctcctcccggcccgagtccctctagtggtgccctggacctactcgatacccccgctgggctcgagaaggaccctggggtgctagacggcgctactgaactgctgggtctcggcggattgctgtacaaagccccttccccacctgaggtagaccacggtcccgaaggcactttggcctgggatgccggcgaccagacactggagcccggtcccggcggccagactccagaggtggtgccgccagatcctggagccggcgcaaactcgtgttctcccgaaggactgcttgagcccctggcccctgattcacccatcaccctccagtctcctcacattgaggaggaggagacgacctcaattgccaccgccaggaggggtagccctggacaggaagaagagcttcctcagggccagccacagtcccccaacgctccgccatctccttctgttggtgagactctgggggacggcattaatagttcccagaccaagcctgggggatccagtccaccagctcaccctagcctgccaggcgacgggttaacagcaaaggcgtctgagaagcccccagaaaggaaaaggtccgagcgcgtgaggcgcgccgagcctcccaaacctgaagtggtggattccaccgagtccattccagtcagcgatgaggattcagatgctatggtggatgatcctaacgatgaggatttcgtgcctttccggcccaggcgcagtccccgaatgagcctgaggagcagcgtgtcacagcgagctggtagatcagccgtgggcaccaagatgacatgcgctcattgccgcacacctttgcagaaaggccaaacagcctaccagaggaaaggcttaccacaactcttttgttcaagtagttgtcttactacgtttagtaaaaagcccagcggaaagaaaacctgtactttttgtaagaaggagatttggaacacaaaagacagcgttgttgctcagaccgggtctggaggtagcttccatgaattttgtacttccgtctgcctgtcactttacgaggcgcagcaacaaagaccaatacctcagtccggagatccagccgacgcaacaagatgctccatctgtcaaaaaaccggagaggtgctccatgaagtgagtaatggttccgttgtgcacaggctctgttctgactcctgtttctctaagtttagggcaaataagggcttgaagactaattgttgcgaccagtgcggtgcctacatctatacaaagactggttcacctggtcctgagctgctctttcacgagggccaacagaagagattttgcaacacgacttgtttgggggcttataagaagaaaaacacgcgcgtgtacccatgtgtctggtgcaagactctctgtaaaaactttgaaatgctctcacatgtggatcgaaacggaaaaacaagcttattttgctccctctgttgtacaacaagttataaggtcaaacaggcaggccttaccgggcccccccgcccctgcagtttttgccgaaggtccttgtctgacccttgttattataataaggttgacagaaccgtgtaccaattctgttcccccagctgttggacaaaattccagagaacatcccccgagggaggcatccacctgtcatgccactactgccattctctattttctgggaagccagaggtcctcgattggcaagatcaggtttttcagttctgttgtcgcgactgctgtgaagatttcaagaggttaaggggtgtggtgtcacagtgtgaacattgtcgccaagaaaaattgttgcacgagaagctgcggttttccggggtggagaaaagcttttgtagcgaggggtgcgtcctgctctacaagcaggactttacgaagaaactgggcctttgttgcatcacctgcacgtactgctctcagacctgtcagcggggtgtaacggagcagctggatggaagcacgtgggacttctgctcagaggattgtaagtcaaaatacctcctatggtattgtaaagctgccagatgccacgcatgcaagaggcagggcaagctactagagactattcattggaggggacaaatccgccatttttgtaaccagcagtgcctactgcggttctattcacagcagaatcagcctaatctggatacccagagcggacctgagagccttctcaatagtcagagccctgagtccaagccacagaccccttcccagaccaaggtggagaactccaatacagttcggacacctgaagagaacggcaatctagggaaaatccctgtaaaaacccgcagtgcgccaaccgctcctacccctcctccccccccccctccggcaacacctagaaaaaataaagcggctatgtgtaaacccctcatgcagaataggggggtgtcctgcaaggtggaaatgaagtcgaagggatcacaaacagaagagtggaaaccccaagttatcgtgctgccaattccagtgcccatcttcgtgcccgtccctatgcacctgtactgccagaaggtaccagtacccttctcaatgccaatccccgtgccagtgccaatgttcctgccaactactctggaatccactgataagatcgtggagaccattgaggagctgaaggtgaagattcctagtaatccactcgaggccgatattcttgctatggctgagatgatagccgaagcggaggaactggataaagctagttccgatctgtgtgatctggtgtccaaccagagcgccgagggcctgctggaagattgcgacctgtttggaccagccagagacgacgtgctcgccatggctgttaaaatggccaacgtgttggacgagcccgggcaagacctcgaagccgactttcctaaaaatccgttggacattaacccatctgtggatttcctgttcgattgcggcctcgtgggtcccgaggacgtgagcactgaacaggatctgccccgcacgatgcggaagggacaaaaacgattggtgctgtccgagtcatgctctagagactcgatgagctcacaaccgagctgtaccggcctcaactactcatatggtgtgaacgcatggaagtgctgggttcaaagtaaatacgcaaacggcgagacttctaaaggggacgagctgcggttcggacccaaacccatgcgaatcaaggaggatatactggcctgcagcgccgccgaattaaattatggcctggctcagtttgtgcgagagattactcgtcctaatggtgaaagatatgaaccagacagtatatattatctgtgccttggtattcaacaatatctgctggaaaacaatagaatggtcaatattttcactgacctttattatctgacgtttgtgcaggagctgaataagtctctgtcaacatggcagcccaccctcctacctaacaacacggtcttttcgcgggtggaggaagagcatctctgggaatgtaagcagctgggggtttactctcctttcgttctgttgaataccctgatgttcttcaacaccaaattctttggtcttcaaaccgctgaggagcacatgcagctgagttttaccaacgttgtcagacagtctagaaaatgtactactccccgagggaccaccaaagtagtgagtattaggtactacgctcccgtcagacagaggaaggggcgagacacaggcccaggtaaaagaaagagagaagacgaggctcctatcctggaacagcgagagaatcggatgaatcctctgcgctgcccagtgaaattttacgagttttacctgagtaaatgccctgagtctttgaggacaaggaatgatgtattttatttgcagcccgagaggtcttgtatagccgaatcacctctttggtactccgtcatccccatggaccgctcgatgctcgagtccatgctaaaccggatcctggctgtcagggaaatctatgaagagctcgggaggccaggagaagaggacctcgattag

SEQ ID NO: 141750 - DNA, 1050 bp, Artificial Sequence
  Description of Artificial Sequence: Synthetic coding sequence
atggacccgtcggattttccctccccattcgatccgctgacactgccagaaaagcctctggcaggagaccttcctgtagacatggagtttggcgaagacttgcttgagtctcagacggccccgacacggggatgggctcctccaggcccatctccatcatccggtgcactcgaccttttggataccccggctggtcttgaaaaggaccccggggtccttgatggagccactgagctgctcgggctggggggtctgttgtacaaggcaccctccccccccgaagtggatcatggccccgaaggcacgctggcttgggacgccggagatcagacactggagcctggtccaggcggccaaacacctgaagttgtaccccccgatcccggtgccggtgcgaattcctgttccccggagggcctgttagaaccacttgcaccagattcgcctattacattgcaaagccctcatattgaggaggaagagaccacgtcaatcgcaacagccaggcggggatcccctgggcaggaggaggagctgccccagggacagccccagagtccaaacgccccccccagccccagtgttggcgaaaccctcggagatggaatcaactcctcccagactaagccagggggtagctctcctccagcccaccctagcctgccgggagacgggctcacagccaaagccagcgagaaacctcctgagcgggtacaaaagcgttcagagagagttagacgcgcagagccccccaagcccgaagtcgtcgatagcacagagagtcgccgctccggcaccccacgtacccgactctggcgaagactcgtccttgaggcgccgagcatgagctctgctcacccgtctgtctcaccgtgtatgcgcccttctagctcagcgagatcaccaagcctcgggatcccacctacccttctcgccgctgcatacgccagacgcctagaacgatcctgcaccagaagcgccatggctgcctggtatactggttccgccgcgatcctggcctcacctaactcaggacccacacgagattag

SEQ ID NO: 141751 - DNA, 1488 bp, Artificial Sequence
  Description of Artificial Sequence: Synthetic coding sequence
atggacccctctgactttcctagccccttcgaccccctgacgcttcccgagaaacccctggccggggacctgcctgtggatatggagtttggcgaagacttgctggagagccagacagcacccacacgaggctgggcgccacctggaccctcgccttccagtggcgccttggatctgttggatacacctgcaggtttggaaaaagacccaggagttttagatggagccactgagctgctcggactcggcggcctgctgtacaaggctccttcgcctcctgaggtggatcatggccccgaaggtacactggcatgggatgccggcgaccaaactttagagcctgggcccggcggacagactcctgaggtcgtaccgccagaccccggagctggagctaattcctgctcacctgaagggctgctggaaccattggccccagacagtccaataaccctgcaatctcctcatatagaggaggaggagaccacttctattgccaccgcaagacgcggatcccctgggcaagaggaagaactgccccagggccagccccagtcccctaatgcccctccgagcccatcagtgggtgagaccttgggggatgggatcaacagtagccaaaccaagcccggcggatccagcccccccgcccacccttcgctgcccggggatggactcactgctaaggccagtgagaaaccccctgagcgaaaaagatcagaaagagttcgccgagctgaacctccaaaacctgaggtcgtggattccactgagtctatacccgtgtctgacgaggactccgatgccatggttgatgaccctaacgacgaggacttcgtgccatttcgcccccggagaagcccccgcatgagcctgaggagttccgtgagccagcgcgcaggacgctcagcagttggaacaaaaatgacctgcgcccattgcaggacacctctgcagaaagggcaaaccgcttaccagagaaaggggctacctcagttattttgctcttcaagctgtttgaccacattttctaagaagcctagtggaaaaaaaacatgcacgttttgtaaaaaggaaatctggaacactaaggattcagtcgtagcccaaacaggatcgggtgggagttttcatgagttctgtacttctgtgtgtctgagtctgtacgaggcccagcagcagcgccccataccccagtccggggaccccgccgacgctacgcgatgctccatatgccagaagacgggtgaagttctgcacgaagtcagcaacggatcagttgtgcaccggctgtgcagcgactcttgtttctccaagttccgggccaacaagggcctaaaaacgaattgctgtgaccagtgcggtgcttacatctacactaaaactggttcaccagggcccgaactcctatttcatgagggacagcagaagcgcttttgcaacaccacatgccttggtgcttacaaaaaggtggggccccgggaatag

SEQ ID NO: 141752 - DNA, 1494 bp, Artificial Sequence
  Description of Artificial Sequence: Synthetic coding sequence
atggacccgagtgattttccatccccgtttgatcctcttacactccccgaaaagcctctcgctggtgacctgccggtggacatggaatttggcgaggatcttctcgaatctcagaccgcaccaaccagaggctgggccccccctggtccttccccatcaagtggagctctcgatctgctggacacgccggccgggctggagaaagaccctggagtcctagatggcgctaccgagctgctcggactcggcggactactgtacaaagcaccaagtcctccagaagtggatcatggtccagaaggcacactcgcgtgggacgcgggggatcagacactggaaccaggacctggaggccagactcctgaggtggtacctccagatcctggtgcaggagcaaattcctgctctccggaaggcctgctagagccactggctcctgattcaccgatcacactgcagagcccccacattgaggaagaggagacgacatccatcgccaccgcaagacggggctcaccaggacaggaagaagaacttccacagggccaaccacagtcccccaatgcgccacccagcccatcagtcggtgagactctcggagacggcattaactcttcacagaccaagcctggagggagcagcccccccgcccatcctagcctgccaggcgatggtctgactgctaaagctagtgaaaagccacctgagcgcgtccagaagcgttcggaacgagtgcgccgggccgaaccgcctaaacccgaggtcgtggactccaccgaaagtattccagtttctgatgaagatagcgacgccatggtcgacgatcccaatgacgaagatttcgttccctttcggccccgcaggagcccccgtatgtccctccgctcttccgtgtcccagcgtgctggacggagtgcagtcgggacaaaaatgacctgcgcccactgccgcacaccattacagaaaggtcagaccgcgtaccagcgcaagggacttccacagctgttctgctcctcctcttgtttgaccacattctcgaaaaagccctccggcaaaaagacctgcacattttgcaaaaaggagatctggaacactaaagactctgttgtcgcacagacaggatcaggtggctcctttcacgagttctgcacaagcgtgtgcctcagcttgtacgaggcccaacagcagcgacctatcccccaatcaggagaccctgccgacgcaacccggtgctctatttgccagaaaaccggggaggttctacacgaggtgagcaacggctcggttgtccaccggctctgtagcgatagctgtttttccaaattccgggctaacaagggcctcaagaccaattgctgtgatcagtgcggtgcctatatctacacaaaaaccgggtctcctggacccgagttgctgttccatgaaggccagcaaaagcggttctgcaataccacctgtcttggtgcatacaagaaagtaggtccacgagaatag

SEQ ID NO: 141753 - DNA, 3843 bp, Artificial Sequence
  Description of Artificial Sequence: Synthetic coding sequence
atggatcctagtgactttccctccccgttcgatcctctgaccttgcccgaaaaaccattggccggcgacttgcctgtggacatggagttcggagaagatttgctggagagtcagacggcacccacccgcgggtgggccccccctggtccatcacccagttccggcgctctggacctgctggatacccccgctgggctagagaaagacccgggtgtgctagacggcgccaccgagctgctggggctgggaggattgctgtacaaggctccatccccaccagaggtggatcatgggccagagggaactctggcctgggacgccggggaccaaacgttagaacctgggcctgggggccagaccccagaggtggtaccccccgacccgggcgccggtgcaaactcatgcagccctgagggtctgctggaacccttggcacctgattccccaatcaccctgcagtctccccatatcgaagaagaggagactaccagcattgcgacagcacgaagggggtccccaggccaggaggaggaactaccacagggccaacctcagtctccaaatgccccaccctcacccagcgtgggtgaaaccttaggcgatggaatcaacagttcccaaactaagcctggcggatcttccccccctgcccatccgtccctgccgggcgatggacttaccgcaaaagcaagcgagaaaccccctgagagggtccagaagagaagtgaacgcgtcaggagagcagagccacctaagccagaggttgtggatagcacagaatcaattcctgtgtctgacgaggactcagacgctatggttgatgatccgaacgacgaggacttcgtgcctttccgtcccaggaggagccctcgtatgagcctccgctcttccgtgagccagcgggctgggaggagcgcagtgggaaccaagatgacatgcgcacactgtagaaccccgttgcagaagggccaaacagcctatcaaaggaaagggctgccccaactcttctgttcttctagctgccttactacatttagtaagaagccctccggaaagaaaacctgcacgttctgtaagaaggagatctggaacaccaaagactctgtcgtggcccagacggggtccggcggctcattccatgagttctgcacatccgtatgcctgtccctctacgaggcgcagcagcagagacccataccccagagcggggaccctgctgacgccacccgctgcagcatttgccagaagaccggggaagttctacacgaggtgagtaatggatcagtcgtgcacagactttgcagtgactcttgcttttcaaaatttcgcgccaataagggcttaaagactaactgttgtgaccagtgtggagcgtacatttacaccaagacggggtctccaggtcccgaactgttattccacgagggccagcagaagcgtttttgtaacactacctgcctgggggcatacaagaagaaaaacactcgggtgtatccttgcgtctggtgcaaaacactgtgcaagaacttcgagatgctgagccacgtggatcgtaacgggaaaacctccctgttctgttccctgtgttgcaccacaagctacaaggtgaagcaagccggcctgaccggtccaccccgcccatgtagtttctgtcgacgcagcctttctgatccttgctattataacaaggtcgatcggaccgtctaccagttttgcagcccaagctgctggacaaagtttcagcggacttcccctgagggcggcatccacttgtcttgtcactactgtcacagcctcttctcaggcaaacccgaggtattggactggcaggaccaggtctttcagttctgctgcagggactgctgcgaggactttaaacgtctcaggggagtggttagtcagtgcgagcactgccggcaggaaaagctgttacatgagaagcttagatttagtggagtcgaaaagtcgttttgttcggagggttgcgtgctactgtataaacaggattttacaaaaaagttgggcctctgttgcatcacttgcacctattgttctcagacctgtcagcggggcgttacagaacagcttgatggttctacgtgggacttttgtagcgaggattgtaagagcaaatacttactatggtactgcaaagcggccaggtgccatgcttgtaaaagacagggcaaacttctggagacgattcattggcggggccagatcagacacttctgcaatcagcagtgcctactcagattttattcccagcagaaccagcctaatctggatacacaatctggccccgagtctttactaaattcccagtccccggagagcaagccgcagaccccatcacagacgaaggtagaaaactccaacacagtgcgaacccccgaggagaatgggaatttgggcaaaattcccgtgaaaactcggtccgctcccaccgctcccacccccccaccaccccccccgcccgcaacccctagaaagaataaggccgccatgtgcaagccactgatgcagaacaggggcgtatcttgcaaagtggagatgaagtcgaagggttctcagaccgaagaatggaagccacaggtcattgtgttgcccattcctgtaccaatcttcgttcctgttcccatgcatctgtactgccagaaagtacccgttccattttccatgccaatccctgtccccgtacccatgttccttcctactacactggagtccacagacaagatagtggagacaatcgaagagctgaaggtgaaaattccctctaatcccctagaggcagacattctagcaatggctgagatgattgctgaggccgaggaactagataaagccagcagcgatttgtgcgacctcgtgtccaaccagtccgcagagggactgcttgaagactgtgacctcttcggccctgcacgagacgatgtgctggccatggctgtcaagatggccaatgtcctggatgaaccaggccaagacctggaggcagacttcccaaagaatcccctcgatattaatcccagcgtagacttcctgttcgattgtggcctggtggggcctgaagacgtgagcactgagcaggatttaccccggacgatgaggaagggacagaaacggcttgtgttatccgagagttgttccagggatagcatgagttcccagcccagctgtacaggcctgaactactcatatggtgtgaatgcttggaagtgctgggtgcagagcaagtatgccaacggcgaaaccagtaaagcaaagccgatgcggattaaggaggatatcctagcctgctctgccgcagagttgaactatggactcgcacagtttgtgagggagatcacgcgcccaaacggggagcgatacgagcccgacagcatatactatttgtgcctcggtatccagcaatacttactcgagaacaataggatggtaaatatcttcacagacctgtactacctgacatttgtgcaggagctgaataagtcattgtctacctggcagcctaccttgctacccaataacactgggcctggaaagcggaaacgcgaagacgaggccccgatcctcgaacagagggagaaccgaatgaatcctttgcgttgccctgtcaaattctacgagttttacctctccaaatgtccggaaagcctgagaaccagaaacgatgttttctatttgcaacctgagcggtcttgtatcgcggaatcccccctgtggtattcagtgataccaatggatcgctccatgttggagagtatgttgaaccggattttggctgtaagagaaatttacgaggagcttggtcggcccggggaagaggacctggattag

SEQ ID NO: 141754 - DNA, 4119 bp, Artificial Sequence
  Description of Artificial Sequence: Synthetic coding sequence
atggaccccagcgatttcccatccccttttgatcccttaacgttgccagaaaaacccttggcgggggatctgccagtcgatatggagttcggtgaggatctccttgagtctcagactgcccccacccgtggctgggcgcccccagggccatccccaagtagcggtgctttggaccttctggatacacctgctggtctggagaaagacccgggcgtcctagacggcgccaccgagcttctgggcctgggcgggttgctatataaggccccttccccccctgaagtggatcatggtccagagggcacactggcttgggacgcaggcgatcaaaccctggagccaggtcctggaggacagactccggaggtagttcccccggatccgggcgctggcgccaactcgtgctcaccagagggactcctggaacccttagcgccagacagtcctatcacactccagtccccacacattgaggaagaggagactactagcattgctacagcgcgccgcggctcccctggtcaggaagaggaactgccccagggccaacctcagtcaccaaacgccccgcctagcccctctgttggcgaaacacttggcgacggcatcaattcatcacagacgaagcctggcggctcttcgccacctgcacatccaagcctaccaggcgacggcctgacggccaaggcctccgaaaagcccccagaacgtgtccagaaacgctcagagcgggtgagacgggcagagccacctaaaccagaggtggtcgattccaccgagtcaatccccgttagcgacgaagacagtgacgctatggtggacgatcctaatgacgaggactttgtcccctttcggccaaggagatccccacggatgtctctgaggagcagcgtctcccaacgagccggaagatcagctgtcggcaccaaaatgacctgcgctcactgccggaccccattgcaaaagggacagacagcttaccagcgaaaaggccttccacagcttttctgctccagtagctgtctgaccactttttccaaaaaaccatctggaaagaagacttgtactttctgtaagaaggagatttggaacaccaaggacagtgttgtggcccagaccggcagtgggggcagctttcacgagttctgtacatctgtttgtctgtccttgtatgaggcgcagcagcaacgtcccatcccacaatcgggagacccagcagatgctacccggtgtagcatctgccaaaagacgggcgaggtgctgcacgaagtcagtaacggatcagtggtccaccgactgtgctccgactcctgcttttcgaagttcagggctaacaagggtctgaagactaactgctgtgatcaatgtggtgcatatatatacactaaaactggctcccccggtccagagctcctgtttcacgaagggcagcagaaacgattctgcaacacaacctgccttggggcttacaaaaaaaagaacacgagggtttacccctgcgtatggtgcaaaaccctgtgcaaaaactttgaaatgcttagccacgtcgacaggaatggcaagacctccctgttctgcagcctgtgttgcacgacctcctataaggtgaagcaggccggcctgactggaccccccaggccatgttcattctgtcgcagaagcctctcagatccatgctattataacaaggttgaccggactgtttatcagttttgttcgcctagttgttggacgaagtttcaacgtactagtcccgagggaggaatccacctgtcgtgccattactgtcattcattgttttccggcaaacctgaggtgctggactggcaagatcaggttttccaattttgttgcagagactgctgtgaagatttcaaacgcctgcggggagtagtcagtcagtgcgagcattgccgccaggagaaactgcttcacgaaaagttgcgatttagtggtgtcgagaagagcttctgctctgaaggatgtgtgttactctacaaacaggatttcacgaaaaagctgggcttgtgttgcatcacctgtacctattgtagccagacatgccagagaggtgtcaccgaacagctggatgggtctacctgggacttctgtagcgaagattgtaaatcgaaatacctgctgtggtactgtaaggctgccagatgccacgcttgcaagaggcaggggaaactactcgagacaatccactggcgggggcagatccggcatttctgtaatcaacagtgtttgctgagattctactcccaacagaatcaacccaatctggacacccagtctggtcccgagtctctactaaattcacagtctccagaatccaagccccaaaccccgagtcagacaaaggtcgagaactcgaacactgtgagaacccccgaagagaatggcaatctgggaaagatacctgtgaagaccagatctgcaccaaccgcccccacacctccaccgccaccacctcccgctacaccccggaagaacaaagccgctatgtgcaaacctctcatgcaaaatcgaggcgtatcctgcaaggtcgagatgaaaagcaaggggtctcaaaccgaagagtggaagcctcaggttatagttctcccaatccccgtaccgattttcgtgcccgtgcctatgcatttgtattgccagaaagtgccagtgcccttctcgatgcccatccctgtccccgttcctatgttcttgccaactactctagaaagtacagacaagatcgtagagacaatcgaagaactcaaagttaagatccctagcaatccattggaggctgacattttggcaatggccgagatgatcgccgaagcggaggagctggacaaggcctcatccgacttgtgtgatctggtgtctaaccagtccgccgaagggctcctggaggactgcgacctgttcgggccagcacgtgatgatgtgttagccatggcagtgaaaatggcaaacgtcttggatgagccgggccaggatctggaggctgactttcctaagaatccactggatatcaacccttctgtggatttcctcttcgattgtggccttgtaggtcctgaagacgtaagtaccgagcaggatttgcctcgcacgatgaggaagggacagaagcgattggtacttagtgagtcatgctctagggatagcatgtcctcccaaccctcgtgtaccggactgaactattcctacggagttaatgcctggaaatgctgggtccaatccaaatacgccaatggagagaccagcaagggagatgagcttagatttggcccaaagcccatgcgaatcaaagaagatatcctggcatgcagcgcggcggaactgaattacggacttgctcagttcgttagagaaattaccaggccgaatggtgagaggtatgaacccgattcgatttattatctctgtttagggatccagcagtacctgctagaaaataatagaatggtcaacattttcactgacctgtactatctaacatttgtgcaggaactaaacaagtcgttgtctacctggcaacccaccctgctccccaacaataccgtgttctctcgggtggaggaagagcacctgtgggaatgtaagcaactgggtgtttatagccctttcgtgctcctaaacacccttatgttcttcaatacaaagttcttcggccttcaaactgccgaagagcatatgcagctgtcattcactaacgtagtccgtcaaagtaggaaatgtaccaccccacgagggaccactaaggtggtgtccatacgctactacgctcctgtgcgccagcgcaaaggccgggataccggcccaggaaagagaaagagagaagacgaggcgccaatccttgagcagcgggagaatagaatgaacccgctgagatgtcccgtgaaattttatgagttctatctctctaagtgccccgaaagcctccgcacaaggaacgatgtgttctatctgcagccagaaagatcttgcatcgcagagagtccactgtggtatagtgtgattcccatggacagatcaatgctggaatccatgctgaatcgtatcttggctgttcgagagatctatgaagagttggggaggcccggtgaggaagatctggactag

SEQ ID NO: 141755 - DNA, 4077 bp, Artificial Sequence
  Description of Artificial Sequence: Synthetic coding sequence
atggaccccagcgacttcccttctccgtttgatcccctgactcttccggagaaacctctggctggcgatctgcctgtagatatggaattcggtgaagatttgttggagtcccagacagctccaactcgcgggtgggctccaccaggcccgtctccaagttccggcgccctcgacctgctggacacacctgctggactcgaaaaagacccaggcgtactggacggagccacagaactcttaggattaggaggcctgctgtacaaagcccctagcccgccagaggttgaccacggtcctgagggcactttggcctgggatgccggcgaccagaccctggagccagggcccggcgggcagacccccgaggtcgtacctcctgaccctggcgctggagctaactcctgttcccccgagggcctgctggagccactggctcctgatagcccgataacacttcaatccccacacatcgaggaggaggaaactacctcgattgcaacagccagaaggggcagtcccgggcaggaggaagaactgccacaggggcagcctcaatctcccaatgcaccaccttctccttcagtgggcgagacgcttggggatggaattaactcatctcagactaaaccaggaggctcttctccacccgctcatccgagcctccccggggatggcttaaccgccaaggccagcgagaaaccacctgaacggaaaaggagtgaaagagtgcgacgggccgagccccccaaacccgaagtagtggactctactgagagcattcctgtgtcggatgaagatagtgatgcgatggtggatgatccgaacgacgaggacttcgttcctttccgcccacgcaggtcaccgaggatgtcccttcgctcttctgtgtcacagcgcgccggcagaagtgcagtcggcacaaagatgacctgcgcacactgtaggactcccttgcagaagggacagacagcctaccaacggaaggggcttccacagctcttctgttcttcctcttgtctgaccactttttccaagaaaccctctggaaaaaagacctgtacgttttgtaaaaaggagatctggaacacaaaagactccgttgtggctcaaaccggcagcggtggaagttttcatgaattctgcaccagcgtgtgcctgtccctgtatgaggcacaacagcaaagaccaattccacagtcaggcgatcctgcagatgccacacgttgttctatctgccaaaaaacaggggaggtgctccatgaggtaagcaatggctcggtggttcatcgtctgtgcagcgacagttgctttagcaagtttcgggctaacaaggggctcaagaccaactgttgtgatcagtgcggcgcatatatttacactaagacaggatctcccggccctgagctgttgttccacgagggacagcagaaaagattctgcaacaccacctgtctgggggcatataaaaagaaaaacacccgggtctacccctgcgtatggtgcaaaactctctgcaagaattttgaaatgttgagccatgtcgaccggaacggaaaaacaagtcttttctgctcactgtgttgcaccactagctataaagtcaagcaggccgggctcacagggcctccacggccatgtagcttctgcaggcgctccctctccgacccctgctactataataaggtggatcggaccgtgtaccaattctgttccccatcttgttggaccaagtttcagaggacttctcccgaaggagggatccacttatcatgtcactactgccactctctcttttccggaaaaccagaagtcctggactggcaggaccaggttttccagttctgctgcagagactgttgcgaggatttcaagcggctgcggggagtcgtcagtcagtgcgaacattgccgtcaggaaaagttactgcatgagaaacttcgcttctccggcgtcgaaaagtcattctgcagcgagggttgcgtgctgctctacaaacaggacttcacaaaaaagctgggactctgctgtatcacctgtacctattgtagtcagacatgtcaacggggcgtgaccgagcaactggatggcagtacatgggacttttgttccgaggactgcaaatccaagtatctgctctggtattgcaaggcagctagatgtcatgcctgtaagcgccaggggaaattactggaaaccattcactggcgcgggcagatccggcatttctgcaaccaacaatgcctgctgcgcttttacagtcaacagaatcagcctaacctggacacgcagagcggccctgaaagtcttctaaatagtcagtcccctgaatcaaagccccagaccccttcccaaactaaagtcgagaactctaatactatccccgtcaaaaccaggtctgcacctacggcccccaccccacccccaccaccccctcccgcaactcctcgcaagaataaggccgccatgtgcaaacccttaatgcagaatcgcggtgtttcctgcaaggtggagatgaaaagtaagggtagccaaacagaggaatggaagcctcaggtgattgtcctgcctatcccggtgccaatcttcgtccccgtgccaatgcacctgtactgccagaaggtgcccgtgcccttttcgatgcctattcctgtccccgtgcctatgttcctgccaaccacgttagagagtactgacaaaatcgtggagaccattgaagagctcaaggtgaagattccatctaatccccttgaggcggatatactggccatggctgagatgatagccgaagcggaggagctggacaaggcctcctctgacttatgcgacctggtttccaatcagagcgctgaaggactgctcgaggactgtgatttgttcgggcccgccagggacgatgtgcttgccatggcagtgaagatggcaaatgtgctcgatgaacctggacaggatctggaagctgattttccgaaaaatccccttgatataaacccatctgtcgacttcctcttcgattgtggactggtgggacctgaagatgttagcaccgaacaggacctgcctcgcaccatgcgtaagggccagaaacgtctcgtgctctcggaatcgtgctcacgcgactcaatgtccagccaaccgtcatgcaccggactcaattactcttacggggtaaacgcttggaaatgctgggtgcagtcaaagtacgccaacggcgaaacatcgaagggtgacgaattacgatttggccctaagcccatgcggatcaaagaggacattcttgcttgctcagccgccgagctcaactatggcctggcccagttcgtgcgggaaattacccggcctaacggagaacggtacgagcctgacagcatctactacctttgtctggggatccagcaatatctgcttgagaataacagaatggtgaatatttttaccgatctgtattatctgacctttgttcaggagctaaataaatcactgtctacctggcagccaactttgctcccaaacaacaccgtgttctcaagagtagaggaagagcatttgtgggagtgtaaacaactaggagtgtacagtcctttcgtgctcctgaacaccctgatgttttttaatacaaaattttttggcctgcagaccgctgaggagcacatgcagttgagctttaccaatgtcgttaggcagtcacgaaagtgcactactcccaggggaacaacaaaagtcgtttcaatcaggtattacgccccagtgcgccagcgcaagggaagagataccggtccaggtaagagaaagagagaagatgaggccccaatactggaacagagagaaaaccggatgaaccccctgaggtgtcccgtcaaattctatgaattctacctcagtaagtgtccggaatcactaagaacacgaaatgatgtcttttacctgcagcccgagaggagttgtatcgcagaaagccctctctggtacagcgtgatccccatggaccgttcaatgctggagtcgatgctgaacagaatacttgctgtgagggaaatatacgaggagcttggccgtccaggcgaggaggatttggactag

SEQ ID NO: 141756 - DNA, 2112 bp, Artificial Sequence
  Description of Artificial Sequence: Synthetic coding sequence
atggaattcgttagtggctaccgggacgagttcctggacttcacagccctcctgtttggttggtttcgaaaattcgtcgcagaacggggagctgtgggtactagcttggaaggtcgatgcaggcaactggaagctcaaatcagacgactcccacaggatcctgccctgtgggtcctccatgtgctgcccaaccactctgttggcatttccttgggccaaggcgccgaacctggtcctggacctgggctaggcaccgcatggcttctcggcgacaatccccccctgcacttgagggatctgagtccgtatatcagctttgtgtccctggaggatggagaggaaggggaggaggaggaagaggaggatgaggaagaagagaagcgcgaggatgggggagccggaagcacagaaaaagtcgagccagaagaagatcgggagctcgcccccacgtctcgggagtccccacaggaaaccaaccctcctggagaatctgaggaggccgctcgagaagctggaggtgggaaggatggctgtcgggaagatcgagtagagaacgaaactaggcctcagaagaggaaaggccagcgcagtgaggccgctccgctgcatgtgtcctgtctacttctggttacggacgaacatgggacaatcctggggatcgacctgctagttgatggcgctcaaggtactgcttcatgggggagtggaacgaaggatctggcaccctgggcctacgccctgctgtgccattctatggcatgccccatgggctccggagatcccaggaaacctcgtcagctgaccgtcggggacgcccgtttgcaccgggaactggagagcctggtaccccgcttgggtgtcaagctggccaagacccccatgagaacgtggggacccaggcctgggtttactttcgcttcgctgcgtgccaggacatgtcatgtatgccatcggcactcttttgaggcaaaactgacaccctgtccccagtgtagcgcagtgctgtactgcggggaagcatgtctgagagcagactggcaaaggtgtcccgatgacgtgagccataggttctggtgcccgcggcttgccgcctttatggaacgggcgggggagctggctacactcccttttacgtatacagctgaggtaacatctgaaactttcaacaaggaggcattcctggcttcccgcgggctgacccgcggatactggactcagctcagcatgttgatccctggccctgggttcagccgccaccccaggggaaatacgcccagcctttccctactcaggggcggcgatccctaccagttgctgcagggggacgggacagctctgatgccaccggtcccccctcacccgcccagaggggtgtttgttcctgagctaaacatccagaacaaacagagcctaaaaattcacgtcgtagaggcaggtaaggagttcgacctcgtcatggttttctgggagttgctggtgctgctgccacacgtggcgctcgaactgcagttcgtgggggatggtctgccccctgaatcagatgaacagcatttcacgcttcagcgggactctctggaagtttctgttagacctgggagcggaatctccgctcgcccgtcatcaggcaccaaggaaaaaggcggtaggcgggatctccagattaaggtctccgcaaggccttatcatctttttcaaggtccgaagcctgacctggtcattggttttaattcaggctttgcactgaaagacacttggttgcggtccttgcctcgcctgcagtctcttcgcgtgcccgccttctttactgagtcttctgaatactcttgcgttatggatggacagaccatggctgtggccacaggaggcggtacaagccctccccaacccaacccatttcgaagcccgttccgtctacgcgccgctgacaactgcatgagttggtactgcaacgccttcatctttcatctggtgtataagccggcacagggcagcggagcaaggcctgctccgggtccccctcctccctccccgactccctctgccccgcctgctcctaccagacgtcgcaggggtgaaaagaagcctggccgcggcgcaaggaggagaaaatag

SEQ ID NO: 141757 - DNA, 2229 bp, Artificial Sequence
  Description of Artificial Sequence: Synthetic coding sequence
atggagttcgtatccggatatagagacgagtttcttgatttcactgctctgctcttcggatggttccggaagttcgtggcagagagaggagccgtcgggacaagcctggaaggacggtgcaggcagctcgaggcacagattcgccgattgccccaggacccagccctgtgggtcttgcacgtgctacccaaccattcggtgggaatttcactgggccagggtgcagaaccaggtcccggacctggactgggcacagcctggcttctgggcgacaatccaccccttcaccttcgggacctgtcgccctacatctccttcgtgtctttagaagatggggaggaaggagaggaagaagaagaggaagatgaggaggaggagaaacgagaggacggaggtgccgggtctaccgagaaagtagagccagaagaggatagagagttggcccccacttcgcgggaatcaccacaagagacaaacccccccggggagtcagaagaagcggcgagagaggccggcggaggcaaggacgggtgccgggaggacagggtagaaaacgaaaccagaccacaaaaacgcaaagggcagcggagcgaagctgcccccttgcacgtatcctgcctgctcctggtgaccgatgagcacgggaccattctcggaattgatctgctggtcgacggcgctcagggtactgcaagttggggcagcgggacaaaggatctggctccatgggcatatgccctgctgtgccattctatggcttgtcctatgggatccggcgacccccgcaagccgaggcagttaactgtgggcgatgcccgcctccaccgggagttggagtctctcgtgcctcgacttggcgtaaagctcgcgaaaacccccatgaggacatggggaccaaggcctggattcacgttcgcctccttacgggcccggacctgccatgtgtgtcaccgccactcctttgaagccaagctcacgccatgcccccagtgctccgccgttctatactgcggagaagcctgcctcagggcagattggcagcgttgccctgacgacgtatcacaccgcttctggtgtcctagactggctgctttcatggaacgggctggcgagcttgctacactcccgtttacatataccgccgaggtcaccagcgagacttttaacaaggaggccttcctggcctctcgcggactcactcgtggttattggacacaactttctatgttaatccccggccctggttttagcagacacccaaggggaaacactccgtccttgtccctgcttcgcgggggagatccctaccagcttctgcagggcgacggtactgccctcatgcctccagtacccccacatccgccccgtggggtctttggttcatggcaggactattatacttggcgaggtctgtctctggatagccctatcgcggtgctgttaacctatcccctcacggtgtactacgtgattactcatctggtccctcaaagcttccctgaactgaacatacagaacaaacagagtttaaagatccacgtagtggaagcaggcaaagaatttgatctggtgatggtgttttgggaactgttggtgttgctcccccatgtcgccctggagctgcagtttgtcggcgatggcctaccaccagaaagcgatgaacagcatttcaccctgcaaagagattctctcgaagtaagcgtgcgaccagggtccgggataagtgccaggccctccagtgggactaaggaaaaaggcggaaggcgtgatttgcaaatcaaagtctcagcacgcccctaccacctatttcaagggcccaagccagatcttgtgatcgggttcaattctgggtttgcccttaaagatacatggctgagaagcctgccccgcctgcagtcactgcgggtgcccgcattttttaccgagagcagcgagtacagctgtgttatggacggtcagaccatggccgtggccactggcggcggcaccagtccaccacagcccaatccttttcgatccccctttaggctgagggccgccgacaattgtatgagttggtattgcaacgccttcatctttcatctcgtgtacaaacctgcccaagggtccggcgctcgtcctgctccagggcctccccccccgtccccgacgccatccgctccccctgcccccacacgtagaagacggggagagaagaagccaggccgcggggcgcgaaggcgtaaatag

SEQ ID NO: 141758 - DNA, 684 bp, Artificial Sequence
  Description of Artificial Sequence: Synthetic coding sequence
atgacagatttcaagctcgggatcgtgagactgggaagggtggctggaaagacaaaatacacgttaatagatgagcaggacatacctctcgtggagtcatacagcttcgaagctcgcatggaggtagatgctgacggaaatggagccaaaatattcgcctacgcttttgacaagaatagagggcggggcagcggcaggcttctccacgagctgctgtgggagaggcacaggggtggcgtggccccgggttttcaggtagttcacctgaacgccgtaacagtggataacaggctcgacaatctgcagttggtgccttgggggtggaggcccaaagccgaggagacaagctcaaagcagagggaacagagtctctactggcttgccatccagcagcttcccaccgatccaattgaggagcagtttccagtgctgaacgtaacccgctattacaacgcaaacggggacgtggtggaggaagaagagaatagttgcacgtactatgagtgccattaccctccctgtaccgtgattgaaaaacagctgagagagttcaatatctgtggccgttgccaggtggcacgttactgcggctcccaatgccaacaaaaggattggcccgcccataagaaacactgtcgggaaaggaagagacccttccagcatgaactggagcccgagaggtag

SEQ ID NO: 141759 - DNA, 2127 bp, Artificial Sequence
  Description of Artificial Sequence: Synthetic coding sequence
atgtccgagagaggaatcaaatgggcctgtgagtactgcacatacgaaaactggccatcggcaatcaaatgtactatgtgtagggcacaaaggccatcggggacaattatcaccgaggaccccttcaaatccggatctagcgacgtcggaagggattgggatccgtcaagcaccgaaggagggagtagtccattgatttgtcctgacagcagtgctcgcccccgtgtaaaatcatcctatagcatggaaaatgccaataaatggtcatgtcatatgtgcacatacctgaattggcccagagccatcaggtgtacccagtgcctatcccagagacggacccggagtccaactgagtcacctcagtcttctgggtctgggtctcggccggttgcctttagtgtcgacccatgcgaggaatacaatgataggaacaaacttaataccaggactcagcactggacttgtagtgtctgcacttacgaaaattgggctaaggcaaagagatgcgtggtgtgcgaccatcctcgaccgaacaatatcgaggcgatcgagctggcagagaccgaggaggcctcatccattatcaacgaacaggaccgtgcccgctggagagggtcatgcagctccggtaactcccagcgccgcagtcctccggcgactaagagagattccgaagtgaagatggatttccagagaatcgaactggccggtgcagtcggttcaaaagaagaacttgaggtggacttcaaaaagctcaagcagataaagaataggatgaaaaaaaccgattggctattcctcaatgcttgcgtgggggtagtcgagggcgatcttgcagcaatagaggcttacaaatcttcaggaggcgatattgcccggcagctgactgccgatgaagtcaggctgctgaaccgtccatccgccttcgatgtagggtacacactggttcacctggcgattagattccaacgccaggacatgctggctatcctgctcacagaagtgtcgcagcaggccgccaagtgtattcccgcaatggtatgtccagagctgaccgaacagattaggagggagattgcagccagtttgcaccagcggaaaggcgattttgcctgttacttcttaacggatctggtgactttcacactcccagcagacatcgaagacctacccccgactgtgcaggaaaagctgttcgatgaggtgctggaccgggacgtccagaaggagcttgaagaagaaagtcccatcatcaattggtcattagagctcgctacacggctggattctcgtctctacgctctgtggaaccggactgcaggcgactgcctgctcgactcagtgttgcaggcaacttgggggatatatgacaaggacagcgttttgagaaaggctctccacgattctctgcacgattgctcccactggttttacacaagatggaaggactgggagtcctggtactcacagtcctttggactccatttcagcctcagggaagagcagtggcaggaagactgggcatttattctcagcctggccagccagcccggggccagcctagagcagactcatatctttgttcttgcccatatcctccggcggcccataatcgtgtatggtgtgaagtattataagagctttcgtggcgaaaccctgggctatacccgctttcaaggtgtgtaccttccactgctgtgggagcagtcattctgttggaagtcgccaattgcactaggttataccagagggcatttctccgcgttggtggcgatggagaacgacgggtatggcaacagaggcgctggggcaaatctcaatactgacgatgacgttacaattaccttccttcccctcgtagattcagaacgaaaactcctgcacgtgcatttcctgagcgcgcaagagctgggtaacgaggaacagcaggaaaagttgttgagagagtggctcgactgctgcgtcaccgaagggggtgtccttgtggctatgcaaaagagttcacggcgacggaatcaccctctggtgacccagatggtggaaaaatggcttgacaggtaccgtcaaatccggccttgcactagtctgagcgacggagaggaggacgaggacgatgaggacgaatag

SEQ ID NO: 141760 - DNA, 2400 bp, Artificial Sequence
  Description of Artificial Sequence: Synthetic coding sequence
atggagatccccaagctgctgcccgcaagaggaaccctgcagggcggcggcgggggcggaataccagcaggcggggggcgagtgcatcggggtccagacagtcctgcagggcaggtcccaacacgtaggctgctcttgccgagaggtccccaggacggcggccctgggcggagacgggaagaggcatctactgcctccagaggccctgggccaagcttatttgcccctcgaccccatcagccgtcgggagggggcgacgactttttcctggtgttactggaccctgtaggcggcgatgttgaaacagccggtagcggacaggcagccggccctgtgttacgggaagaggctaaggcgggccctgggcttcaaggcgacgaatccggcgccaacccagccgggtgctctgcacagggaccgcactgtcttagcgcagtgccgacccctgccccaatatccgcccctggccccgccgccgcgttcgctgggaccgtcacaatccataaccaggacctcttgctgcggtttgagaacggcgtcctcactcttgccacaccaccgccccacgcttgggaacctggcgccgcaccagcccagcaacctcgatgtctgatcgcccctcaggccggttttcctcaggccgcccaccctggtgactgtcccgaactgaggagcgatctcctgttggcagagcccgctgagcctgccccggccccagcccctcaggaagaggcagaggggcttgcggccgctttggggccgcgaggactgttgggcagcggtccaggcgtggttctgtatctgtgtcccgaagccctgtgtggtcagacgtttgccaagaaacaccaacttaagatgcacctgcttacgcactccagcagtcaaggacagagaccgttcaagtgccccttaggtggttgtggatggactttcactaccagttataagttaaagcggcatctgcaatctcatgacaaactcaggccattcggctgtccggcagagggatgcggaaaatcgttcactaccgtgtataaccttaaagcccatatgaaaggccacgagcaggagaattcatttaagtgcgaagtatgcgaggagagtttccctacacaagccaaactgggggcccaccagcggagtcacttcgaaccagagcgcccataccaatgcgccttctccggatgcaagaagaccttcataactgtgtccgctttattctcccataacagagctcacttccgggagcaggaacttttctcttgtagttttccgggctgcagtaagcaatacgataaggcgtgccgcctcaaaatccatctgcggagccatactggtgagcgaccttttctgtgcgatttcgacgggtgcggatggaacttcacatcaatgagcaagctgctgagacataaacgtaagcacgatgacgatagaagattcatgtgtccagtagaaggttgtgggaaatcttttactagagcagaacatctgaaaggacattctattactcatctcggcacaaaaccgttcgtatgcccggtggcgggttgttgcgctagattttccgctaggagtagcttgtacatccactcaaaaaagcacttgcaggacgttgacacttggaagagccgttgtcccatcagctcttgcaacaagcttttcacctcaaagcattctatgaagacacatatggtaaagcggcataaggtaggccaggatttactggcccagctagaagcggccaactcattgacaccctccagtgaacttacctcccagcgacaaaacgatttgtcagacgcagagattgtgtccctcttctccgacgtgcctgattcaacatccgctgcactgcttgacaccgccttggtgaacagtgggatcctgacaatcgacgtggcctctgtgtcttccaccctggctggccatctgcccgctaacaataataacagtgtgggccaggctgtggacccaccctcccttatggcaacatccgaccctccgcagagcctcgatacaagcctcttctttggaacagccgccaccggcttccaacagagcagtctgaacatggatgaagtgagcagtgtaagcgtgggccccctgggctcgctggatagtctcgcgatgaagaattcctctccagagccacaggctctcacgccgagtagcaaattaactgttgataccgacaccttgacaccaagctctaccctctgcgagaattctgtgagcgagctcctgacacccgcaaaagctgagtggagcgtgcatcccaactcggactttttcgggcaggagggggagacacagtttggtttcccaaacgctgccggaaatcacggcagccaaaaggagcgcaatttaatcacagtgacgggctcctccttcctggtatag

SEQ ID NO: 141761 - DNA, 2412 bp, Artificial Sequence
  Description of Artificial Sequence: Synthetic coding sequence
atggaaattccaaaactgttgcctgcacggggcacacttcaaggaggcggcggaggcggaataccagctggcggcgggagggtccaccgcgggccagactcaccagccggtcaggtccctactaggaggttgctgctgttacgcggtccacaggacggaggacccggaagacggcgcgaagaagcaagtacagccagcagaggccccggccctagccttctcgcgccccggactgaccagccgtccggtgggggggggggcggtggagatgattttttccttgtgctgttggatccagttggcggagacgtagaaacggcaggatcaggtcaggctgctggacccgtgcttcgcgaggaggcggaggaggggcctggccttcaagggggggagagcggggctaatcccgcaggacccactgccctgggcccccgatgtctgagcgcggtacccacccccgccccaattagtgcacccggaccagctgccgcctttgctggtacggtgaccattcacaaccaggacctgctcttgcgctttgaaaatggggttctaacccttgccacccccccaccgcacgcctgggaaccaggagcagcccccgctcagcagcccggatgcctgattgctccacaagcaggttttcctcacgctgcccatccaggcgactgtccagagctgccccctgacctgcttttggctgagcccgcagaaccagcgcccgcccctgctccagaagaagaagctgaaggccctgccgcggccctgggaccaagagggccactcgggagcgggccaggggttgtcctgtacctctgtcccgaagctcaatgtggacagacattcgctaagaagcatcaactgaaggtacatctcctgacccactcatcttctcaagggcagaggccatttaaatgtcccctgggcggttgtggatggacttttaccacatcttacaaactgaagagacacctgcaaagtcatgataagctgaggccttttggatgcccggcggaaggctgtggtaagtcgtttactaccgtgtacaatctcaaggctcacatgaaggggcatgaacaggagaacagctttaaatgcgaagtgtgtgaagagagcttcccaactcaggccaagctcagcgctcaccagagatcccactttgaaccggagcggccttaccaatgtgctttcagcggctgcaaaaagacttttatcacagtctccgccctcttttcccacaacagagcacatttccgcgaacaggaactgtttagttgcagcttcccggggtgttctaaacagtacgataaggcttgcaggcttaagatacatcttagatcacatactggagagaggccattcctttgtgactttgacggctgcggatggaactttaccagtatgtcaaaattactgcggcacaagcgcaagcacgatgacgatagacgtttcatgtgccccgtggaagggtgtggtaagtcctttactcgggccgaacacctgaagggacacagcattacgcacctgggaacaaagccgtttgtgtgccccgtggcaggctgttgcgcaagatttagcgccagaagtagcctgtatattcactcaaaaaagcacctacaggatgttgacacctggaaatcgcgctgtcctatcagttcatgtaataaattgttcacctcaaagcactcgatgaagacacacatggtgaagaggcacaaggtcggccaggaccttcttgcacagctggaggccgccaactctctgaccccttccagtgagctgacctcccagcgccaaaacgacctgagcgacgccgaaattgtctcgctattctcagacgttccggattcaaccagcgcagcactcctggataccgcactggtgaatagtggtattctgacaatagatgtagccagtgtctcctctactctggctgggcaccttcccgcgaacaataataattctgtggggcaggccgttgatccgccgtccctcatggccacgtccgatccaccacaatcgttagacacttccctgttctttggaactgcggccaccggctttcagcagtccagcttgaacatggacgaggtaagcagcgtgagtgtggggccgctggggtctctggactccctggccatgaaaaattcatcccccgaaccacaggctttgacaccttcctctaagttgacagtcgataccgacgccttgactcccagttccacgttgtgcgaaaactccgtgtccgagttgttaacacctacaaaggccgagtggaatgtccacccagacagcgacttctttggccaggagggcgaaacccagttcggctttcctaacgctgcaggcaatcatggaagtcagaaagaaaccgacctcattaccgtgactgggagctcgttcctggtgtag

SEQ ID NO: 141762 - DNA, 2622 bp, Artificial Sequence
  Description of Artificial Sequence: Synthetic coding sequence
atggcttccagacgcaaaagtacgactccatgtatggttctggccagcgagcaggacccagatctcgagctgattagcgacctagatgaagggccacctgtgctcaccccggttgaaaatacaagagcagagagtatatcctctgacgaggaggtccatgaaagcgtagatagtgacaatcagcaaaacaagaaagtggaaggcgggtatgagtgcaaatactgtacctttcaaacaccagatcttaacatgtttacatttcacgtcgactctgaacacccaaacgttgtattaaactcctcgtacgtgtgcgtcgagtgcaactttctcacaaaaagatacgacgcgctgtctgagcacaatctaaagtatcatcccggagaggagaattttaagctcaccatggtgaagcgtaacaatcagacaatctttgagcagactataaacgacctcacctttgacggaagttttgtgaaggaggaaaacgccgagcaggccgaaagtaccgaggtgagctcaagcggcatttccattagtaaaacccctattatgaagatgatgaaaaataaagtggagaacaaaagaatcgcggttcaccacaactctgttgaggatgtcccggaggaaaaggagaacgagatcaagcccgacagagaagaaatcgtagagaacccctcaagttctgccagcgaaagcaacacgtcaacatccatagtgaaccgcattcacccttcgacagccagcaccgtcgtaactcccgccgctgtgttgcctggcctggcacaggtcattaccgcggtgtctgcgcagcagaactctaacctgattccgaaagtgcttattcccgtaaatagcatccctacttataacgcggctcttgacaacaatcctctgctactgaatacctacaataagttcccatatccaacaatgtctgaaatcaccgtgctgtccgcccaagctaagtatactgaagagcaaataaaaatctggtttagcgcccagaggttaaaacatggagtgagttggacaccagaggaggttgaagaggctagacgaaagcagttcaacggcactgtacatacagtgccacaaacaatcactgttatacctacccatataagtaccggaagcaacggcctaccttcaatactccagacatgccaaattgtggggcagcctgggctagtgttgacacaggtagctgggacaaatacactcccagtcaccgccccaattgcattaacagttgcgggggtgccaagccagaataacattcaaaagtcacaggtaccagccgcgcagccgactgctgagacaaagcctgctaccgctgctgtgcccaccagccagagtgtaaagcatgagactgcccttgtcaacccggacagttttgggatcagagcgaaaaaaaccaaggagcaactggctgagttgaaggtgtcatacctgaagaatcagtttccacacgatagtgaaattatcagactcatgaaaattactggactcactaagggggagatcaaaaagtggtttagtgacacccggtataatcagcgcaacagcaaatctaaccagtgtctgcatctcaacaacgactcttcaaccaccattattattgattcctcagacgagacaaccgaaagtcctaccgtgggtactgctcaacccaaacagtcttggaatccattcccagactttaccccgcagaagttcaaagagaaaactgctgaacagctgcgcgtgctgcaagctagcttcctgaacagcagcgttctaaccgatgaggagctgaaccgactgcgtgcacaaaccaaactaacccgcagggagatcgacgcttggtttaccgaaaagaaaaagtctaaagctctgaaagaagagaagatggagattgacgaaagtaacgccggctcatccaaagaggaagccggagaaacatcacctgccgatgagtctggcgcgccgaaatccggctccaccggtaagatctgcaaaaagacccctgaacaactgcacatgctgaagtcagcattcgtgaggacacagtggccttcccccgaagagtatgacaaacttgccaaggagtccggtctggccaggacagacatcgtttcctggtttggcgatacaagatatgcatggaagaacgggaatttgaagtggtattactattaccagagtgctaactcctccagcatgaacggcctgagttccctgcggaagagaggccgcgggagacccaaaggacgcggccggggccgccctcgaggccgcccgcggggcagtaaacggatcaacaactgggaccgaggaccaagtttgataaagtttaagacaggtacagccatcctgaaggattattaccttaagcataagttccttaacgagcaggacctggatgagctagtgaacaagtcacatatgggctacgagcaggtcagggaatggtttgcagaaaggcagcgacgctcagagctcggcatcgaactctttgaggagaatgaagaagaagatgaggtgatcgacgaccaggaggaagacgaggaagaaaccgatgactctgatacatgggaacctccgcgccacgtgaaacgcaaattatcgaagagcgatgattag

SEQ ID NO: 141763 - DNA, 2622 bp, Artificial Sequence
  Description of Artificial Sequence: Synthetic coding sequence
atggcttcacgcaggaaatctactactccgtgtatggtattagcgagtgagcaggaccctgacctcgagctaatttctgatctcgatgaaggacctccagtcctgacccccgtagaaaatacgcgagccgagtcaataagtagcgatgaagaggtgcatgagtccgtggatagcgataaccagcaaaataagaaagtcgaggggggttacgaatgcaaatactgcacatttcagacaccagaccttaacatgtttacttttcatgtcgattccgagcaccccaatgtggtacttaattcaagctatgtatgtgtggagtgcaactttcttactaaacggtatgacgcgctcagcgagcataacttgaagtatcacccgggcgaagaaaattttaaacttactatggttaagcgaaataatcagacaatttttgagcagaccattaacgacctgacttttgacgggtcattcgtgaaggaggaaaacgccgagcaggctgagagcaccgaagtttcaagctccggtatttctatctctaagacccctattatgaagatgatgaagaacaaagtcgaaaataagaggatcgcagtccaccacaactccgttgaagatgtcccagaagaaaaagagaacgagattaaaccagaccgagaagaaattgtggaaaatcctagttccagtgcctcagaatcaaacacgtccacctctattgtgaaccgcatacatcccagtacagcttctacggtggttacccccgcagcagttttacctggtttagcgcaggtaattacagccgtgtccgctcagcagaatagcaatctgattccaaaggtgttgattccagtgaattctatccccacctataatgcagccctggacaataatcctcttctactaaacacctacaataagttcccgtaccccaccatgagcgaaatcacggtcttgtctgcccaggccaaatatacagaggagcagatcaagatatggttcagtgcgcaacggctgaagcatggggtgtcctggactccagaggaagtggaggaggccagacggaaacagttcaacgggacagtccataccgtgccccagactatcactgtgatccccacccacatctccacgggctccaatggcctaccatctatccttcagacatgtcagatagttgggcagccagggctggtgctgacccaggtcgctggtacaaacacactgcccgtcactgcacctattgccctcacggtggccggcgttccaagccagaataatatccagaaaagccaggtgcccgccgcacaacctactgccgaaacgaagcctgccacggcagctgtaccgactagtcaaagtgtgaaacacgagactgcacttgttaatcccgactcatttggcatccgtgcgaagaagaccaaggaacagctagctgaactcaaagtatcttacttaaagaatcagttcccacatgatagcgaaatcatccgcctgatgaaaatcacgggcctgaccaaaggggaaattaaaaaatggtttagtgatacacgttataaccaaaggaactccaaatccaatcagtgcttacacctgaataacgattccagcaccaccataataattgattcaagcgacgagacaaccgaatcccccactgttggcactgcccagcccaagcagagttggaaccccttcccagacttcacaccccagaaattcaaggaaaagacagccgagcagctgcgagtcctgcaggcgagctttcttaactcaagtgtgctgaccgatgaggagttgaaccggctgagagctcagaccaaactgacaaggcgagagattgacgcctggtttaccgagaagaagaagtccaaggccctgaaggaagagaagatggaaattgacgagtctaatgcggggagctctaaggaggaggccggagaaacaagccccgccgatgagtcgggagcccccaagtccggttctaccgggaagatttgcaagaagactcccgagcagctgcacatgttgaagtccgcatttgtgaggactcagtggcctagccccgaagagtacgacaagctggcaaaagagagcgggttggctaggaccgatatcgtgtcctggtttggcgataccagatatgcctggaaaaacggcaaccttaaatggtattattattatcagtctgcgaactcatcaagcatgaacggtctaagctctctgaggaagcggggccggggcagaccaaagggccgtggtaggggtcggcctcgggggcgccccagaggctccaagcggattaacaattgggatagaggccctagcctgatcaagttcaaaaccggtaccgctattttaaaagattactacctgaagcacaagtttttgaacgagcaagatctggacgagttggttaacaaaagtcacatggggtacgagcaagtgcgggagtggttcgctgaaagacagcggcgatcagaacttggtatcgaactgttcgaggaaaatgaggaggaggacgaagttatagatgaccaggaagaggacgaagaggagaccgatgatagcgacacatgggagcctccacgacatgtgaagcgaaagcttagcaaatccgatgactag

SEQ ID NO: 141764 - DNA, 2622 bp, Artificial Sequence
  Description of Artificial Sequence: Synthetic coding sequence
atggctagtcggcgaaagtccaccactccctgcatggtccttgcctcagagcaagaccccgatttggaactgattagcgatctggacgagggcccacccgtcctaacgcctgtggagaataccagggcggaatccatcagcagtgacgaagaagtccacgaaagtgttgattccgacaaccagcagaacaaaaaggtggaaggcggttacgaatgcaaatattgcacgtttcagacaccagaccttaatatgttcactttccacgtagatagtgaacaccccaatgtggtgctgaacagctcgtacgtctgtgtcgaatgtaactttctgaccaagcgctatgatgccttaagcgaacacaatctgaagtatcatcctggcgaggagaattttaaactgaccatggtgaaacgcaataatcaaactatcttcgagcagaccataaatgatctgacttttgacgggtcgttcgttaaagaggaaaatgcagaacaggcagaatccacggaagtgtcttcaagcggaatttctatatcaaagacccccattatgaaaatgatgaagaataaagtagagaacaagcggatcgccgtgcaccacaattccgttgaagatgttcctgaagaaaaagagaacgagataaaaccagatagggaggaaatcgtagaaaatcctagttcctccgcctcggaatctaatactagtacatcgatcgtgaatcgtattcacccctctacggcttccactgtggtgacccctgcggcagtgctccccggattggcacaggttattaccgcagtctctgcccagcagaactcaaacctgattcctaaagtgctgattccagttaattctattcctacttacaatgccgcgctcgacaacaaccccctactgttgaacacatacaacaagtttccctaccccacaatgtcagagattactgtgctgagcgcacaggcaaaatataccgaggagcagataaagatttggttttctgcgcaacgtttgaagcacggcgtctcctggacgccggaagaagttgaagaagcacgcaggaaacagttcaatggtactgtgcacaccgtcccccagaccatcacagtgattcctacacacattagcacaggcagcaacggactcccctcaattctacagacttgccagatcgtgggtcagcctggcctcgtattaacacaggttgccggtacaaacacactgcccgtgaccgctccaatcgctttgacagtcgccggtgttcccagtcagaacaatatccaaaagtctcaagttccagccgctcaacctaccgccgagaccaagccggccactgccgcagttccaacgagtcagtccgtgaagcatgagacagcactggtgaatcctgatagttttggcatacgggctaagaaaacaaaggaacagttggccgagctaaaagtgtcctatcttaagaaccagttcccccatgacagtgagatcattaggttgatgaaaatcacaggtctcaccaaaggggagattaagaaatggttctccgacacccggtacaaccagcggaatagtaagtcaaatcaatgcctacatctcaataacgactccagtaccactattataattgactcatcagacgaaacaaccgaaagccctactgtggggacagcccagccaaaacagtcgtggaatccgttccccgacttcaccccacagaagtttaaggaaaagaccgcagagcagctgagagtgttgcaggcctcttttctgaacagttccgtgctgactgacgaagaactgaatcgactgcgggcacagaccaagttaactcgtcgcgagattgatgcgtggtttacagagaagaagaagtccaaagccttaaaagaggagaaaatggaaattgacgaaagcaatgcgggttcctcaaaagaggaggcaggagaaacctcccccgccgacgaatcaggcgcccccaaaagcggctctactggcaaaatctgcaaaaagaccccagaacagctgcacatgctgaaatcagcttttgtccggactcaatggccttcccccgaggagtacgataaactcgcaaaagagagcggtttggctaggacagatattgtctcatggttcggcgatactcgttatgcttggaaaaacggcaatctaaagtggtactactactatcagagcgctaactcctctagcatgaatggactctctagcctgaggaaaagaggccggggcaggcccaagggacgcggtaggggcagaccacgaggtcgtccccggggttccaaacgcattaacaactgggataggggccctagcctgatcaaattcaaaactggaaccgctatactgaaagactattaccttaaacacaaattcctgaatgagcaggacctggacgagttagtgaacaaatctcatatggggtacgaacaagtgcgagaatggtttgctgagcgccagaggaggtcagaacttggaatcgagctctttgaagagaacgaagaagaagatgaggtaatagatgaccaggaagaggacgaggaagaaacggatgattcggacacctgggagcctcccagacacgttaagcggaagctgtctaagagcgacgattag

SEQ ID NO: 141765 - DNA, 1497 bp, Artificial Sequence
  Description of Artificial Sequence: Synthetic coding sequence
atggcaagcaaaagaaaatctacgacaccttgcatgattcccgttaaaacagtggtgctgcaggacgcttctatggaggcccaacctgccgagacgctaccggaaggcccccagcaggatctccctcctgaagccagtgctgccagctctgaggcagcacaaaacccctcttccaccgatgggtccacattggcaaatggccaccgttccacgttggacggctatctgtactcttgcaaatactgcgacttcagatcacatgacatgactcagttcgtgggacacatgaattccgaacacactgacttcaacaaagacccaacattcgtctgtagtggatgtagtttcttggccaagacgcccgaaggtctatctttacacaatgcaacctgtcacagcggggaagccagtttcgtatggaatgtggcaaagccggacaaccacgtagtggtagagcagtcgatcccggaatccacatccacccccgacttggcaggagagccaagtgccgagggtgctgacgggcaggccgaaattatcataacgaaaactcctatcatgaaaattatgaaaggcaaggccgaagcaaaaaagatccacacactgaaagaaaatgtcccctcacaacctgtgggagaagccttgcccaagctgtctacaggcgagatggaagtgagggagggagatcactcattcatcaacggggccgttcccgtgtcccaggcttccgcaagctccgcgaaaaatcctcacgccgccaatggaccactgataggaacggttccggtgttgccggctggaatcgcccagttcctttctcttcagcagcagcccccggtacacgctcagcaccacgtacatcagccattacctaccgcaaaggctctacccaaagtgatgatccctctgagttccataccaacatataatgctgccatggactccaatagtttcctgaagaactccttccacaaatttccctaccctactaaagctgagctttgctatcttactgtggtcaccaagtacccagaggagcagctgaagatctggtttactgcccagcggctaaagcagggtatcagctggagccccgaagaaattgaggacgctagaaaaaagatgttcaatacagtgatacagagcgtgccccaacctacgatcactgtgctgaacacacccttggtagcctcggcagggaatgtgcaacacttgatccaggcggccctgcccggacacgtggtgggtcagccagaagggaccggtggagggctcctcgtgacacagcctctgatggcgaacggcttacaggccactagtagcccactccctctgacagttaccagtgtgcccaagcaaccaggagtggcccctattaataccgtgtgcagcaacaccaccagcgctgtgaaagttgtcaatgctgcccagagccttctcacggcctgtccatctattacttctcaagcctttcttgatgcctctatctacaaatag

SEQ ID NO: 141766 - DNA, 291 bp, Artificial Sequence
  Description of Artificial Sequence: Synthetic coding sequence
atggcttccaagaggaagagtactactccgtgcatgattccagtcaagaccgtggtgctgcaggatgcgagcatggaggcacaacctgctgagaccctgcctgaaggcccccagcaagacctgcctccagaggcttctgccgcgagcagcgaagcggcgcagaacccatctagcacagacgggtcgacactcgcaaacggccaccgctcaaccctagacggctatctctactcctgcaagtactgcgatttcagatcacacgacatgactcagttcgttggacacatgtag

SEQ ID NO: 141767 - DNA, 2244 bp, Artificial Sequence
  Description of Artificial Sequence: Synthetic coding sequence
atggaggtgcgggagggagaccattccttcatcaacggggcggtcccagtgtcgcaggcctcagcatcctcagccaagaacccccacgctgcaaatggccctttgatcggaacagtgcctgtcctgccagctggcatcgctcaatttttatcactccaacaacagccgcctgtgcatgcccagcaccacgtgcatcaacctctccccaccgctaaagccttacctaaggtgatgattccgctgtccagtatacctacttacaacgccgcgatggattctaatagctttctcaaaaattcttttcacaagttcccatatcccacaaaggctgagctctgctacctgaccgttgtgaccaagtacccagaggaacagctaaagatttggttcactgctcagagactaaagcagggtatcagttggagcccagaggagatcgaagatgccaggaagaagatgttcaatacagtgatccagtcggttccacagccgacaatcactgtgctcaatacacctttggtagcatccgccggcaacgtgcagcacctcatccaggccgccctccctgggcatgtggtgggtcagcccgagggtaccggcggcggcctcttggtgacacaaccacttatggcaaacggcctccaggccacctcaagcccactgcctctcacagtgacaagtgttcccaagcagcctggggtcgctcccattaataccgtctgtagtaatacaaccagcgctgtgaaggtggtgaacgcggctcaatccctgctgacggcctgcccgtctattactagtcaagcttttctcgacgcttcaatttacaagaataagaaatcacacgaacagctgtctgcgctcaagggcagcttctgcagaaaccagttccctggtcaatcagaagtagagcacctgactaaggttacgggcctgtctacccgggaagtgcggaaatggtttagcgacagacgctaccactgcagaaacctgaagggaagtagggccatgattcccggtgaccatagctccatcatcattgactccgtaccggaagtgtcctttagcccatcaagtaaagtccccgaggtcacctgcatacccactactgccactttagcgacccacccctccgctaaacgccagtcctggcaccagactcccgattttacccctaccaaatacaaagagcgagcccctgaacagctgcgagcgctcgaatcctctttcgcgcaaaatcctctgcccctggatgaggagctcgacaggcttcgcagcgaaactaaaatgactagacgagagattgattcatggttcagcgagaggagaaaaaaggtgaacgccgaagagaccaaaaaggccgaggaaaacgcctcccaggaggaagaagaagccgctgaggacgaggggggtgaagaggacttggcctccgaactcagggtgagcggggagaacggtagccttgaaatgccctcatcacatattcttgccgagcgaaaagtgagccccataaagatcaacctgaagaacctcagagtgacagaggctaacggtcggaatgagatcccaggactaggcgcgtgtgaccctgaggacgacgagtccaacaagctggccgagcagctacctggtaaggtgtcatgtaagaaaactgctcagcagaggcaccttctccgacaattatttgtccagacccagtggccctccaatcaggactatgatagtatcatggcccaaaccgggctgccacgcccagaagtggtacgctggttcggggattccagatacgcactaaaaaacggccagctgaaatggtatgaagactataagagaggcaactttccccccggactccttgtgattgctcctggcaacagggagttgctgcaggattattacatgacgcataagatgctgtatgaagaagacctgcagaacctatgtgataaaacgcaaatgtcatcacagcaggtaaagcaatggttcgctgaaaaaatgggcgaagagacacgcgccgtggcagataccggtagtgaggaccagggtccgggcacaggagagttgactgccgtccacaagggcatgggcgatacttactcagaggtctctgagaattcggaatcatgggaaccccgtgtgcctgaagccagtagcgagcccttcgacacatccagccctcaggcaggtcgacagctcggcagctggtcactgtcatctcaaccactcccatctctgctaactctctag

SEQ ID NO: 141768 - DNA, 2871 bp, Artificial Sequence
  Description of Artificial Sequence: Synthetic coding sequence
atggccagtaagcgcaagagtactaccccatgcatgatccccgtcaaaaccgttgttctacaagatgccagcatggaggctcaacctgcagaaacactgcccgagggaccacagcaggatctcccacccgaggcaagcgcagcgagtagcgaggccgcccagaatccaagcagtactgacggaagcacactggctaatggccaccgcagtaccctggacggttatctttattcttgcaaatactgcgattttcggtctcacgatatgacacaatttgtaggtcacatgaatagtgaacacaccgatttcaataaggatcctactttcgtatgttcgggctgcagctttcttgcaaagacaccggaaggactgtcattgcataatgcaacatgccactcaggcgaggctagtttcgtctggaatgtcgctaagccggataatcatgtagtggtcgaacaatccatccctgagagcacctcaacaccggacctggccggggagccttcggctgaaggggccgacggccaggctgagattattatcacaaagacaccaatcatgaagatcatgaagggcaaagccgaggcaaaaaaaattcatacactcaaagaaaatgtgccatcccaaccggtcggggaggcattgcctaagcttagcaccggagaaatggaggttagagagggagaccattccttcattaacggcgctgtgcctgtgtcccaggcatctgcttcaagtgccaagaacccacacgctgctaatggccctctcattgggaccgtgcccgtcctgcccgccggcattgcccagtttctgtctcttcagcagcagccacccgtgcacgctcagcaccatgtgcaccagcccctgccaacagcgaaggctctgcccaaagtgatgattccgctgtctagcattcctacctataatgcagcaatggactctaacagttttctgaagaactcttttcacaagttcccataccccaccaaggccgaattgtgctatctgactgtcgtcactaagtatccagaggagcagttgaaaatatggttcacggcccagcggctgaagcagggcatcagttggtcccccgaagagattgaagacgcgaggaagaagatgttcaatactgtgatccaaagcgtcccacagccaaccatcaccgtgctcaatacaccactcgtcgccagcgccggaaacgtgcagcacctgatacaagccgccttgccaggtcacgttgttggccaacccgaaggtacaggtgggggtctgcttgtgacccagcccttgatggcaaacggcttgcaggccacgtcctcacccttacccctcactgtaacgtctgtcccaaaacagccaggagtggctccgattaacacggtgtgctcgaacacaacctcagccgtcaaggtggttaacgctgctcagagcttactcaccgcttgccctagcattacatcgcaggcctttctcgatgcttccatttataagaacaaaaaatctcacgaacagctgagcgctctgaagggcagtttttgtcggaatcagtttcccggacagtccgaggttgaacatctgactaaggttacaggcctatctacccgagaggtgcggaagtggttctccgaccgccgctaccattgcagaaacttgaaagggtccagggctatgattcctggcgaccattcatcgatcatcattgattcggtccccgaagtttcgttttcgccctcttccaaagtccccgaggtgacatgtatcccaacaaccgccactctagctactcatccatccgccaaaagacagtcctggcaccaaacaccagatttcacgccaactaaatacaaagagcgcgctccagaacagcttcgcgccttggaatccagttttgctcagaaccctctgcccctagacgaagagctcgacagactgcgatccgagaccaagatgacccgccgggagattgactcttggttttctgagcgaagaaagaaggttaacgccgaagaaacaaagaaagccgaggagaacgcctcacaggaagaggaagaggccgcagaagacgagggaggggaagaagatctggcctccgaactgcgcgtaagcggtgagaatggaagcctggagatgccctcctcccacatacttgcagaacggaaggtatctccgattaagattaacctgaaaaacctccgtgtaacagaggccaacggtcgtaacgaaatacccggccttggtgcatgtgaccccgaggacgatgagtccaacaagcttgctgagcagctcccaggtaaagtgtcttgcaaaaaaaccgctcaacagaggcatttgctccgacagttgtttgtgcagacgcagtggccctccaaccaggattatgattctatcatggctcaaactgggctgcctcgccccgaagtggttagatggtttggggactccaggtatgcattgaaaaacgggcagctgaagtggtatgaggactataagcgcggcaactttcctcctggcttactggtgatagctccaggaaatcgcgagcttctccaggattactacatgacacacaagatgttatatgaggaagacttacaaaacctttgtgataagacgcagatgtccagtcagcaagttaagcagtggtttgcagaaaagatgggagaagagactcgggctgtggccgatactgggtctgaggaccaaggcccaggtacaggagagttgactgcagtgcacaagggcatgggcgatacctactccgaggtgtccgaaaacagcgaatcctgggaacctcgagtgcctgaagcatcaagcgaacctttcgatacctcatcccctcaagctggccggcaactggaaacggattag

SEQ ID NO: 141769 - DNA, 141 bp, Artificial Sequence
  Description of Artificial Sequence: Synthetic coding sequence
atggcgtctaagagaaagagtacaacaccctgtatgatacctgttaaaacggtggtgctgcaggacgcgagcatggaggcccagcccgcagagaccttgcccgagggcccacagcaagatctgcccccagaagcctcatag

SEQ ID NO: 141770 - DNA, 1497 bp, Artificial Sequence
  Description of Artificial Sequence: Synthetic coding sequence
atggccagcaagaggaaaagcacaaccccttgcatgataccagtgaaaaccgtggtgctccaggacgcaagcatggaagcacagcccgcggagactctgcccgagggtccccagcaggatctaccgccggaggcaagtgcagcttctagtgaagccgcccagaatccaagctctacggacggaagtactctcgctaatggacaccggtctactttggatgggtatctgtatagttgcaagtattgtgattttagaagtcatgatatgactcagttcgtggggcacatgaatagcgaacatactgactttaacaaggatcccacttttgtgtgctcaggttgttcatttcttgctaagacacccgagggacttagcctgcacaatgcaacttgccacagcggggaggcgtcatttgtctggaacgtcgcaaagcctgacaaccacgtcgtggttgaacagtctatccccgaatcaaccagtacacctgatttggcaggagagcccagcgccgagggggctgatgggcaggccgagataatcatcaccaagacgccaatcatgaaaataatgaagggaaaagccgaagccaagaagatacatacactgaaggagaacgtaccatctcagccagtgggagaggcccttccgaagctgtccaccggagagatggaagtaagagaaggcgatcactccttcattaatggtgcggtgcccgtatctcaagcctcggcatccagtgccaagaatcctcacgccgcaaacggcccccttatcggcacagtgcctgttctgccggcgggaattgcacagtttctcagcttacagcagcagccccccgtccatgctcagcaccacgtacaccagcccctgcccactgcaaaggcactgcccaaggtaatgattccgctgagctcgataccaacttacaacgccgcgatggattccaattcgttcttgaagaactcttttcacaaattcccataccccactaaagcagaactgtgctatctgaccgtggtgacaaagtaccctgaggagcaactgaagatctggtttactgctcaaagactgaagcagggcatctcctggagccctgaagagattgaagatgctagaaagaagatgttcaataccgtaatccagagcgttcctcagccgacaataactgtgctcaacacacccctcgtggcatccgcaggtaacgtccagcacttgatccaagccgcactccccgggcacgtcgtgggccaaccagaggggactgggggcgggctgctggtaacccaaccacttatggccaatggcttgcaagcaacctcatcccctctgcctctgacagtaacatctgtgccaaagcagcccggggtggcgccaatcaacactgtatgtagtaatacaacttccgcagtgaaggtggttaacgccgcgcagtctttattgacggcatgcccttctatcacttctcaggcgtttttagacgctagcatctacaaatag

SEQ ID NO: 141771 - DNA, 147 bp, Artificial Sequence
  Description of Artificial Sequence: Synthetic coding sequence
atggcctccaagagaaaatcaaccaccccttgtatgattcccgttaagacagtggtgttgcaggatgccagtatggaggcacagccagcagagacccttcccgagggcccacagcaggacttgcccccagaggcatccgcggcctag

SEQ ID NO: 141772 - DNA, 273 bp, Artificial Sequence
  Description of Artificial Sequence: Synthetic coding sequence
atggctagcaaaagaaaatcaactacaccatgcatgattcctgtgaaaaccgtggtcctgcaggacgcctcaatggaagcccaaccagcagagacgctgccagaaggcccacagcaagacttgccacctgaggccagtgcagccagtagcgaagctgctcagaatccttccagcaccgatgggtctactttggccaatggacatcgttcaaccttggacggatacctctatagctgtaagtactgcgatttccggagccacgatatgacgtag

SEQ ID NO: 141773 - DNA, 357 bp, Artificial Sequence
  Description of Artificial Sequence: Synthetic coding sequence
atggcctctaaacgaaagagcacaacaccatgcatgatccccgttaagacggtcgtgctgcaagacgccagcatggaagctcagccagccgaaaccctgcctgagggtccgcagcaagacctgccaccagaggcgtcagcagcctcttccgaggccgctcagaatcctagcagcactgacggtagcactctggccaatgggcaccgtagcaccctggacggctatctctactcctgcaaatactgcgactttaggtcccacgacatgacccaatttgtggggcatatgaacagcgagcacaccgatttcaacaaggatcctacgtttgtgtgctccggttgctccttccttgcatag

SEQ ID NO: 141774 - DNA, 2871 bp, Artificial Sequence
  Description of Artificial Sequence: Synthetic coding sequence
atggccagtaagagaaaatctacaaccccctgtatgattccggtaaagacagttgtgctgcaggatgcatccatggaagctcaaccggccgagacactcccagaggggccacaacaggatctgcccccagaggccagtgcagcaagctccgaggcagcgcagaatccctctagcaccgatggctctacccttgcaaatgggcatcgctcgaccttagatggctacttgtactcttgcaaatactgtgacttccggtcacacgacatgactcaattcgtgggacatatgaacagcgaacatacagatttcaataaggaccccacctttgtgtgcagcggttgttccttcctagccaagacgcctgagggactgtccctacacaatgctacatgtcactccggcgaagcaagctttgtttggaatgtggcaaaacctgataaccacgtggtagtggaacagagcattccggagtccacctccacacccgatttagccggcgagccttccgccgaaggtgccgacggccaggccgagattattatcactaagacgccaattatgaaaatcatgaaggggaaagctgaggctaaaaaaatccacacacttaaggaaaacgtaccgtcacaaccggtgggagaggccttgccaaagctgtcaactggcgaaatggaggttcgcgagggagatcactcgttcattaatggggccgttcctgttagccaagcttcagcctctagcgccaagaatccccacgctgctaatggaccccttatcggtactgtgccagtgttacctgccggaatcgctcaattcctctcactgcaacagcagccacctgttcacgcacagcaccacgttcatcagccactcccgaccgcaaaagctctgccaaaagtgatgattcctctatctagcatcccgacgtacaatgcagctatggattctaactcattccttaagaactccttccacaagttcccttatccgacaaaggccgagttatgctacctgaccgtcgttaccaagtacccagaggagcagctgaaaatctggttcaccgctcagcgactcaagcagggaattagctggagtcctgaagagattgaggatgcccgcaaaaagatgtttaatacggtgatccaatccgtgccacagccaaccatcactgttctgaacacccctctagtcgcctcagccggaaacgtgcagcacctgattcaggcagcacttcctggccacgtggtaggtcagcctgaggggaccggcggtggccttttagtgacccagcctctgatggccaatgggctgcaagcaaccagcagcccactgccgcttactgtcacctctgtgccaaagcaaccaggtgtggccccaataaacactgtgtgcagcaatacaacctctgccgtcaaggttgtgaacgccgcccagtcactcctgactgcctgcccttctataaccagccaggcttttctggacgccagcatctataaaaacaagaaatcccacgagcagctttctgcacttaaaggttccttttgccggaaccaattcccagggcagtccgaagtagaacatttgaccaaagtgacgggactgtctacacgggaagtcaggaagtggttctctgacagacgctaccactgccgcaatcttaaaggctctcgcgctatgattcccggggaccatagcagtatcataattgactctgtccccgaggttagctttagccccagttcaaaggttcctgaggtgacttgcatcccgaccacagcaaccctggcaactcacccctccgcgaagaggcagtcttggcatcagacccccgatttcacacctacaaaatataaggaacgtgcaccagagcaactgcgcgctctagaaagctcattcgcccagaaccccttgccactggacgaagagctggatcgcctccgctcagagactaagatgacccgccgcgagatcgactcatggttcagtgaacgccgcaaaaaagtgaatgccgaggaaacaaaaaaagccgaggagaatgccagccaggaggaagaggaggcagcagaagatgaaggtggggaggaagacctggcatcagaactgcgtgtttccggtgaaaatggctccctggagatgccatccagtcacattcttgctgagaggaaagtctcgcctatcaagataaatctcaagaacttaagagtaaccgaggctaatggccgcaacgaaatccctggactgggagcatgtgatcctgaggatgacgagtctaacaagctggccgaacagctgcctggtaaagtgtcatgtaaaaagaccgcccagcagcgccatctgttaaggcagctgtttgttcagacacagtggccttctaatcaggactacgactcaattatggctcagaccggactccccagaccagaggtggtgagatggtttggggacagccggtacgctttgaaaaatgggcagctaaaatggtatgaagactacaaacgcggcaacttcccgccaggcctgctggtgattgcccctggcaatagggagctgctgcaagactattacatgacacacaaaatgctatatgaggaagatttgcagaacctgtgcgataagactcagatgtcgagccagcaagtaaaacaatggtttgctgagaagatgggcgaggagacccgcgcagtcgcagatacaggaagtgaagaccagggtcccgggactggcgagttgaccgcggtacacaagggcatgggtgacacttactccgaggtgtcagagaattctgagtcctgggagccaagggtgccagaagcctccagcgagccgttcgatacctccagcccacaggccgggcgacagttggagacagactag

SEQ ID NO: 141775 - DNA, 2910 bp, Artificial Sequence
  Description of Artificial Sequence: Synthetic coding sequence
atggcctctaagcgcaaatcaaccacaccgtgcatgattcccgtaaaaaccgtggtcctgcaggacgcctcgatggaggcacagcccgcagaaactcttccagaagggccacaacaagacctgccccccgaggctagcgccgcgtcctccgaggcagcccagaatccttccagtaccgatggtagcacacttgcaaatggacaccgctcaaccctcgatgggtacctgtatagctgcaagtactgcgacttccgcagccacgacatgacacagtttgtgggacatatgaacagcgaacatacggattttaacaaagaccctacctttgtatgtagcgggtgttctttcctggcgaaaacaccagagggcctttcacttcacaatgccacctgccacagcggggaggcaagcttcgtgtggaacgtggccaaaccggacaatcacgtcgtcgtggagcagtccatacctgagagcacatcgacacctgatctcgcaggcgaaccgagcgctgaaggagcagacggccaggctgagataattattacaaagacacccattatgaaaatcatgaagggaaaggcagaggccaaaaagattcataccctgaaggagaacgtgcccagccagccagtgggagaggccctgcccaagttatcaaccggtgagatggaggtgagggagggcgatcattcctttattaatggcgcggtgccagttagccaggcctcagcatcctctgctaaaaacccacacgctgcaaacggacccctcatcggcaccgtgcctgttttacctgccgggattgcacagttcctgtccttgcaacaacagcctcctgtgcatgcgcagcaccatgtgcaccagcctcttcccaccgcaaaggccttgccaaaagtgatgattcctctgagttcaatcccaacttacaatgcagcaatggacagcaactcctttcttaaaaactcgtttcataagttcccgtacccaacgaaagctgaactgtgctaccttactgttgttaccaagtaccctgaggagcagctaaaaatctggttcacagcccaaaggctcaaacagggaatctcatggtcccccgaggaaattgaggacgcacggaagaagatgtttaacacagtcatacagagcgtaccacagcctaccatcaccgtgttgaacacgcctcttgtcgccagcgccggtaatgtgcagcacctgattcaggcggctctgcccggccacgttgtgggccagccagaggggaccggtggcggcctgttagtcacccagcctctgatggcaaatggactccaggctacatccagccctctgcctttgacggttacctccgtcccaaagcagcctggcgtggccccaatcaacactgtgtgctccaatactactagcgccgtaaaggtggtcaacgctgcacagtccctgctgaccgcatgtcccagtattacatcccaggcttttctggatgctagtatttacaaaaataaaaagtctcatgagcagctaagcgctttgaaggggtctttctgccgcaatcagttcccaggccagtccgaggtggagcacctgactaaagttactggtctaagtacccgtgaagtgcgaaagtggttttcagataggaggtaccattgcagaaacctgaagggctcccgggcaatgatccctggcgatcattctagcataatcatcgattccgtgcccgaagtgtcgttctcgccgtcctccaaggtcccggaggtcacctgtatacccacaacagccacactggcgacacatccatccgccaaaagacaatcatggcatcagacccctgattttacacctacaaagtacaaggaacgagcacccgagcagctgagagcactcgagagctccttcgcccagaatccgttgccgctagatgaagagttggacaggctcaggagcgaaacgaagatgacccgaagagaaatagactcttggttcagtgaaaggaggaaaaaggtgaacgccgaggagaccaaaaaggctgaagagaatgcctctcaggaagaggaagaagctgctgaggacgaaggcggagaggaagatctggctagcgaattgagggtgtcgggggagaatgggagtcttgagatgccttctagccatattctggctgagcgtaaagtgtccccaatcaagatcaacctcaagaatctgagggtgaccgaggctaatggcaggaacgagatccccggacttggggcatgcgaccctgaagacgacgagtctaataagcttgccgaacagctgcccggcaaagtctcttgcaaaaagacagctcagcagcgccacctgctgaggcagctgtttgtgcaaacccagtggccaagtaatcaggactatgacagcatcatggcacagaccggcctgccgaggcccgaggtcgttcggtggttcggagattcaaggtatgctctcaagaatggtcagctcaagtggtacgaggattacaaaagggggaactttcctcccgggctgctcgtaattgcccctggaaacagggaactcctgcaggactactatatgactcataagatgctttacgaggaggacctgcagaacctctgtgataagacacagatgtccagccaacagaagcaaaccgaatttgacctgataaatgtgaaagactggcccgtgtgggagactgcttgccatgtagaggagcccaaccctacactgtgctgtcatatgcccttcccctgcccagcggccggtcatctcggcgagctgcccgagtcatcccaaacagcacagtcacttccgctgcccagtgcttgtcccccgccaagcaaacagcaggcccgttgggggtcacatcaattttttctgccacaatgccggacattcccacttccatccaatggttag

SEQ ID NO: 141776 - DNA, 948 bp, Artificial Sequence
  Description of Artificial Sequence: Synthetic coding sequence
atggccagcaagcgaaagtctacgactccctgcatgattccagttaaaacggttgttctgcaggacgctagtatggaagcacagcccgctgagacgcttcccgagggccctcagcaggatctgccccctgaagcttcagccgcctcatctgaagccgctcagaaccccagctcaactgacggatccacgcttgccaatggtcaccgcagcacgctcgacggctacctgtattcttgcaagtactgcgacttcagatcccacgacatgacacagtttgtcgggcacatgaactccgagcatacagacttcaacaaggaccctaccttcgtttgtagcggctgttcgtttctggctaaaacccccgagggactatctctgcacaacgccacgtgccactcaggtgaggccagctttgtgtggaatgtggccaaaccggataaccacgtcgtggtggagcagtcaatccccgagtctacttctactcccgatctcgcaggggaaccgagcgccgagggcgccgatgggcaagctgagattatcatcacaaagacccccatcatgaaaatcatgaaaggcaaggcagaggccaagaagatccacacattgaaagaaaatgtcccttcacagccggtgggggaagccttgcccaagcttagtaccggcgaaatggagaaacaaacagagtttgacctcattaacgtgaaagattggccggtgtgggaaactgcctgtcacgtcgaggagcccaacccgacgctgtgttgccatatgccgtttccttgccccgcagctgggcatctcggtgaactgcctgagtccagtcagacagcccagagtctcccattacccagtgcctgccctcctccgagcaaacaacaggctcggtggggaagccatcagttcttcctgcctcagtgtcgcacgttccctctgcctagcaacggttag

SEQ ID NO: 141777 - DNA, 501 bp, Artificial Sequence
  Description of Artificial Sequence: Synthetic coding sequence
atggctagcaagcgcaagtctactacaccgtgcatgatcccagtgaaaacagttgttttgcaagatgctagcatggaagctcagccagccgagacactgcccgaggggccacagcaagatcttcctcccgaagcatccgccgcctcttccgaagcagcccagaacccgagtagcacggacggttccactttggccaatgggcacaggtccactcttgacgggtatctgtactcctgcaaatattgcgattttagaagtcatgatatgacacagttcgtgggacatatgaatagcgagcacactgactttaacaaagaccccacgtttgtttgttccgggtgttccttcctcgcgaagactcctgagggccttagtctacacaacgcaacatgccactcgggggaggcctcctttgtctggaatgtggcgaagccagacaatcacgttgttgttgaacagtctatacctgagtcaacaagtacgccagacctcgcaggctag

SEQ ID NO: 141778 - DNA, 2871 bp, Artificial Sequence
  Description of Artificial Sequence: Synthetic coding sequence
atggcaagcaagagaaagtctaccaccccatgtatgattcccgtaaaaaccgttgttctgcaggatgcctctatggaggcccagcccgctgagaccctgccagaaggcccgcagcaggatctgccgccagaggcatcagctgctagctccgaagccgctcaaaatccaagcagcaccgatggctctaccctcgcaaatggtcaccggagtacccttgatggctacttgtactcctgtaaatactgcgacttcaggagtcacgatatgacacaatttgtaggtcacatgaactcagagcacaccgatttcaataaagacccaacatttgtttgctccgggtgttcctttctcgccaaaacccccgaagggcttagcctgcacaacgccacttgccattcaggagaagcttccttcgtgtggaacgtcgccaaacctgacaatcatgtggtggtagaacagagtatcccagaatctacttctaccccagatctggccggcgagccctccgctgagggcgctgacggtcaggcagaaattataattactaaaacgccaatcatgaagattatgaagggcaaagccgaggcaaaaaaaatccatactctgaaggaaaacgtaccttcacagccagttggagaggctctgccaaaattaagcacaggggaaatggaagtacgggagggagaccactcatttataaacggtgctgtgccagtgtctcaagcgtccgccagcagcgccaaaaacccacatgcagccaacggtccactgatcggtaccgtaccagtgctgcccgcaggcatcgctcaatttctgtcattgcagcagcaaccacctgtgcacgctcagcatcacgtgcatcaacccctgccaactgctaaagccctgcccaaagtgatgattccactgtcttccatcccaacgtataatgcggccatggactcaaattccttccttaaaaactcttttcataaattcccctacccaacaaaggctgagctgtgctatcttactgtggtgactaaatatcccgaggaacagctgaagatatggttcaccgcacagcgcctaaaacaggggattagctggagcccggaagaaatcgaggatgcgcggaaaaaaatgtttaacacagtcatccagagtgtgccacagcctacgattacagtgctaaacactcctctggtagcctctgccggaaacgtgcagcatcttattcaagcggctctgcccggacacgtcgttgggcagccagaggggaccggaggtggattactggtgacacagcccctgatggctaatgggctccaggccacatctagcccactgcctcttacggtgacaagtgttccaaaacaacccggcgtggctccaattaatactgtgtgctccaataccacttccgccgttaaggttgtgaatgccgcccagtctctcttgacagcctgtccttccatcacaagtcaagctttcttagacgcttctatttacaaaaacaaaaagtcacacgaacagttatcagcactcaagggtagcttttgtagaaatcagtttcccggacaatccgaggtcgagcatttaacaaaagtgactggcctgagtactagggaggtccgaaaatggttcagcgaccggcggtatcattgtcgcaacctgaagggcagtcgggccatgattcctggcgatcacagttctatcattatagattccgttccagaagtctcattctctccatcctccaaagtacccgaggtgacttgcatccccaccacagccaccctggccacccaccctagtgctaagcggcagtcttggcaccaaactcctgactttaccccgacgaaatacaaagagcgcgcacccgagcagcttcgtgccctcgaatcgtcatttgctcagaacccgcttccccttgatgaggagctcgacagacttcggagcgagaccaaaatgactaggcgcgagatagattcatggttttctgagcggcggaaaaaagtgaacgccgaggaaaccaagaaggcggaggaaaatgcctcacaggaggaggaggaagctgctgaagacgaggggggggaggaagacctggcatccgagttacgcgtgtcaggagaaaatgggagtctcgaaatgcccagcagtcatattttggcagaacgcaaggtgtcacccataaaaatcaatttaaagaatttgagagtaactgaggccaacggccgtaatgagattcccggccttggcgcatgtgatccagaagatgatgaatctaacaagctagctgagcagctgcctgggaaggtcagttgtaagaaaactgcacaacagcggcatctactccggcagctcttcgttcagacgcagtggccctccaatcaggactacgattctatcatggcacaaacgggactgccacgccccgaggtggtgagatggttcggcgattctcgttatgccctaaaaaatgggcagctcaagtggtacgaggattacaaacgagggaatttccctccaggacttctagttatcgcacctgggaaccgggagttacttcaagattactatatgactcacaaaatgctctatgaagaagatctccagaatctttgtgataagacccagatgtcaagccagcaggtgaaacagtggttcgcagagaaaatgggggaggagactagagcggtggcggacacaggcagtgaggaccagggtcctgggacaggtgaactaaccgccgtacataaaggaatgggcgacacgtactcagaagtgtccgagaattcagagtcctgggagccccgcgtgccagaagcatcatcagaacccttcgatacgtctagtccgcaagctgggcgccagcttgaaactgattag

SEQ ID NO: 141779 - DNA, 2871 bp, Artificial Sequence
  Description of Artificial Sequence: Synthetic coding sequence
atggcctcaaagcgtaaaagcacaactccgtgtatgatccccgtgaaaacagtggtgcttcaggatgctagcatggaagctcagcccgccgaaaccctaccagaaggtccccaacaggatttgccccctgaagcttcagcagcaagctctgaagccgcccagaatccttcaagcaccgatggctccactcttgcaaacggccacagatctactttagacgggtatctgtattcatgtaaatactgcgattttaggtcacatgacatgactcagttcgtgggccatatgaactcagaacacacggactttaacaaagaccccacttttgtttgcagcggctgttcatttttagccaaaacccctgaagggctgagcttacacaatgctacctgccactccggtgaagccagcttcgtgtggaatgtagcaaagcccgacaatcacgttgtggttgaacagagcattccggagagcaccagtacccctgatctcgctggagagcctagcgcagaaggagccgatggacaagctgagatcatcatcactaaaactccgatcatgaaaatcatgaaaggaaaagctgaagccaagaagatacatacgttgaaggaaaacgtccctagtcagccagtgggcgaagctttaccaaagctcagcactggcgagatggaagttcgcgagggcgatcatagctttattaacggagctgtccccgtgagccaggcatccgccagtagcgcaaagaatccacacgctgctaatggcccgcttatcgggacagtgcccgttcttcccgctgggatagcgcaattcctcagcctgcaacagcaaccccccgttcatgctcagcaccatgtccatcaaccattacctacagccaaggcactcccaaaagtcatgatcccgttaagctccattcccacctacaatgcagccatggatagtaattcttttctgaagaatagctttcataaatttccttatcccacaaaggccgaactctgttacctgaccgtcgtgactaaataccctgaggaacaattgaagatttggtttacggcccagcgcctgaagcaaggcattagttggagccctgaggagatcgaagacgcccgtaagaagatgttcaataccgtgattcagtctgtgcctcagccaactataacagtgctgaatacaccattggtggcgtcggcagggaacgtgcagcaccttattcaggcagcccttcctggccacgtagtgggacagcctgagggtacaggtggaggcctcctggttacacagccgttaatggccaacgggcttcaggcgacaagctctcccctgcccctgaccgtgacgagtgtcccaaagcagccaggggttgcgcccattaacacggtttgcagtaacacaacaagcgccgtgaaagtggtgaatgccgcacagagtttgctaaccgcgtgtccttcaattacaagtcaggcattcctagacgctagcatatataaaaataaaaaatcgcatgaacaactctctgccctgaaaggaagcttttgtaggaatcagtttcctggacaaagcgaagtggagcacttgacaaaagtgactggcctgagcaccagagaggtgaggaagtggttttccgaccgcaggtaccactgccggaatctgaaaggctcacgcgctatgatacccggcgaccactcttccataatcatcgacagtgtgcctgaggtttcgttttctccttcctccaaagtgcctgaggtgacctgcattcctactaccgctaccttggcaactcatccaagcgcaaagcggcagtcttggcatcagacgcccgactttactcccaccaagtacaaagaacgcgctccagaacagctgcgtgccttggagtccagcttcgctcaaaatccattgcctctcgatgaagagctcgacaggctgaggtcggaaacaaaaatgacccgccgtgaaattgattcatggttttctgaacgccgaaagaaagtcaacgctgaagagacaaaaaaagctgaggagaacgcctctcaggaagaagaggaggctgccgaggacgagggaggggaggaggacttggcctctgaacttcgtgtctccggcgagaatggctcactggaaatgccgagttcgcacatcttggctgaaagaaaagtgagccctatcaagatcaatttgaaaaatcttagagttaccgaagctaatgggcggaatgaaatcccaggattaggagcttgtgatccggaggacgatgagtctaataagttggccgaacagctgcccgggaaggtgtcttgtaaaaaaaccgctcaacagaggcaccttttaaggcagttattcgtccagacacagtggccctcaaatcaggactacgatagcattatggcacaaacaggcctgcctagacctgaagtggtaagatggtttggtgattctaggtacgctctcaagaatggacaacttaagtggtacgaagattataagagagggaacttcccacctggactgctggtgatcgcacctggaaacagagagctcctgcaggactactacatgacacataaaatgctctacgaggaagacctgcagaacctgtgtgacaagacacagatgtctagccagcaggtgaaacagtggtttgccgagaagatgggcgaggagacacgggctgtcgccgatacaggctcagaggatcaaggacctggaactggcgagttgaccgcggtgcacaagggcatgggagacacttattctgaggtaagtgaaaatagcgagtcttgggaacctagagtccctgaggcaagctccgagccattcgacactagttccccccaagctggtagacagctcgaaacagattag

SEQ ID NO: 141780 - DNA, 501 bp, Artificial Sequence
  Description of Artificial Sequence: Synthetic coding sequence
atggcatccaaacgtaagtccaccactccttgcatgatcccagtaaagacagttgttttacaggacgcctcgatggaagcccagcctgcagagactttgcctgaaggacctcaacaagacttgcctccggaagcctccgccgcttcgtccgaggcggcgcagaatccttcttccacagatggcagcactcttgccaacgggcatagatccacccttgacggatacttatactcttgcaagtattgcgacttcaggagccacgacatgacccagtttgtcggccacatgaactcagaacacaccgactttaataaggatcccaccttcgtgtgtagcgggtgctcattccttgccaaaacacctgagggcctcagtctgcacaacgctacatgccatagcggggaggcttctttcgtatggaacgttgcaaagcctgacaatcatgtggtcgtcgaacagagtattccggaaagcacaagcaccccagacctggcaggctag

SEQ ID NO: 141781 - DNA, 1428 bp, Artificial Sequence
  Description of Artificial Sequence: Synthetic coding sequence
atgggaatgtgggccagccttgacgcgctgtgggagatgcccgccgaaaagcgtatcttcggcgctgtcctcctcttctcctggacggtgtatctgtgggagaccttccttgctcagagacagagaagaatatataagacgaccacccacgtcccccctgagttgggccagattatggactccgaaaccttcgaaaagtcgcgcctgtatcaactggataagtccacattctcgttctggtcagggctctattcagagacggagggaacgctgattctcctcttcggcggaatcccatacctgtggcgcttgtcagggaggttctgtggttacgcaggctttggacccgagtatgagatcactcaatccctcgtctttcttctgctggccaccctcttttctgcactgacaggactgccctggagcttgtacaatacgttcgtgatcgaggagaagcatggcttcaatcagcagacgcttggattctttatgaaggatgccatcaagaagtttgtggttacacagtgtattctgctgcccgtttcctccctcctgctctacattatcaaaatcgggggtgattatttttttatctatgcttggctgtttaccctggtcgtttcgctggtgctggttaccatctacgccgattacatcgccccactattcgacaagttcacgcctctgcctgagggcaaactcaaggaggagattgaggtaatggccaagtcaatagacttcccgcttaccaaagtgtatgtagtggaaggctccaagaggagttctcattcaaacgcttacttctatgggttttttaagaataaaagaattgtactctttgacacactgcttgaggagtacagcgtgcttaataaggatatccaggaagactccggtatggaaccccgcaatgaagaagagggtaactctgaggaaattaaggccaaggttaaaaataagaaacaaggctgcaagaatgaggaagtcctggccgtgctcgggcacgagttgggccactggaaactcgggcacaccgtgaaaaacattatcattagtcagatgaactcatttctgtgcttcttcctgttcgctgttctgatcggcagaaaagaactctttgccgcgttcggtttctacgacagccagccgacattgattggtcttctgatcattttccaatttatcttctctccttacaacgaagtgctctccttctgcctgaccgtgctcagtagacgatttgaattccaggcggatgcttttgccaagaaactggggaaggcaaaggacttgtatagtgcacttatcaaactgaataaggataacctggggttccctgtgtcagattggctgttttcaatgtggcattactctcatcctcctctccttgagagactgcaggccttaaaaaccatgaaacagcattag

SEQ ID NO: 141782 - DNA, 1017 bp, Artificial Sequence
  Description of Artificial Sequence: Synthetic coding sequence
atgatgcggacctgcgttttgctgtccgcggtgttgtggtgcctcacaggcgttcagtgccctaggtttactctgttcaataaaaagggattcatttacggcaaaacaggccagccagacaagatctatgtagaacttcaccagaacagtccagtgctaatctgcatggactttaagttgtcgaagaaggagattgtcgacccgacatacttatggattggcccaaatgagaaaactctgactggcaacaacaggatcaacattacagagactggccagctaatggtcaaggattttctggagccactcagtggtctttacacctgcaccctgagctataagactgttaaagccgaaacccaggaggaaaagacggtgaaaaagaggtacgatttcatggtctttgcctacagagagccagactacagttatcagatggcagttcggttcaccaccagatcatgtattggccggtataacgatgtgttctttcgtgtcctgaagaagattctggattcattaatcagcgacttaagctgccatgttatagagccctcttacaagtgccattccgttgaaatccctgagcatggcctcatccatgagttgtttattgcattccaggttaatccctttgctcccggctggaaaggcgcttgtaatggttccgttgactgtgaggataccacaaaccataacatcctgcaggcgcgggatagaattgaagacttttttcgcagccaggcctatatattttatcacaactttaacaagaccttgccagccatgcacttcgtggatcattcactccaagtggtgcgtctggattcctgcagacctgggtttggcaagaatgaacgactgcattcgaactgcgccagctgttgcgtagtgtgctctccggccacattcagcccagacgtgaacgtaacctgccagacttgtgttagcgtcttaacatatggcgctaaaagctgtccgcagactagcaataaaaatcagcagtacgaggattag

SEQ ID NO: 141783 - DNA, 951 bp, Artificial Sequence
  Description of Artificial Sequence: Synthetic coding sequence
atgatgcgcacatgtgtgctcctctctgccgtcctctggtgtctgacgggggataagatatatgtggaactgcaccagaattcgcccgtgcttatctgtatggacttcaagttgagtaagaaggagatcgtggacccgacttatctatggatagggcccaacgaaaaaacactgaccgggaataacagaatcaacattactgagaccgggcagttgatggttaaagactttctcgagccactgtctgggctctacacgtgcacactgtcttacaaaacggtaaaggcggagacccaagaggaaaagaccgtcaagaaacggtatgatttcatggttttcgcgtatagggaacctgactatagctaccagatggcagtcaggttcaccacacggtcctgtatcggacgctacaacgacgttttttttcgcgtcctgaagaagattctggacagccttatttcggatctgagctgtcatgtgatcgagccttcatataagtgtcatagcgtggagattccagaacacgggctcatacacgagctattcattgcgttccaggtgaacccttttgctccaggctggaaaggagcctgtaatgggagcgtggactgtgaggacaccacaaatcacaatatccttcaggctcgcgaccggatagaagacttttttcgctctcaggcctatatattctaccacaatttcaataagactctacctgcgatgcacttcgttgatcattcgctgcaggttgtgagactggattcctgtcgccccgggttcgggaagaatgaacggctgcacagcaattgcgcaagctgttgtgtggtatgcagcccggctaccttcagccctgacgttaatgtcacctgccaaacctgtgtgtccgtcctcacctatggcgcaaaatcctgcccacagacatccaataagaaccagcagtacgaagactag

SEQ ID NO: 141784 - DNA, 1917 bp, Artificial Sequence
  Description of Artificial Sequence: Synthetic coding sequence
atggccggaggttctgctaccacctgggggtatccagtggcgctgctgttgctggtagctaccctgggcctgggcaggtggctgcaacccgatcctgggttacccgggttaaggcactcctacgattgtggcattaagggcatgcagttgcttgtctttcctagaccagggcagaccttgcgtttcaaggtggtcgatgagtttggtaacaggttcgatgtcaataattgtagcatatgttatcattgggttacttctcggccacaggaaccagccgttttttccgctgattacaggggttgtcacgtgcttgaaaaagacgggcgcttccatttaagagtttttatggaggccgtgctgccaaacggtcgggttgacgttgctcaggatgcaaccttgatctgccccaaacccgacccctcaagaacactggattctcagctcgcacctccggctatgtttagtgtttctactccgcagaccttgagctttcttccaacatccggtcataccagccaagggtcaggccacgcttttccttcgcccctcgatcccggacacagctcagtgcatccaacacccgcgctcccatccccaggcccagggccaaccctcgccaccctggcgcaacctcactggggcactctcgagcattgggacgtaaataaacgagattatattggtactcatctctcacaggaacagtgccaggtggcttccggacacttaccatgcatcgtgagacggacatccaaggaggcctgtcaacaggccgggtgctgttacgacaataccagggaggtcccttgctattacggaaacactgccacagtccagtgcttcagggacggctactttgtgctcgttgtgtcccaggagatggctctgacgcaccggatcactctggccaatatccatctggcttacgcccctacatcttgttcgcctacacagcacactgaggcattcgtcgttttctattttccgttgacccactgcggtacaactatgcaggttgctggggaccagctcatttacgagaactggcttgtgtcggggattcacattcaaaagggacctcaagggagcataacaagagactcaacattccagttgcatgttcggtgtgtgtttaacgccagcgatttcttgccaatccaagcctccatctttcctccaccaagccctgcacccatgacccagcctggccctctccggctcgagctgaggatcgctaaggatgagactttctccagttactacggcgaagatgactaccccatcgtgcgcctccttagagagccagttcacgtggaagtgagactgcttcagaggactgaccccaatctggtcttgctcctgcaccagtgctggggcgctccatcggccaacccatttcagcaacctcagtggcccatcctaagtgacggctgcccttttaaaggggatagctaccggacacagatggtcgcactggatggagctactccatttcaaagtcactatcagcgctttaccgtcgccaccttcgccctgctcgattccggtagccagcgagccttacgcggtttggtgtacttgttttgctccacatccgcctgtcatacatccggcctggaaacctgctccactgcatgttcgactggaactaccaggcaacggaggtcttctggccatagaaacgatactgctcggccacaggacattgtttcatccccgggtcctgttggttttgaggatagttatggacaggaacccacacttgggccgaccgatagcaacggaaattccagcctgagaccccttctgtgggccgtgttattactgcccgccgtggccctggtgctcggcttcggcgtgttcgtcggtttaagccagacttgggcacaaaagctctgggagagtaataggcagtag

SEQ ID NO: 141785 - DNA, 993 bp, Artificial Sequence
  Description of Artificial Sequence: Synthetic coding sequence
atggcccttacacacagaattactctggctaacattcacctggcgtacgcccccacttcttgctcccccactcagcacactgaggccttcgtggttttctacttcccactcacacactgtggcaccacaatgcaggtggctggcgaccagttgatttacgaaaactggctcgtcagcgggatccatattcagaaaggccctcagggatctattactagagacagcacatttcagctacacgtgcggtgtgtgttcaatgcgtctgattttctccccatccaagccagcatcttccctccgccaagccccgcccctatgacccagcctggccctctgcggttggagctgcgtatcgctaaggacgagacatttagcagctattacggagaagatgactatcccattgtacggctgctgcgggaacccgtccatgtggaagttcgccttcttcagagaaccgacccaaatctggtgctgcttctgcatcagtgctggggcgcgccaagcgcaaatcccttccagcaaccgcagtggcccatcctgtcagacggctgccctttcaaaggggattcatatcgcactcaaatggtggccttggacggagccacccccttccagtcccactatcagcggtttacagtggctacctttgctctgctggattcagggagccaacgcgctctgcggggcttggtgtacttattttgttctaccagcgcctgccacacgtcagggctggagacctgttctactgcctgctcaacagggacaactagacagaggcgatccagcggtcaccggaatgacaccgctcgcccgcaggatatcgtatcctcacccggcccagtggggtttgaggactcgtacggccaggagccaaccttaggtcctacggacagcaatggcaactccagcctgagaccactgctttgggccgtgctcctgctgcccgcggtcgctctagtgctgggatttggcgtgtttgtagcctag

SEQ ID NO: 141786 - DNA, 1317 bp, Artificial Sequence
  Description of Artificial Sequence: Synthetic coding sequence
atgggcagagtggaagacggaggcactaccgaagagctcgaggattgggaccccgggacctccgccctccccgcaccaggcattaagcagggccctagggagcaaaccggcactggccccctatcacagaaatgttgggaacccgagcctgatgcccccagtcagcctgggcccgccctgtggagtagaggccgtgccaggacacaggctttagccggtggctcttctctgcagcagctagatccagaaaataccgggtttatcggagccgacacctttaccggactcgtgcattcccatgagctcccgttggatccggcaaaactggacatgctcgtggctttagcacagagcaacgagcaggggcaggtatgttatcaagagctggtcgacctgatcagctcaaagcgcagctcatctttcaaacgggctatcgcaaacggccaaagggccctgcctagagatggtccccttgatgagccaggcttgggagtgtacaagaggtttgtaaggtacgtcgcgtatgagattctcccatgcgaagtcgatcgaaggtggtatttctataggcaccgtagctgcccgccaccagtgtttatggcgagcgtcactcttgcccagatcattgtgttcctgtgctatggggctagactcaacaaatgggttctgcagacttatcatccagaatatatgaagtcaccccttgtgtaccatcccgggcatcgagctagagcctggcgctttcttacatacatgttcatgcacgtagggctggaacaactcgggttcaacgcactccttcagctgatgataggagtaccactggagatggttcatgggctcctgagaatttccctgttgtatctcgcaggtgtcctggccggttcactcaccgtaagcatcactgatatgagggcccccgtggtgggcggctcgggaggggtctacgccttgtgcagcgctcacttagcaaacgtggtgatgaactgggcaggcatgcgctgtccatataaacttctgcgaatggtcctcgctcttgtgtgcatgtctagtgaagtcggccgggctgtgtggctgcgattctctcctcctcttcctgcttccggaccgcaaccctcctttatggcacacctggcaggggccgttgtcggagtctccatgggtcttacgatactgaggtcctatgaagaacgcttgcgggaccagtgcgggtggtgggtggtgctccttgcctacggaacattcctcctgttcgccgtgttttggaacgtcttcgcttatgacttgctaggtgctcatattcccccacccccatag

SEQ ID NO: 141787 - DNA, 1122 bp, Artificial Sequence
  Description of Artificial Sequence: Synthetic coding sequence
atggtgatggtctcaaaagatctgtttggaacaggaaagttgatccgcgcagcggatctaaccctaggtcccgaggcgtgcgagcccttggtgtccatggacacagaagacgtcgtacgattcgaggtggggctgcatgagtgcggcaacagtatgcaggtcaccgatgacgccttagtctactccaccttcttactgcacgatcctcggcccgttggcaatttgtccattgtcaggaccaatagagctgagatacccatcgagtgcaggtatccacgccaagggaacgtcagctcacaggccattcttcccacgtggctgccgtttcgcaccaccgtgtttagcgaagaaaaactgacgttctcgctgagattgatggaggaaaactggaacgctgaaaagagatcccccacgttccacctgggtgacgccgcacatctgcaggcagaaatccatactggctctcatgtgccgctgcgtctgtttgtcgaccactgcgttgctacgcctacccctgaccagaacgctagtccctaccacaccatcgtcgatttccatggctgtctcgttgatggcctcactgacgcctcttccgcattcaaggtcccacgaccaggaccggataccctgcaatttacagtcgatgtctttcattttgccaatgactctcgaaatatgatctacatcacgtgccacctgaaagtcacgctagctgagcaggacccagacgaactgaataaagcctgttctttttcgaagccttctaatagctggttcccagtcgagggtagcgccgacatatgccagtgctgtaataaaggcgactgtggtacccctagccattcccggcgacagccacacgtcatgagccagtggagtcggagtgccagtcgcaatcggcggcacgtgacagaggaagccgatgtgaccgtcggccccttgatttttcttgaccgccggggggatcatgaagtggagcaatgggcgctaccttctgacacctccgtggtgcttctgggtgtgggcctggcggtggtcgtgagtctgacactcacagcagtaattctcgtgctgacgagacgctgcagaaccgctagtcacccggtctccgcgtccgaatag

SEQ ID NO: 141788 - DNA, 1275 bp, Artificial Sequence
  Description of Artificial Sequence: Synthetic coding sequence
atggagctgtcatacagattgtttatctgcctgttgctgtggggcagcaccgagttatgctatccacaacccctctggctccttcagggcggtgctagtcatcctgaaacttccgttcagcccgtccttgtggagtgccaggaagccacactgatggttatggtttccaaggacttgttcgggacaggaaagctcataagggctgccgatctcaccttaggaccagaggcctgtgagccacttgtgtctatggacacagaggacgtggtcaggtttgaggtcggactccacgaatgcggaaactccatgcaggtcaccgatgacgcccttgtatacagcacttttctcctgcacgacccaagaccagtgggtaacttaagcattgtaagaacgaacagagccgagattcctattgagtgtagatatccccggcaggggaatgtgtcatctcaagctatccttccgacatggctgccttttcgcaccacagtctttagcgaagagaaattaaccttcagtctgcgcctgatggaggagaattggaacgccgagaaaagatctccaacctttcatctgggagacgctgctcacttgcaggctgagatccacactggatcccatgtccctctcaggcttttcgttgaccactgtgtggcaacacctacccctgaccagaacgccagcccctaccacactatcgtcgacttccacgggtgcctggttgacggcctgacagatgccagctctgccttcaaggttcctagacctggcccggataccctccagttcacagtagacgtgtttcactttgcaaatgactcccggaatatgatttatatcacctgtcatctaaaagtgaccctcgctgaacaagacccggacgaacttaacaaagcgtgtagtttcagcaagccatctaatagttggtttcccgtggaaggctccgcagatatttgtcagtgttgtaataaaggggattgcgggacgccttcccattctcgccggcagccccatgtcatgagtcagtggtcgagaagtgcctccagaaatcgaaggcatgtcaccgaagaagctgacgtgactgtgggtccactgatcttcctagatcggcgcggggaccacgaggtggaacagtgggctcttccctctgacacatccgtggtactactgggtgtggggctagcagtggtggtcagtctcaccctcaccgccgtcatactcgtgctaacccggagatgtcgaaccgcatcacaccctgtttccgcaagcgagtag

SEQ ID NO: 141789 - DNA, 1116 bp, Artificial Sequence
  Description of Artificial Sequence: Synthetic coding sequence
atggaactcagttacaggttgtttatctgcctccttctctggggcagtacagagttatgctatccgcagcctctgtggctcctccaaggaggagcctcccatcctgaaacctccgtacaacccgtgctggtggagtgtcaggaggccaccctgatggtgatggttagcaaggacctgtttgggacagggaagctcattcgcgctgccgatctaaccctagggccagaggcctgcgaacccctggtatccatggatactgaggacgtggtccgttttgaggttggtctgcacgaatgcggcaatagcatgcaggtgacagacgatgcgctagtgtattctacctttttgctgcacgatccaagacctgtggggaatctgtcgatcgtgagaacgaatcgagccgagattcccattgagtgcagataccccagacaaggaaacgtctcaagtcaggccattctccccacctggctgccctttaggaccacagtgttttcagaggagaagctcacattttctcttaggctcatggaggaaaactggaatgcagagaagaggtcccctacatttcacctcggcgatgctgcccatctgcaagcagaaatacataccgggagccacgttcccttgcggttgtttgtggaccattgcgtcgccactcccactcctgatcagaatgcttccccataccacacgatcgtggactttcacgggtgcctggtagatgggttgacggacgctagcagtgcatttaaggtaccccgtcccgggccagacacgctgcaattcaccgtcgatgtatttcattttgccaacgacagtcggaacatgatttatattacctgtcacttaaaggtgacactggcagagcaggatcccgacgaactaaataaggcttgctcattcagcaagccaagtaactcctggtttccagtagaggggagtgcggatatctgccagtgttgtaataagggtgactgcggcaccccgtcccacagccgtcgtcagccacacgtgatgtcccagtggagtcgatcagcctccagaaacagacggcatgtcaccgaggaagccgatgttaccgtcggcaccgacctgcccggccaagaaggctag

SEQ ID NO: 141790 - DNA, 1623 bp, Artificial Sequence
  Description of Artificial Sequence: Synthetic coding sequence
atgtggctgctcaggtgtgtcttactgtgtgtgtcactgagtctagctgtgagtggccagcacaaacctgaggctccagattacagttctgtcttacattgtggcccttggtcttttcagttcgctgtgaatctgaatcaggaggctacctcaccccccgtactgattgcctgggataaccagggactgctgcacgaacttcagaacgacagcgattgtggaacatggatcaggaagggccccgggagttcagtggtgctggaagcgacctactcctcctgctacgtcacagagtgggacagccactacataatgccagtgggtgtcgagggtgccggtgccgcagaacacaaagtagtgactgagcgtaagctgctgaaatgtcccatggatcttctagctagagatgctcccgataccgactggtgcgactccatacctgctcgcgatcggctgccttgcgcaccatctcccatcagcagaggcgactgcgaggggctgggttgctgctattcttctgaagaggtcaacagttgttattatggaaataccgtgaccctgcactgtacaagagaagggcacttctccatcgccgtctctcgcaatgtgacctcccctcccctgctcttggactccgtacgcttagccctgcgtaacgattctgcttgcaatccggtgatggctacacaggctttcgtcctgttccagtttccatttacctcatgtggtaccacccggcagataaccggcgatagagctgtctatgagaatgaactcgtggctacacgagatgtcaagaatggttcccgtggctccgtcacacgagacagtatctttcgcctccatgtgtcctgcagctattccgtgtctagcaacagtctgcccatcaacgtccaggtgttcacacttccgcctcctttccctgagactcagcctgggccattaacactcgagttacagatcgctaaggataaaaattatggcagttactatggcgtaggggattatcctgtggttaagctcctgagggacccaatctatgtcgaagtcagcatactgcaccggactgatccctacctgggactgttacttcagcagtgttgggccacaccatcaaccgatcctttgtctcagcctcagtggcctatcctggtaaaaggatgtccctatataggagacaactatcagacccagttgattcctgtccagaaggcactggatctgcccttccccagccatcatcagcgctttagcatctttacctttagctttgtcaatcccacagtggaaaaacaagcgttacgagggccagtgcatcttcactgcagcgtatccgtgtgtcagcctgccgagacacctagttgtgtcgtcacttgtccggatctgtcaagacggagaaattttgataacagtagccagaatactaccgcttcagtctcctctaaggggcccatgatcctgttacaagcaaccaaggaccctcctgaaaagctgagagtcccagtcgactccaaggtgctttgggtagccgggctgagtgggaccctaatcctcggtgccttattagtgtcatacttggccgtcaaaaagcagaaaagctgcccagatcagatgtgtcagtag

SEQ ID NO: 141791 - DNA, 2340 bp, Artificial Sequence
  Description of Artificial Sequence: Synthetic coding sequence
atggcctccttcgttaccgaagtgctggcccattccggtcggcttgagaaagaagatctgggcacccgtatctcccgcctcacgaggcgtgtggaagagataaagggcgaagtgtgtaatatgatctctaaaaaatatagtgagttcttgccatcaatgcagtctgcacaaggattaatcactcaggttgacaaattgtctgaagacatcgacctgcttaagtctagaattgagtcagaagtaaggagagacctccatgttagcaccggagaattcactgatctcaaacaacaacttgagcgcgattctgtcgttctgagtcttctgaagcagctgcaagagttcagcacagctatcgaagagtacaactgcgctctgacagaaaaaaagtacgtgacaggggcccagcgcctggaagaggcccagaagtgtctaaagcttttgaaatccaggaaatgcttcgatctgaaaattctgaagagtctatcaatggagctgactatacaaaagcagaacattctataccatttgggggaggagtggcaaaagctcatcgtttggaagttcccccccagtaaggacacatctagcctcgagtcttatctgcaaacagaactgcatctgtacacagaacagagtcacaaagaagagaagacccctatgcctcccatcagcagtgtattgttagcttttagcgtgctgggagagctccacagcaagctgaagtcttttgggcagatgctgctgaaatacatactcagacctctggcctcttgtccgtctctccacgcggtgatcgaaagccagcccaacatcgttattattcgattcgagtccatcatgaccaatttagagtacccaagtcctagtgaagtgttcacgaaaattaggctagtccttgaagtccttcagaagcaactgctagatctgcctctggacactgacctcgagaatgagaaaacctcaaccgtgcccctcgcagaaatgttaggcgacatgatctgggaggatctgtcagaatgcctgatcaagaactgtctggtttactcaattcctacaaactcctcgaagctgcagcaatatgaggagatcatccagagcaccgaggagtttgaaaacgccctgaaggaaatgagattcctgaagggagatactactgacctgctgaagtacgccagaaatatcaactcccactttgctaacaagaagtgccaagatgttatcgtggcggctagaaatctcatgaccagcgaaatccataacactgtaaagattatccctgattccaagatcaacgttccagagcttcccacacccgacgaagacaataaacttgaggtccagaaggtgagtaacacacagtatcacgaggtgatgaatttggagcccgaaaataccctcgatcagcacagcttttcactcccaacctgtcggatcagtgaatccgtgaagaagctcatggaactcgcctaccagacactgttggaggcaacaacctcctccgaccagtgcgccgtgcagttgttctactcggttcgcaatattttccatctgttccatgatgtggtcccaacttaccataaagaaaatctccagaagctgccacagctggccgctatccatcataacaactgtatgtacatagcccaccatctgctcacactgggccaccagttccggttgagactcgcaccaatcctatgtgatggaactgccacattcgtggacctggtgccaggattcagacgtttagggacggaatgctttttggctcagatgagagcccagaaaggggagttactcgagcggctgagctctgcacgaaacttctccaatatggacgatgaggaaaattattcagctgcctctaaagccgtgagacaggtcttacatcaattgaagagactggggatcgtgtggcaagatgtcctgcctgtgaatatctactgcaaggccatgggaacacttctgaacactgctatcagtgaagttataggaaagattaccgcattggaagatatcagtaccgaggacggcgaccggctgtactctttgtgtaagaccgtcatggacgaggggcctcaagtctttgcccctctatcggaggaatcgaagaataagaaataccaagaggaggttccggtttatgtgcctaagtggatgccattcaaagagctgatgatgatgttacaggcttcgctccaagaaatcggagatagatgggcggatggaaaggggcctcttgctgccgcattctcctccagcgaagtgaaggccctgattcgggcccttttccagaatacagaacgacgggcagccgccctcgctaagatcaaatag

SEQ ID NO: 141792 - DNA, 2019 bp, Artificial Sequence
  Description of Artificial Sequence: Synthetic coding sequence
atggccagcttcgtaacggaggtgctggcccactccggacgactagaaaaggaagatttgggtaccagaatttcacggctgacccgcagggttgaagaaatcaagggggaggtgtgtaatatgatctcaaaaaagtactcagaattccttccgagtatgcagtctgctcaaggcctgattacccaggtggataagctgagtgaagatatagatctgctcaagagccgaattgagtccgaggtccgcagggacctgcatgtgagcacaggcgagtttacagaccttaaacagcagttagaacgggatagtgttgtgctttccttgctcaaacagcttcaggagttcagcacagctatagaggaatacaactgtgcacttacagaaaagaagtatgtgactggcgcccaaagactagaagaggctcagaaatgtctcaaattgctgaaatcacgaaagtgtttcgatctgaagattctgaaatcactgagcatggagcttaccatccagaagcaaaatatcttgtatcacctgggagaagaatggcagaagctcatcgtatggaagttccccccttccaaggatacttcttcattggagagctacttacaaactgaacttcatctctacacagagcagtctcataaggaggagaaaacccctatgccacctataagcagtgtgctgcttgcctttagcgtgcttggcgagctgcacagcaagctcaagagtttcggccaaatgcttctgaaatatatcttacggcccttagctagctgtccgagcctgcacgcagttatcgaaagtcaaccaaatatcgtcatcataagattcgagagtattatgacaaatcttgagtacccttcacccagtgaagtgtttacaaagatccgtcttgtcctcgaagtgcttcaaaaacagcttctcgacctgccactagatactgatctggagaatgagaaaactagtaccgtgccactcgccgagatgctgggcgatatgatttgggaggatttaagcgagtgcctgattaaaaactgcctagtgtacagcatccctacaaacagcagcaagttacagcagtatgaagagattattcagagcacagaggagtttgaaaatgcgctgaaggaaatgcgcttcctcaaaggtgatacaacagacttattaaaatacgctcggaacataaactcccactttgctaataaaaaatgtcaagacgtcatcgtagcagcgcgaaacctaatgacaagcgagatccataacacagtcaaaattatcccggacagcaagattaacgttcctgagctcccaacaccagatgaggacaacaagctcgaggtccagaaggtcagcaacacccagtatcacgaggtgatgaacctggagcccgagaacactctcgatcagcactcctttagcctcccgacttgccgaatctcggagtctgttaagaagctgatggaattagcttaccagaccctcctcgaggccacaaccagctctgaccagtgcgcagttcagctgttttattcggtgaggaatatatttcatctgtttcatgatgtggttcccacataccacaaagagaacctgcagaaacttccccagctcgcggccatccaccataataattgtatgtatatcgcgcaccatttacttaccctgggtcatcagttccggctgcgtctggcaccaattttgtgtgatgggacagccacctttgtggatctggtgcccggttttcggcgcttaggaaccgagtgctttttggcgcagatgagagcccaaaaaggggagctgctggagcgacttagtagcgctcggaacttctcaaacatggacgatgaagagaattactccgcggccagcaaagccgtcaggcaagtcctgcatcagctcaagcgcctcggaatcgtgtggcaggacgtgcttccagttaatatctactgcaaagctatgggcacactcctgaacacggccatcagcgaagtcattggtaagatcacagccctagagtag

SEQ ID NO: 141793 - DNA, 1776 bp, Artificial Sequence
  Description of Artificial Sequence: Synthetic coding sequence
atgtgggaaaggctgaactgcgcagctgaggacttttacagtagacttctgcagaaattcaacgaggagaagaaggggattagaaaagatccattcctgtacgaagctgacgtacaagtccagttgatctctaaaggccagcccaacccccttaagaacattctcaatgagaacgatattgtttttattgtagaaaaagttcctcttgaaaaagaagaaacaagtcatatagaggagctccagtctgaagagactgcaatatccgatttctctactggtgagaatgtcggacccctcgctctgccggttggcaaggctcgacaattaatcggcttgtacacaatggcccacaatcccaacatgactcacctgaagattaatctgccagttacagccctgccccctctctgggtacggtgcgattcgagcgatcccgaggggacatgctggctgggcgccgagttgataacaaccaacaatagcattactggaatagtgttgtatgtggtgtcctgcaaggctgacaagaactactcagtgaacctagaaaatctgaaaaacttgcataagaagcgccatcatctgagtactgtgacaagcaaagggtttgcccagtatgagctatttaagagtagcgccttagatgataccattaccgctagccagacagcaatagccctagatatctcttggagccctgtggatgaaatcctccagattcctcctcttagtagcaccgctacactgaacattaaggtggagagtggcgagccaagaggtcccctgaatcacctatacagagaactaaagtttctgctggttcttgctgatggtctgcggactggggttacagaatggctggagccgctggaagcaaaatcggccgtcgagcttgtgcaggaatttctgaatgatctaaataagctggacgggttcggagactcgacgaaaaaggacaccgaggtggaaaccctgaaacacgacacagccgcagttgaccgctccgtgaaacgtttgttcaaggttcgcagcgacttagacttcgctgaacagctgtggtgcaaaatgtcgagtagcgtgatttcctatcaagacttagttaaatgcttcaccttgatcatccagagtctgcagcggggcgatatccagccatggctccacagtggctccaatagtctcctttctaagcttatacatcaatcataccacggcaccatggatacggttagcctctccggaaccataccagtgcagatgttgctagagatcggtttggacaagttgaagaaagactacatctcattcttcatcggccaagaactggcttccctcaatcacctcgagtacttcattgcacctagcgtggacattcaggaacaagtgtacagagtgcagaagctgcatcacatcctggagattctggtttcctgtatgcctttcattaaatcccaacacgaactgttgttcagcttgacacagatctgtattaagtattataagcagaaccccctggacgaacagcacatcttccagctgcccgtcaggcctacagcggttaaaaacctctatcaatccgagaagccacagaaatggcgcgttgagatctactctggtcaaaaaaagattaagaccgtttggcagttatccgattctagcccgatcgatcatttgaactttcacaagccagatttctccgaactcacgcttaacggaagcttggaagaacgcatttttttcacgaacatggtaacttgctcgcaagttcattttaaatag

SEQ ID NO: 141794 - DNA, 1434 bp, Artificial Sequence
  Description of Artificial Sequence: Synthetic coding sequence
atggctcacaatcctaacatgacacacctcaagatcaacctccccgtcacagccttacctcctttgtgggtgcgatgcgacagctcggacccggagggcacgtgttggttgggggccgagttgattactaccaataattctataaccgggatagttttgtatgttgtgtcatgcaaggccgacaaaaattattcggtgaacctcgagaacctgaagaacttgcacaagaagcgccaccatctttccactgtgaccagtaagggttttgctcaatacgaactgtttaagtcctctgctctggacgataccattaccgcatctcaaacagccattgctctggacatatcttggagccctgttgatgagatcctgcagattcccccgctgtcgtcaaccgctactctcaacatcaaagttgagtccggtgagccccgcggccctcttaaccatctctaccgggaattgaagttcctactcgtgctcgccgacggactgaggactggggtgacggagtggctggagccactggaagctaagagcgccgttgaactggtgcaggaattcttgaacgaccttaacaagctggacggtttcggggacagcaccaagaaggacaccgaagtcgaaacactgaaacacgacacagctgctgtggatagatcggtgaagcgtctcttcaaggtaaggtcagaccttgacttcgccgaacagctttggtgcaaaatgagctcatcggtcatatcctaccaggacttagtgaagtgttttactctcatcattcagtcactacagcgtggagatatccagccctggcttcactcggggagcaattccttgctgagcaaactaatccatcagtcttatcacgggacgatggataccgtcagcttatctgggaccatccccgtgcagatgctcctagaaattggcctggacaaactcaaaaaggattatatttcatttttcattggccaggagctggcctcactcaatcacctggagtattttatagcgccttcagttgacatacaagagcaagtctatagagtacagaaactgcaccatatcctggaaattctcgtcagctgtatgcctttcatcaagtctcagcatgaactactgttttcacttacccaaatctgcatcaaatattacaaacaaaaccctcttgacgagcaacatatctttcaacttcccgtccgccccactgcagtgaaaaacctttatcaatcagaaaagccacagaaatggagggtggaaatctatagcggacaaaaaaagatcaagaccgtctggcagctcagtgactcgagccctatagatcaccttaactttcataaaccagatttttccgaactgaccttaaacgggagccttgaggagcgcattttcttcaccaacatggtgacttgttctcaggtgcatttcaagtag

SEQ ID NO: 141795 - DNA, 1434 bp, Artificial Sequence
  Description of Artificial Sequence: Synthetic coding sequence
atggcccacaatcccaacatgacccacctcaagataaatctgccggtcacagccctcccacccctttgggtcaggtgtgatagttctgatcctgaagggacctgctggcttggcgcagagcttataacaacaaataactcaatcacagggattgtcttatacgtggtgagctgcaaggccgacaagaactacagtgtcaacttggagaatttaaaaaacttgcacaagaagcggcaccacctgagtaccgtcacgtccaagggattcgcccaatatgagctatttaagtcaagcgcactcgatgacaccatcacagccagtcagaccgccattgcgctggatatttcatggtcacccgtcgatgagatactacagatccccccactttcaagcactgctactctcaacatcaaagttgagtcaggtgaaccccgtggccccctgaatcacttatacagagaactgaaatttcttctggtgctggccgacggccttaggaccggagtgaccgaatggctcgagcctcttgaagcaaaatccgctgttgagcttgtgcaggagtttttgaacgacctgaataaactggatggatttggagattctaccaaaaaggacacagaagtggaaacgttaaaacacgatacagcagcagttgacaggagcgtcaagaggctgttcaaggtgagaagcgatttggacttcgccgaacagctgtggtgcaagatgagtagctcagtcatctcatatcaagatctagtgaaatgcttcactcttataatccagtccctgcagcggggagacattcagccctggctgcattctgggtctaacagtctcttaagtaaactgatccaccagagctatcacggtaccatggataccgtgagcctctccggcacgattcctgtgcaaatgctgcttgagatcggactcgataaattgaagaaagactacataagctttttcatcggccaggagctcgccagcttaaaccacctggaatactttattgctccatccgtagatattcaggaacaggtttatagggtgcagaagctgcaccacattttggagattctggtgtcttgcatgcccttcatcaagtcccagcatgaactgctcttcagcctgactcaaatatgcattaaatactacaaacagaaccctcttgatgagcagcatattttccagctgcccgtgcgccccacagccgtgaaaaatctctatcagtcggagaagccacagaagtggagagtggagatctactccgggcaaaagaagattaagacagtgtggcagctgagcgacagctccccaatagaccatcttaattttcacaagcctgacttttccgaactaacactcaacggctccctggaagagcgcatcttcttcactaacatggtgacctgctctcaggtgcactttaagtag

SEQ ID NO: 141796 - DNA, 1275 bp, Artificial Sequence
  Description of Artificial Sequence: Synthetic coding sequence
atggccgcactgggcgacgaagtacttgacggctacgtgttccctgcatgcccgccatgctcataccggtatccctatcccgccgctaccaaagggaaaggtgctgccgggggctcttggcagcagcgaggacggggctgtctccccgcaagctctccgtgtagcgcaggcgccgccagtctctcatttccaggttgcggacggctaaccgcagctgagtacttcgacagctaccagcgcgaacggctaatggccttactggctcaggtcggccccggacttggccctcgcgcgaggcgggccggaagctgtgacgtggctgtgcaggtttccccaagaattgacgccgccgtgcagtgttcactgggacgcaggacacttcaacgccgtgcacgcgaccccgagtcccccgctggaccaggcgccgaggggacaacaggtggtggaagtttttctcagcagccctctcgcagaggactggaacaaggatcgccacaaaacggagcaccccggcctatgcgatttccaagaacggttgccgtgtactctcctcttgctctgcggagactcactgcttttctggaggggcctggccctgccgcaggagaacagcgtagtggcgcctccgacggcgagcgcgggcctccacccgcccgactacagggcccggaggagggagaggtgtggacgaaaaaggcgcccagacggccacagagcgacgatgatggcgaagcccaggcggccgtgcgtgccagctgggagcaaccggccgacggacccgaactccctcctagggaagctcaggagggggaagcagctccgagaagtgccctgcgctctcccggtcagccccccagcgccggacgagcgagagacggaggcgacggacgggaagccgccgttgcaggagaggggccctcacccagaagcccggagctggggaaggagcggttacggtttcagttcctagaacagaagtacgggtattaccactgcaaagattgcaacattcgctgggagtctgcttacgtctggtgcgttcagggcaccaacaaggtctacttcaagcaattctgcaggacttgccaaaagtcctacaatccctaccgcgtggaggacattacgtgtcagagttgcaaacagacaaggtgttcctgtcctgtgaaactccggcacgtggacccaaagagaccacatcggcaggacctgtgcggtcggtgcaaagggaaacggttgtcctgcgattccacttttagtttcaagtatatcatatag

SEQ ID NO: 141797 - DNA, 1719 bp, Artificial Sequence
  Description of Artificial Sequence: Synthetic coding sequence
atggccgctccgcgcccgagccctgcaatctcagtaagtgtgtccgcaccagctttctatgccccccagaagaaattcggtcccgtcgtggcacccaagcctaaggtcaatccctttaggcctggcgatagcgagccccccccggcaccaggcgctcagcgagctcagatgggccgcgtgggagagatccccccaccgccccccgaggacttcccccttccaccgcccccactggctggagatggagacgatgcagaaggcgctctcggtggcgctttccccccccctcctccacctatagaggaatccttccctcctgcccccctggaagaagagatcttccctagtcctcccccccctcccgaggaagagggagggcctgaggcacctattccccctcccccacaacctcgcgagaaggtgtctagcatcgatctggaaattgacagcctatcgtctttgcttgatgatatgacgaaaaacgatccttttaaggcacgggtgagctccggctacgttccaccacccgtcgccactccctttagttccaagagttccaccaaacctgccgcggggggcaccgccccgttacccccctggaaaagtccctctagttctcagccgctgccccaggtacctgcccccgcccaaagccaaacgcagttccacgtgcaacctcaaccgcagccaaagcctcaggtgcaactgcacgtccagtcccagacgcagccggtaagtctcgctaacacacagccccgtggacctcccgcctcctctcccgcaccggcccctaagttcagcccagtaactccgaaatttacacccgtggcttcaaagttctcacccggagcccccggggggtcaggaagccagcctaatcagaagcttggccaccctgaagcattgagcgccggcacaggctcccctcagccccccagcttcacttacgcccagcagagggagaagcctcgcgtgcaggagaagcagcatccggtgcctccaccggcgcagaatcagaatcaggtccgaagccccggagcccctggtccgctgaccttgaaagaagtcgaagaattggagcagctcacccagcagctcatgcaagatatggagcaccctcagagacagaacgtggctgtcaacgagctgtgtgggcgctgccaccagccactagccagggcccaacccgccgtgagagcactgggacaactattccacattgcttgttttacgtgccatcagtgtgcacagcagcttcagggacagcagttctacagcttagagggcgctccctactgcgagggatgctatacggatacgttggagaagtgtaacacctgtggagagcccatcacagaccgcatgctgcgcgctactggcaaagcttaccacccccactgttttacatgcgtagtgtgcgccaggcctctcgagggtacttcctttattgtcgaccaggccaataggccccactgcgtccctgactatcacaagcaatacgccccacgctgctccgtatgtagtgagcccatcatgcctgagccaggtcgggatgagacagtccgcgtggtagctctggacaagaattttcatatgaagtgttataagtgtgaagattgtggaaaacctctgagcattgaggctgacgataatgggtgtttccccctcgatgggcatgtcttgtgcaggaaatgtcatacagctcgggcccagacttag

SEQ ID NO: 141798 - DNA, 1623 bp, Artificial Sequence
  Description of Artificial Sequence: Synthetic coding sequence
gccgctccacggccttcaccggcgatttcagtgtccgtgtcggccccagctttctatgctccacagaaaaagttcgggcccgtggtggcccctaaaccaaaggtgaatccgtttcggcctggggactctgagccgccccctgccccaggcgcacagcgcgcacagatgggccgggtgggggaaattccccccccaccacccgaggacttccctctcccccccccaccactggccggcgatggagatgatgccgagggggcgttgggaggcgctttcccgcctcctccaccccctatcgaggaatccttcccacctgccccactggaagaggagatcttccccagcccccctcctccccctgaggaggagggtggacccgaggctcctattcctccaccgcctcaggtctcctccggctatgtcccaccgccagtggccacgcctttttcctcaaaaagtagcacgaaaccagccgcgggaggaacagcaccactgccaccctggaaatcccccagcagtagccagcctctgccacaggtacccgcccctgcacaatcacaaacacaatttcacgtccagccccaaccgcaacctaaaccacaggtccaactacacgtgcaaagtcaaacgcagcccgtatccctggccaacacccagccccgcgggcctcctgccagttctcccgcacccgcccccaagttctctcccgtgaccccaaagttcactcccgtggcctcgaagtttagccccggcgctccgggaggttccggctcacagcctaatcagaagctgggacatcctgaagccctgagcgccggaactggctcacctcagcccccttccttcacctacgcacagcagcgcgaaaagccaagagtccaggagaagcagcacccagtgcccccacccgcgcaaaaccagaaccaggttagatcccccggagccccagggccacttacgctcaaggaggtcgaggagctggagcagctgacccaacaattgatgcaggatatggagcatccacagaggcagaatgtagctgtgaatgagctgtgcgggagatgtcaccaaccattggcccgcgcgcagccggcggtccgggcgcttgggcaactcttccatattgcctgcttcacatgccatcagtgcgcccagcaactccaggggcaacagttttattcactcgaaggcgccccctactgcgaagggtgttatacggacactttggagaaatgcaacacttgtggcgagcctatcaccgaccgtatgttacgggccaccggaaaggcgtaccatcctcattgctttacatgtgtcgtgtgtgcccgacccctggagggcactagtttcattgtggaccaggcaaacaggccccattgcgtgcccgactaccacaagcaatacgctccaagatgctcagtgtgttcagagccaatcatgcccgaacctggacgggatgaaacagttagagtcgtagccctggataagaacttccatatgaagtgctacaaatgtgaagattgcgggaagccactaagcatcgaggcagacgataatggatgtttcccactggacggacacgtgctgtgtcgcaagtgccatacagccagagctcagacttag

SEQ ID NO: 141799 - DNA, 1248 bp, Artificial Sequence
  Description of Artificial Sequence: Synthetic coding sequence
atgacaaagaacgaccctttcaaagctcgggtgtcaagcgggtacgttcccccacctgtggccaccccttttagctctaagtccagcaccaagcccgcagccggtggcactgcccccttgcccccctggaagtccccatcttcgtcacagccattacctcaagttcccgcacctgcacagtcgcagacacaattccacgtgcagccgcagccacagccaaagccccaagtacaattacacgtccagtcacagacccagcctgtatccctggccaatactcaacctcgcggcccacctgctagtagccctgctcccgctccaaagttctcgccagttacccctaagtttacacccgttgcgtccaagtttagtcctggggctcctggaggcagcggcagccagccaaaccagaaactgggccaccccgaggcattgtccgccggcacaggcagtccccaacccccttctttcacatatgcccaacagagagagaagccacgagttcaggagaagcagcatccagtacccccccctgcgcagaatcagaatcaggtccggtccccaggggcccccgggcctttgaccctgaaggaagtagaggagttggagcagcttactcagcagcttatgcaggatatggagcatccacagcgtcagaacgttgctgtgaacgagctatgtggccggtgccatcagccactagctagggcacaacctgcggtcagagctctggggcagctgttccatatcgcctgttttacatgccatcaatgcgcacagcagctgcagggtcagcagttctattccctggaaggggccccttactgcgagggatgttacacagataccctggagaaatgtaatacctgtggcgaaccaataactgataggatgctgagggctactggtaaagcataccatccacattgcttcacctgcgtggtatgtgcgcgccccctagaagggacttcatttattgttgaccaggcgaatcgtccccactgcgtacctgattaccacaagcagtacgcaccgcgctgctccgtctgcagcgagcccatcatgcctgaaccagggcgcgacgagaccgtcagggtggtggcactcgacaagaactttcacatgaagtgctacaagtgtgaggactgcggaaaacctctgtcgattgaagcagatgacaacggatgtttcccacttgacggtcacgtcctttgtcggaaatgccacaccgcacgtgcgcagacctag

SEQ ID NO: 141800 - DNA, 1458 bp, Artificial Sequence
  Description of Artificial Sequence: Synthetic coding sequence
atgggacgggtcggggaaatacccccaccgccgcctgaggattttcccctacctccccctcctctggccggcgacggtgacgatgcggagggcgccctggggggggcatttccccctccaccgcctcccatcgaagaaagtttccccccagcgccgctggaggaggaaattttcccaagcccccctccgcccccagaagaagaggggggtccagaggcccctatcccacccccaccacaggtgagtagcggatatgtgccaccgcccgtcgcgactcccttttcatcaaagtcaagtaccaaacctgctgcaggtggaactgcccctctgcctccttggaaaagcccctcctcttcccagcctctgcctcaggtgcctgcccccgcccagagccagacgcagttccacgtgcagccacagcctcaacccaagccacaggttcaactgcacgtacaatctcagacccaaccggtctccctcgctaacactcaaccaagggggccgccagcatccagcccagctccggctcccaaatttagtccagtgacccctaagtttactcccgtggcttccaagttctccccaggggcgcctggcgggtctggcagccagccaaatcagaagctggggcaccccgaggctctgagtgcagggaccggttctccgcagcccccaagtttcacctatgctcagcagcgcgagaagcctcgagtgcaggagaagcaacaccccgtcccaccacccgcacagaatcagaaccaggtccgatcaccaggcgcaccaggaccgttaacactcaaagaagtggaagagcttgagcagctcacacagcagcttatgcaggatatggagcatcctcagcgtcaaaacgtcgcagtcaatgaactctgcgggcggtgccaccagccactggcacgggcccagcctgccgtccgggccctcggacagctattccacatcgcttgctttacatgtcatcagtgcgcccaacagctgcaggggcaacaattctattctttagagggcgccccttactgcgaaggctgctacacagataccctggaaaagtgcaatacttgtggggagcccattaccgacaggatgcttagagccacgggaaaagcctaccacccacactgttttacgtgtgtagtgtgcgcaagacctttagaaggtacctcatttatcgtggatcaggccaaccgcccccactgcgttccagattatcataagcagtatgcaccgcgttgctctgtttgttccgaacctattatgccagaaccaggccgagatgagactgtaagggtggtagcactggataagaactttcatatgaagtgctataagtgtgaagactgcggaaaaccgttgtctatagaggctgatgataacggatgtttccccctcgatggacatgtattgtgcaggaagtgtcatactgcgcgcgcccaaacctag

SEQ ID NO: 141801 - DNA, 495 bp, Artificial Sequence
  Description of Artificial Sequence: Synthetic coding sequence
atggccgcacctagaccaagccctgccatatcagtttcagtgagcgccccagccttctatgcaccgcaaaagaaattcggtcctgtagtggcacccaagcctaaggtgaatcctttccgtcctggggatagcgaaccaccaccagcccccggggcacagagggcacagatgggaagggtcggcgagataccgccaccacccccggaggacttccctctgccaccacctcctctcgccggagacggtgatgacgctgagggtgcactgggtggggcttttccaccccctcctccacccattgaggagagctttccccctgcgcccctagaagaagaaatttttccttctcctccaccaccaccagaagaggaaggcggcccagaagccccgataccccctccaccacagccacgggagaaggtgtcaagtattgatttagagattgactctttaagcagcttattggatgacatgaccaaaaatgatcccttctag

SEQ ID NO: 141802 - DNA, 852 bp, Artificial Sequence
  Description of Artificial Sequence: Synthetic coding sequence
atggacctgtggccaggggcctggatgctgctgctgctgctcttcctgctgctgctcttcctgctgcccaccctgtggttctgcagccccagcgccaagtacttcttcaagatggccttctacaacggctggatcctcttcctggccgtgctggccatccctgtgtgtgctgtgcggggcagaaatgtggagaacatgaagatcctgcggctgatgctgctgcacatcaagtacctgtatggcatccgggtggaggtgcggggggcccaccacttcccccccagccagccctacgtggtggtgagcaaccaccagagcagcctggacctgctgggcatgatggaggtgctgcccggccgctgtgtgcccatcgccaagcgggagctgctgtgggccggcagcgctggcctggcctgctggctggccggggtcatcttcatcgacaggaagaggactggagatgccatctctgtgatgtctgaggtggcccagaccctgctgacccaggatgtgcgggtgtgggtgtttcctgagggcaccaggaaccacaacggctccatgctgcccttcaagagaggagccttccacctggccgtgcaggcccaggtgcccatcgtgcccatcgtgatgagcagctaccaggacttctactgcaagaaggagcggcgcttcaccagcggccagtgccaggtgcgggtgctgccccctgtgcccacagagggcctgaccccagatgatgtgcctgccctggccgacagagtgcgccacagcatgctgaccgtcttccgggagatcagcacagatggccggggcggcggggactacctgaagaagccaggcggcggcggctag

SEQ ID NO: 141803 - DNA, 852 bp, Artificial Sequence; identical to SEQ ID NO: 141802
  Description of Artificial Sequence: Synthetic coding sequence

SEQ ID NO: 141804 - DNA, 852 bp, Artificial Sequence; identical to SEQ ID NO: 141802
  Description of Artificial Sequence: Synthetic coding sequence

SEQ ID NO: 141805 - DNA, 852 bp, Artificial Sequence; identical to SEQ ID NO: 141802
  Description of Artificial Sequence: Synthetic coding sequence

SEQ ID NO: 141806 - DNA, 852 bp, Artificial Sequence; identical to SEQ ID NO: 141802
  Description of Artificial Sequence: Synthetic coding sequence

SEQ ID NO: 141807 - DNA, 852 bp, Artificial Sequence; identical to SEQ ID NO: 141802
  Description of Artificial Sequence: Synthetic coding sequence

SEQ ID NO: 141808 - DNA, 852 bp, Artificial Sequence; identical to SEQ ID NO: 141802
  Description of Artificial Sequence: Synthetic coding sequence

SEQ ID NO: 141809 - DNA, 852 bp, Artificial Sequence; identical to SEQ ID NO: 141802
  Description of Artificial Sequence: Synthetic coding sequence

SEQ ID NO: 141810 - DNA, 852 bp, Artificial Sequence; identical to SEQ ID NO: 141802
  Description of Artificial Sequence: Synthetic coding sequence

SEQ ID NO: 141811 - DNA, 852 bp, Artificial Sequence; identical to SEQ ID NO: 141802
  Description of Artificial Sequence: Synthetic coding sequence

SEQ ID NO: 141812 - DNA, 852 bp, Artificial Sequence; identical to SEQ ID NO: 141802
  Description of Artificial Sequence: Synthetic coding sequence

SEQ ID NO: 141813 - DNA, 852 bp, Artificial Sequence; identical to SEQ ID NO: 141802
  Description of Artificial Sequence: Synthetic coding sequence

SEQ ID NO: 141814 - DNA, 516 bp, Artificial Sequence
  Description of Artificial Sequence: Synthetic coding sequence
atgatggaggtgctgcccggccgctgtgtgcccatcgccaagcgggagctgctgtgggccggcagcgctggcctggcctgctggctggccggggtcatcttcatcgacaggaagaggactggagatgccatctctgtgatgtctgaggtggcccagaccctgctgacccaggatgtgcgggtgtgggtgtttcctgagggcaccaggaaccacaacggctccatgctgcccttcaagagaggagccttccacctggccgtgcaggcccaggtgcccatcgtgcccatcgtgatgagcagctaccaggacttctactgcaagaaggagcggcgcttcaccagcggccagtgccaggtgcgggtgctgccccctgtgcccacagagggcctgaccccagatgatgtgcctgccctggccgacagagtgcgccacagcatgctgaccgtcttccgggagatcagcacagatggccggggcggcggggactacctgaagaagccaggcggcggcggctag

SEQ ID NO: 141815 - DNA, 852 bp, Artificial Sequence; identical to SEQ ID NO: 141802
  Description of Artificial Sequence: Synthetic coding sequence

SEQ ID NO: 141816 - DNA, 852 bp, Artificial Sequence; identical to SEQ ID NO: 141802
  Description of Artificial Sequence: Synthetic coding sequence

SEQ ID NO: 141817 - DNA, 852 bp, Artificial Sequence; identical to SEQ ID NO: 141802
  Description of Artificial Sequence: Synthetic coding sequence

SEQ ID NO: 141818 - DNA, 852 bp, Artificial Sequence; identical to SEQ ID NO: 141802
  Description of Artificial Sequence: Synthetic coding sequence

SEQ ID NO: 141819 - DNA, 852 bp, Artificial Sequence; identical to SEQ ID NO: 141802
  Description of Artificial Sequence: Synthetic coding sequence

SEQ ID NO: 141820 - DNA, 852 bp, Artificial Sequence; identical to SEQ ID NO: 141802
  Description of Artificial Sequence: Synthetic coding sequence

SEQ ID NO: 141821 - DNA, 852 bp, Artificial Sequence; identical to SEQ ID NO: 141802
  Description of Artificial Sequence: Synthetic coding sequence

SEQ ID NO: 141822 - DNA, 852 bp, Artificial Sequence; identical to SEQ ID NO: 141802
  Description of Artificial Sequence: Synthetic coding sequence

SEQ ID NO: 141823 - DNA, 852 bp, Artificial Sequence; identical to SEQ ID NO: 141802
  Description of Artificial Sequence: Synthetic coding sequence

SEQ ID NO: 141824 - DNA, 852 bp, Artificial Sequence; identical to SEQ ID NO: 141802
  Description of Artificial Sequence: Synthetic coding sequence

SEQ ID NO: 141825 - DNA, 852 bp, Artificial Sequence; identical to SEQ ID NO: 141802
  Description of Artificial Sequence: Synthetic coding sequence

SEQ ID NO: 141826 - DNA, 852 bp, Artificial Sequence; identical to SEQ ID NO: 141802
  Description of Artificial Sequence: Synthetic coding sequence

SEQ ID NO: 141827 - DNA, 852 bp, Artificial Sequence; identical to SEQ ID NO: 141802
  Description of Artificial Sequence: Synthetic coding sequence

SEQ ID NO: 141828 - DNA, 852 bp, Artificial Sequence; identical to SEQ ID NO: 141802
  Description of Artificial Sequence: Synthetic coding sequence

SEQ ID NO: 141829 - DNA, 852 bp, Artificial Sequence; identical to SEQ ID NO: 141802
  Description of Artificial Sequence: Synthetic coding sequence

SEQ ID NO: 141830 - DNA, 852 bp, Artificial Sequence; identical to SEQ ID NO: 141802
  Description of Artificial Sequence: Synthetic coding sequence

SEQ ID NO: 141831 - DNA, 852 bp, Artificial Sequence; identical to SEQ ID NO: 141802
  Description of Artificial Sequence: Synthetic coding sequence

SEQ ID NO: 141832 - DNA, 852 bp, Artificial Sequence; identical to SEQ ID NO: 141802
  Description of Artificial Sequence: Synthetic coding sequence

SEQ ID NO: 141833 - DNA, 852 bp, Artificial Sequence; identical to SEQ ID NO: 141802
  Description of Artificial Sequence: Synthetic coding sequence

SEQ ID NO: 141834 - DNA, 852 bp, Artificial Sequence; identical to SEQ ID NO: 141802
  Description of Artificial Sequence: Synthetic coding sequence

SEQ ID NO: 141835 - DNA, 852 bp, Artificial Sequence; identical to SEQ ID NO: 141802
  Description of Artificial Sequence: Synthetic coding sequence

SEQ ID NO: 141836 - DNA, 852 bp, Artificial Sequence; identical to SEQ ID NO: 141802
  Description of Artificial Sequence: Synthetic coding sequence

SEQ ID NO: 141837 - DNA, 852 bp, Artificial Sequence; identical to SEQ ID NO: 141802
  Description of Artificial Sequence: Synthetic coding sequence

SEQ ID NO: 141838 - DNA, 852 bp, Artificial Sequence; identical to SEQ ID NO: 141802
  Description of Artificial Sequence: Synthetic coding sequence

SEQ ID NO: 141839 - DNA, 852 bp, Artificial Sequence; identical to SEQ ID NO: 141802
  Description of Artificial Sequence: Synthetic coding sequence

SEQ ID NO: 141840 - DNA, 852 bp, Artificial Sequence; identical to SEQ ID NO: 141802
  Description of Artificial Sequence: Synthetic coding sequence

SEQ ID NO: 141841 - DNA, 852 bp, Artificial Sequence; identical to SEQ ID NO: 141802
  Description of Artificial Sequence: Synthetic coding sequence

SEQ ID NO: 141842 - DNA, 852 bp, Artificial Sequence; identical to SEQ ID NO: 141802
  Description of Artificial Sequence: Synthetic coding sequence

SEQ ID NO: 141843 - DNA, 852 bp, Artificial Sequence; identical to SEQ ID NO: 141802
  Description of Artificial Sequence: Synthetic coding sequence

SEQ ID NO: 141844 - DNA, 852 bp, Artificial Sequence; identical to SEQ ID NO: 141802
  Description of Artificial Sequence: Synthetic coding sequence

SEQ ID NO: 141845 - DNA, 276 bp, Artificial Sequence
  Description of Artificial Sequence: Synthetic coding sequence
cacagcgccagcacccccatcctgacccacagccacccagcccagggcatgatggaggtgctgcccggccgctgtgtgcccatcgccaagcgggagctgctgtgggccggcagcgctggcctggcctgctggctggccggggtcatcttcatcgacaggaagaggactggagatgccatctctgtgatgtctgaggtggcccagaccctgctgacccaggatgtgagccaccctggcctgctgctgcaggagggcgccagcctgcacctgggctag

SEQ ID NO: 141846 - DNA, 276 bp, Artificial Sequence; identical to SEQ ID NO: 141845
  Description of Artificial Sequence: Synthetic coding sequence

SEQ ID NO: 141847 - DNA, 276 bp, Artificial Sequence; identical to SEQ ID NO: 141845
  Description of Artificial Sequence: Synthetic coding sequence

SEQ ID NO: 141848 - DNA, 516 bp, Artificial Sequence; identical to SEQ ID NO: 141814
  Description of Artificial Sequence: Synthetic coding sequence

SEQ ID NO: 141849 - DNA, 516 bp, Artificial Sequence; identical to SEQ ID NO: 141814
  Description of Artificial Sequence: Synthetic coding sequence

SEQ ID NO: 141850 - DNA, 276 bp, Artificial Sequence; identical to SEQ ID NO: 141845
  Description of Artificial Sequence: Synthetic coding sequence

SEQ ID NO: 141851 - DNA, 276 bp, Artificial Sequence; identical to SEQ ID NO: 141845
  Description of Artificial Sequence: Synthetic coding sequence

SEQ ID NO: 141852 - DNA, 276 bp, Artificial Sequence; identical to SEQ ID NO: 141845
  Description of Artificial Sequence: Synthetic coding sequence

SEQ ID NO: 141853 - DNA, 516 bp, Artificial Sequence; identical to SEQ ID NO: 141814
  Description of Artificial Sequence: Synthetic coding sequence

SEQ ID NO: 141854 - DNA, 516 bp, Artificial Sequence; identical to SEQ ID NO: 141814
  Description of Artificial Sequence: Synthetic coding sequence

SEQ ID NO: 141855 - DNA, 276 bp, Artificial Sequence; identical to SEQ ID NO: 141845
  Description of Artificial Sequence: Synthetic coding sequence

SEQ ID NO: 141856 - DNA, 516 bp, Artificial Sequence; identical to SEQ ID NO: 141814
  Description of Artificial Sequence: Synthetic coding sequence

SEQ ID NO: 141857 - DNA, 516 bp, Artificial Sequence; identical to SEQ ID NO: 141814
  Description of Artificial Sequence: Synthetic coding sequence

SEQ ID NO: 141858 - DNA, 741 bp, Artificial Sequence
  Description of Artificial Sequence: Synthetic coding sequence
atggagctgtggccctgcctggccgccgccctgctgctgctgctgctgctggtgcagctgagcagagctgctgagttctacgccaaggtggccctgtactgtgccctgtgcttcaccgtgtctgctgtggccagcctggtgtgcctgctgcggcacggcggccgcacagtggagaacatgagcatcatcggctggtttgtgcgctccttcaagtacttctacggcctgcgctttgaggtgcgggacccccggcggctgcaggaggcccggccctgcgtcatcgtgagcaaccaccagagcatcctggacatgatgggcctgatggaggtgctgcctgagcgctgtgtgcagatcgccaagcgggagctgctcttcctgggccctgtgggcctcatcatgtacctgggcggcgtcttcttcatcaaccggcagaggagcagcacagccatgacagtgatggctgacctgggggagaggatggtgagagaaaatgtgcccatcgtgcctgtggtgtacagcagcttcagcagcttctacaacaccaagaagaagttcttcaccagcggcaccgtgacagtgcaggtgctggaggccatccccaccagcggcctgacagctgctgatgtgcctgccctggtggacacctgccaccgggccatgaggaccaccttcctgcacatcagcaagaccccccaggagaatggagccacagctggcagcggcgtgcagcctgcccagtag

SEQ ID NO: 141859 - DNA, 837 bp, Artificial Sequence
  Description of Artificial Sequence: Synthetic coding sequence
atggagctgtggccctgcctggccgccgccctgctgctgctgctgctgctggtgcagctgagcagagctgctgagttctacgccaaggtggccctgtactgtgccctgtgcttcaccgtgtctgctgtggccagcctggtgtgcctgctgcggcacggcggccgcacagtggagaacatgagcatcatcggctggtttgtgcgctccttcaagtacttctacggcctgcgctttgaggtgcgggacccccggcggctgcaggaggcccggccctgcgtcatcgtgagcaaccaccagagcatcctggacatgatgggcctgatggaggtgctgcctgagcgctgtgtgcagatcgccaagcgggagctgctcttcctgggccctgtgggcctcatcatgtacctgggcggcgtcttcttcatcaaccggcagaggagcagcacagccatgacagtgatggctgacctgggggagaggatggtgcgggagaacctgaaggtgtggatctacccagagggcaccagaaatgacaacggggacctgctgcccttcaagaagggggccttctacctggccgtgcaggcccaggtgcccatcgtgcctgtggtgtacagcagcttcagcagcttctacaacaccaagaagaagttcttcaccagcggcaccgtgacagtgcaggtgctggaggccatccccaccagcggcctgacagctgctgatgtgcctgccctggtggacacctgccaccgggccatgaggaccaccttcctgcacatcagcaagaccccccaggagaatggagccacagctggcagcggcgtgcagcctgcccagtag

SEQ ID NO: 141860 - DNA, 837 bp, Artificial Sequence; identical to SEQ ID NO: 141859
  Description of Artificial Sequence: Synthetic coding sequence

SEQ ID NO: 141861 - DNA, 1371 bp, Artificial Sequence
  Description of Artificial Sequence: Synthetic coding sequence
atgttcctgctgctgccctttgacagcctgattgtgaacctgctgggcatcagcctgactgtgctcttcaccctgctgctggtgttcatcatcgtgcctgccatcttcggcgtgtcctttggcatcaggaagctgtacatgaagagcctgctgaagatctttgcctgggccaccctgaggatggagcggggggccaaggagaagaaccaccagctgtacaagccctacaccaacggcatcatcgccaaggaccccaccagcctggaggaggagatcaaggagatccgccgcagcggcagcagcaaggccctggacaacaccccagagtttgagctgagtgacatcttctacttctgcaggaagggcatggagaccatcatggatgatgaggtgaccaagcgcttctctgctgaggagctggagagctggaacctgctgagcaggaccaactacaacttccagtacatcagcctgcggctgactgtgctgtggggcctgggcgtgctgatccgctactgcttcctgctgcccctgcgcatcgccctggccttcaccggcatcagcctgctggtggtgggcaccaccgtggtgggctacctgcccaacggccgcttcaaggagttcatgagcaagcacgtgcacctgatgtgctaccgcatctgtgtgcgggccctgacagccatcatcacctaccatgacagagaaaatcggcccagaaatggaggcatctgtgtggccaaccacaccagccccattgatgtgatcatcctggccagtgatggctactatgccatggtgggccaggtgcacggcggcctgatgggcgtcatccagagggccatggtgaaggcctgcccccacgtgtggtttgagaggtctgaggtgaaggacagacacctggtggccaagaggctgacagagcacgtgcaggacaagagcaagctgcccatcctgatcttccctgagggcacctgcatcaacaacacctctgtgatgatgttcaagaagggcagctttgaaattggagccaccgtgtaccctgtggccatcaagtatgacccccagtttggagatgccttctggaacagcagcaaatatggcatggtgacctacctgctgaggatgatgacctcctgggccatcgtgtgcagcgtgtggtacctgccccccatgacccgggaggctgatgaagatgctgtgcagtttgccaacagagtgaagagcgccatcgcccggcagggcggcctggtggacctgctgtgggatggcggcctgaagcgggagaaggtgaaggacaccttcaaggaggagcagcagaagctgtacagcaagatgattgtgggcaaccacaaggacaggagccgctcctag

SEQ ID NO: 141862 - DNA, 1305 bp, Artificial Sequence
  Description of Artificial Sequence: Synthetic coding sequence
atggagggcgctgagctggccggcaagatcctgagcacctggctgaccctggtgctgggcttcatcctgctgcccagcgtgtttggagtgtccctgggcatcagcgagatctacatgaagatcctggtgaagaccctggagtgggccaccatcagaattgagaagggcacccccaaggagagcatcctgaagaacagcgcctctgtgggcatcatccagagagatgagagccccatggagaagggcctgagcggcctgcggggccgggactttgagctgagtgatgtgttctacttcagcaagaagggcctggaggccatcgtggaggatgaggtgacccagcgcttcagcagcgaggagctggtgtcctggaacctgctgaccaggaccaacgtgaacttccagtacatcagcctgcggctgaccatggtgtgggtgctgggcgtcatcgtgcgctactgtgtgctgctgcccctgcgggtgaccctggccttcatcggcatcagcctgctggtgattggcaccaccctggtgggccagctgcctgacagcagcctgaagaactggctgtctgagctggtgcacctgacctgctgccgcatctgtgtgcgggccctgagcggcaccatccactaccacaacaagcagtaccggccccagaagggcggcatctgtgtggccaaccacaccagccccattgatgtgctgatcctgaccacagatggctgctacgccatggtgggccaggtgcatggaggcctgatgggcatcatccagagggccatggtgaaggcctgcccccacgtgtggtttgagaggtctgagatgaaggacagacacctggtgaccaagaggctgaaggagcacatcgctgacaagaagaagctgcccatcctgatcttccctgagggcacctgcatcaacaacacctctgtgatgatgttcaagaagggcagctttgagatcggcggcaccatccaccctgtggccatcaagtacaacccccagtttggagatgccttctggaacagcagcaagtacaacatggtgtcctacctgctgaggatgatgacctcctgggccatcgtgtgtgatgtgtggtacatgccacccatgacccgggaggagggggaggatgctgtgcagtttgccaacagagtgaagagcgccatcgccatccagggcggcctgacagagctgccctgggatggcggcctgaagagggccaaggtgaaggacatcttcaaggaggagcagcagaagaactacagcaagatgattgtgggcaatggcagcctgtcctag

SEQ ID NO: 141863 - DNA, 1305 bp, Artificial Sequence; identical to SEQ ID NO: 141862
  Description of Artificial Sequence: Synthetic coding sequence

SEQ ID NO: 141864 - DNA, 1506 bp, Artificial Sequence
  Description of Artificial Sequence: Synthetic coding sequence
atgttcaccctgccccagaaggacttccgggcccccaccacctgcctgggccccacctgcatgcaggacctgggcagcagccacggggaggacctggagggagaatgttccaggaagctggaccagaagctgcctgagctgcggggcgtgggggaccctgccatgatcagcagtgacaccagctacctgagcagccggggccgcatgatcaagtggttctgggacagcgctgaggagggctaccgcacctaccacatggatgaatatgatgaggacaagaaccccagcggcatcatcaacctgggcaccagcgagaacaagctgtgctttgacctgctgtcctggaggctgagccagagggacatgcagagggtggagcccagcctgctgcagtatgctgactggaggggccacctgttcctgcgggaggaggtggccaagttcctgtccttctactgcaagagccctgtgcccctgcggccagaaaatgtggtggtgctgaatggaggagccagcctcttcagcgccctggccaccgtgctgtgtgaggccggggaggccttcctgatccccaccccctactatggagccatcacccagcacgtgtgcctgtatggcaacatccggctggcctacgtgtacctggacagcgaggtgacaggcctggacacccggcccttccagctgactgtggagaagctggagatggccctgcgggaggcccacagcgagggcgtgaaggtgaagggcctcatcctgatcagcccccagaaccccctgggagatgtgtacagccctgaggagctgcaggagtacctggtgtttgccaagaggcaccggctgcacgtgattgtggatgaggtgtacatgctgtctgtgtttgagaagtctgtgggctacagatctgtgctgagcctggagcggctgcctgacccccagaggacccacgtgatgtgggccaccagcaaggactttggcatgagcggcctgcgcttcggcaccctgtacacagagaaccaggatgtggccacagctgtggccagcctgtgccgctaccacggcctgagcggcctggtgcagtaccagatggcccagctgctgcgggaccgggactggatcaaccaggtgtacctgcctgagaaccacgcccggctgaaggccgcccacacctacgtgtctgaggagctgcgggccctgggcatccccttcctgagcagaggagctggcttcttcatctgggtggacctgaggaagtacctgcccaagggcacctttgaggaggagatgctgctgtggaggcgcttcctggacaacaaggtgctgctgagctttgggaaggcctttgagtgcaaggagcccggctggttccgctttgtgttcagtgaccaggtgcaccggctgtgcctgggcatgcagagggtgcagcaggtgctggccggcaagagccaggtggccgaggacccccggcccagccagagccaggagcccagcgaccagaggaggtag

SEQ ID NO: 141865 - DNA, 477 bp, Artificial Sequence
  Description of Artificial Sequence: Synthetic coding sequence
atgttcaccctgccccagaaggacttccgggcccccaccacctgcctgggccccacctgcatgcaggacctgggcagcagccacggggaggacctggagggagaatgttccaggaagctggaccagaagctgcctgagctgcggggcgtgggggaccctgccatgatcagcagtgacaccagctacctgagcagccggggccgcatgatcaagtggttctgggacagcgctgaggagggctaccgcacctaccacatggatgaatatgatgaggacaagaaccccagcggcatcatcaacctgggcaccagcgagaacaagctgtgctttgacctgctgtcctggaggcctcctgggggcagcggccaggtgcctgtgttcctgctgcaggagcccagcaccccccagaccagagaatgtggctgcccagagtggtggtgcctggccctgctgtgcagcggccatggagctgtgtag

SEQ ID NO: 141866 - DNA, 420 bp, Artificial Sequence
  Description of Artificial Sequence: Synthetic coding sequence
atgttcaccctgccccagaaggacttccgggcccccaccacctgcctgggccccacctgcatgcaggacctgggcagcagccacggggaggacctggagggagaatgttccaggaagctggaccagaagctgcctgagctgcggggcgtgggggaccctgccatgatcagcagtgacaccagctacctgagcagccggggccgcatgatcaagtggttctgggacagcgctgaggagggctaccgcacctaccacatggatgaatatgatgaggacaagaaccccagcggcatcatcaacctgggcaccagcgagaacaagctgtgctttgacctgctgtcctggaggctgagccagagggacatgcagagggtggagcccagcctgctgcagtatgctgactggaggggccacctgtag

SEQ ID NO: 141867 - DNA, 234 bp, Artificial Sequence
  Description of Artificial Sequence: Synthetic coding sequence
atgttcaccctgccccagaaggacttccgggcccccaccacctgcctgggccccacctgcatgcaggacctgggcagcagccacggggaggacctggagggagaatgttccaggaagctggaccagaagctgcctgagctgcggggcgtgggggaccctgccatgatcagcagtgacaccagctacctgagcagccggggccgcatgatcaagtggttctgggacagcgcctag

SEQ ID NO: 141868 - DNA, 780 bp, Artificial Sequence
  Description of Artificial Sequence: Synthetic coding sequence
atgagcaagtacaagctgatcatgctgcggcatggagagggcgcctggaacaaggaaaatcgcttctgctcctgggtggaccagaagctgaacagcgagggcatggaggaggccaggaactgtgggaagcagctgaaggccctgaactttgaatttgacctggtgttcacctctgtgctgaacagaagcatccacacagcctggctgatcctggaggagctgggccaggagtgggtgcctgtggagagctcctggaggctgaatgaaagacactacggggccctgattggcctgaaccgggagcagatggccctgaaccacggggaggagcaggtgcggctgtggaggaggagctacaacgtgaccccaccacccatcgaggagagccacccctactaccaggagatctacaatgaccggcgctacaaggtgtgtgatgtgcccctggaccagctgcccaggtctgagagcctgaaggatgtgctggagcggctgctgccctactggaatgaaagaattgcccctgaggtgctgcggggcaagaccatcctgatcagcgcccacggcaacagcagccgggccctgctgaagcacctggagggcatcagtgatgaggacatcatcaacatcaccctgcccaccggggtgcccatcctgctggagctggatgagaacctgcgggctgtgggcccccaccagttcctgggggaccaggaggccatccaggccgccatcaagaaggtggaggaccagggcaaggtgaagcaggccaagaagtag

SEQ ID NO: 141869 - DNA, 780 bp, Artificial Sequence; identical to SEQ ID NO: 141868
  Description of Artificial Sequence: Synthetic coding sequence

SEQ ID NO: 141870 - DNA, 780 bp, Artificial Sequence; identical to SEQ ID NO: 141868
  Description of Artificial Sequence: Synthetic coding sequence

SEQ ID NO: 141871 - DNA, 237 bp, Artificial Sequence
  Description of Artificial Sequence: Synthetic coding sequence
atgagcaagtacaagctgatcatgctgcggcatggagagggcgcctggaacaaggaaaatcgcttctgctcctgggtggaccagaagctgaacagcgagggcatggaggaggccaggaactgtgggaagcagctgaaggccctgaactttgaatttgacctggtgttcacctctgtgctgaacagaagcatccacacagcctggctgatcctggaggagctgggccaggagtggtag

SEQ ID NO: 141872 - DNA, 894 bp, Artificial Sequence
  Description of Artificial Sequence: Synthetic coding sequence
atgaacagaggcttcagcaggaagagccacaccttcctgcccaagatcttcttcaggaagatgagcagcagcggggccaaggacaagccagagctgcagttccccttcctgcaggatgaggacacagtggccaccctgctggagtgcaagaccctcttcatcctgcggggcctgcccggcagcggcaagagcaccctggcccgggtcatcgtggacaagtacagagatggcaccaagatggtgtctgcagatgcctacaagatcacccctggggcccggggggccctgaaggagctgcggcagtttgtgcctggagatgagccccgggagaagatggacctggtgacctactttgggaagaggcctcctggggtgctgcactgcaccaccaagttctgtgactatggcaaggcccctggagctgaggagtatgcccagcaggatgtgctgaagaagagctacagcaaggccttcaccctgaccatcagcgccctgtttgtgacccccaagaccaccggggcccgggtggagctgtctgagcagcagctgcagctgtggcccagtgatgtggacaagctgagccccacagacaacctgccccggggcagccgggcccacatcaccctgggctgtgccgcagatgtggaggccgtgcagacaggcctggacctgctggagatcctgcggcaggagaagggcggcagcagaggagaggaggtgggggagctgagccggggcaagctgtacagcctgggcaatggccgctggatgctgaccctggccaagaacatggaggtgcgggccatcttcaccggctactacggcaagggcaagcctgtgcccacccagggcagcaggaaaggaggagccctgcagagctgcaccatcatctag

SEQ ID NO: 141873 - DNA, 1206 bp, Artificial Sequence
  Description of Artificial Sequence: Synthetic coding sequence
atgagcagcagcggggccaaggacaagccagagctgcagttccccttcctgcaggatgaggacacagtggccaccctgctggagtgcaagaccctcttcatcctgcggggcctgcccggcagcggcaagagcaccctggcccgggtcatcgtggacaagtacagagatggcaccaagatggtgtctgcagatgcctacaagatcacccctggggcccggggggccttcagcgaggagtacaagaggctggatgaggacctggccgcctactgcagaagaagagacatccgcatcctggtgctggatgacaccaaccacgagcgggagcggctggagcagctgtttgagatggctgaccagtaccagtaccaggtggtgctggtggagcccaagacagcctggaggctggactgtgcccagctgaaggagaagaaccagtggcagctgtctgcagatgacctgaagaagctgaagccaggcctggagaaggacttcctgcccctgtacttcggctggttcctgaccaagaagagcagcgagaccctgaggaaggccggccaggtgttcctggaggagctgggcaaccacaaggccttcaagaaggagctgcggcagtttgtgcctggagatgagccccgggagaagatggacctggtgacctactttgggaagaggcctcctggggtgctgcactgcaccaccaagttctgtgactatggcaaggcccctggagctgaggagtatgcccagcaggatgtgctgaagaagagctacagcaaggccttcaccctgaccatcagcgccctgtttgtgacccccaagaccaccggggcccgggtggagctgtctgagcagcagctgcagctgtggcccagtgatgtggacaagctgagccccacagacaacctgccccggggcagccgggcccacatcaccctgggctgtgccgcagatgtggaggccgtgcagacaggcctggacctgctggagatcctgcggcaggagaagggcggcagcagaggagaggaggtgggggagctgagccggggcaagctgtacagcctgggcaatggccgctggatgctgaccctggccaagaacatggaggtgcgggccatcttcaccggctactacggcaagggcaagcctgtgcccacccagggcagcaggaaaggaggagccctgcagagctgcaccatcatctag

SEQ ID NO: 141874 - DNA, 1266 bp, Artificial Sequence
  Description of Artificial Sequence: Synthetic coding sequence
atgaacagaggcttcagcaggaagagccacaccttcctgcccaagatcttcttcaggaagatgagcagcagcggggccaaggacaagccagagctgcagttccccttcctgcaggatgaggacacagtggccaccctgctggagtgcaagaccctcttcatcctgcggggcctgcccggcagcggcaagagcaccctggcccgggtcatcgtggacaagtacagagatggcaccaagatggtgtctgcagatgcctacaagatcacccctggggcccggggggccttcagcgaggagtacaagaggctggatgaggacctggccgcctactgcagaagaagagacatccgcatcctggtgctggatgacaccaaccacgagcgggagcggctggagcagctgtttgagatggctgaccagtaccagtaccaggtggtgctggtggagcccaagacagcctggaggctggactgtgcccagctgaaggagaagaaccagtggcagctgtctgcagatgacctgaagaagctgaagccaggcctggagaaggacttcctgcccctgtacttcggctggttcctgaccaagaagagcagcgagaccctgaggaaggccggccaggtgttcctggaggagctgggcaaccacaaggccttcaagaaggagctgcggcagtttgtgcctggagatgagccccgggagaagatggacctggtgacctactttgggaagaggcctcctggggtgctgcactgcaccaccaagttctgtgactatggcaaggcccctggagctgaggagtatgcccagcaggatgtgctgaagaagagctacagcaaggccttcaccctgaccatcagcgccctgtttgtgacccccaagaccaccggggcccgggtggagctgtctgagcagcagctgcagctgtggcccagtgatgtggacaagctgagccccacagacaacctgccccggggcagccgggcccacatcaccctgggctgtgccgcagatgtggaggccgtgcagacaggcctggacctgctggagatcctgcggcaggagaagggcggcagcagaggagaggaggtgggggagctgagccggggcaagctgtacagcctgggcaatggccgctggatgctgaccctggccaagaacatggaggtgcgggccatcttcaccggctactacggcaagggcaagcctgtgcccacccagggcagcaggaaaggaggagccctgcagagctgcaccatcatctag

SEQ ID NO: 141875 - DNA, 174 bp, Artificial Sequence
  Description of Artificial Sequence: Synthetic coding sequence
atgagcagcagcggggccaaggacaagccagagctgcagttccccttcctgcaggatgaggacacagtggccaccctgctggagtgcaagaccctcttcatcctgcggggcctgcccggcagcggcaagagcaccctggcccgggtcatcgtggacaagtacagagatggatag

SEQ ID NO: 141876 - DNA, 1419 bp, Artificial Sequence
  Description of Artificial Sequence: Synthetic coding sequence
atgaagttcctgatctttgccttctttggaggagtgcacctgctgagcctgtgcagcggcaaggccatctgcaagaatggcatcagcaagaggacctttgaggagatcaaggaggagatcgccagctgtggagatgtggccaaggccatcatcaacctggccgtgtatggcaaggcccagaacagaagctatgaaaggctggccctgctggtggacacagtgggcccccggctgagcggcagcaagaacctggagaaggccatccagatcatgtaccagaacctgcagcaggacggcctggagaaggtgcacctggagcctgtgcgcatcccccactgggagcggggggaggagagcgctgtgatgctggagccccgcatccacaagatcgccatcctgggcctgggcagcagcatcggcaccccacctgagggcatcacagctgaggtgctggtggtgaccagctttgatgagctgcagaggcgggccagcgaggcccggggcaagatcgtggtgtacaaccagccctacatcaactacagcaggacagtgcagtaccgcacccagggcgctgtggaggccgccaaggtgggcgccctggccagcctcatccgctctgtggccagcttcagcatctacagcccccacacaggcatccaggagtaccaggatggagtgcccaagatccccacagcctgcatcaccgtggaggatgctgagatgatgagcaggatggccagccacggcatcaagatcgtcatccagctgaagatgggcgccaagacctacccagacacagacagcttcaacacagtggccgagatcaccggcagcaagtacccagagcaggtggtgctggtgtctggccacctggacagctgggatgtgggccagggcgccatggatgatggcggcggggccttcatctcctgggaggccctgagcctcatcaaggacctgggcctgcggcccaagaggaccctgcggctggtgctgtggacagctgaggagcagggcggcgtgggcgccttccagtactaccagctgcacaaggtgaacatcagcaactacagcctggtgatggagagtgatgctggcaccttcctgcccaccggcctgcagttcaccggcagcgagaaggcccgggccatcatggaggaggtgatgagcctgctgcagcccctgaacatcacccaggtgctgagccatggagagggcacagacatcaacttctggatccaggccggcgtgcctggggccagcctgctggatgacctgtacaagtacttcttcttccaccacagccacggggacaccatgacagtgatggaccccaagcagatgaatgtggccgctgctgtgtgggccgtggtgtcctatgtggtggccgacatggaggagatgctgcccaggagctag

SEQ ID NO: 141877 - DNA, 981 bp, Artificial Sequence
  Description of Artificial Sequence: Synthetic coding sequence
atgagcggcctgggcaagaagcacctgctgctgatgggagagttcttctcctatggcaccaagatcctgtaccagaacacagaggccctgcagagcaagttcttcagccccctgcagaaggccatgctgccccccaacagcttccagggcaaggtggccttcatcaccggcggcggcaccggcctgggcaagggcatgaccaccctgctgagcagcctgggcgcccagtgtgtgattgccagcaggaagatggatgtgctgaaggccacagctgagcagatcagcagccagacaggcaacaaggtgcacgccatccagtgtgatgtgcgggaccctgacatggtgcagaacacagtgtctgagctgatcaaggtggccggccaccccaacatcgtcatcaacaatgctgctggcaacttcatcagccccacagagcggctgagccccaatgcctggaagaccatcacagacatcgtgctgaatggaacagcctttgtgaccctggagatcggcaagcagctgatcaaggcccagaagggagctgccttcctgagcatcaccaccatctatgcagagactggaagtggctttgtggtgcccagcgccagcgccaaggccggcgtggaggccatgagcaagagcctggccgctgagtggggcaagtatggcatgaggttcaacgtcatccagcccggccccatcaagaccaagggggccttcagccggctggaccccaccggcacctttgagaaggagatgattggccgcatcccctgtggccgcctgggcaccgtggaggagctggccaacctggccgccttcctgtgcagcgactatgcctcctggatcaacggggccgtcatcaagtttgatggaggagaggaggtgctgatctctggagagttcaatgacctgaggaaggtgaccaaggagcagtgggacaccatcgaggagctgatcaggaagaccaagggcagctag

SEQ ID NO: 141878 - DNA, 1551 bp, Artificial Sequence
  Description of Artificial Sequence: Synthetic coding sequence
atggagcctgctgtgtccctggccgtgtgtgccctgctcttcctgctgtgggtgcggctgaagggcctggagtttgtgctgatccaccagcgctgggtgtttgtgtgcctcttcctgctgcccctgagcctcatctttgacatctactactacgtgcgggcctgggtggtgttcaagctgagcagcgccccccggctgcacgagcagagggtgcgggacatccagaagcaggtgcgggagtggaaggagcagggcagcaagaccttcatgtgcaccggccggcccggctggctgactgtgtccctgcgggtgggcaagtacaagaagacccacaagaacatcatgatcaacctgatggacatcctggaggtggacaccaagaagcagatcgtgcgggtggagcccctggtgaccatgggccaggtgacagccctgctgaccagcatcggctggaccctgcctgtgctgcctgagctggatgacctgactgtgggcggcctcatcatgggcactggaattgagagcagcagccacaagtatggcctcttccagcacatctgcacagcctatgagctggtgctggctgatggcagctttgtgcgctgcaccccatctgagaacagcgacctcttctatgctgtgccctggagctgtggcaccctgggcttcctggtggccgctgagatccgcatcatcccagccaagaagtatgtgaagctgcgctttgagcctgtgcggggcctggaggccatctgtgccaagttcacccatgagagccagaggcaggagaaccactttgtggagggcctgctgtacagcctggatgaagctgtgatcatgactggagtgatgacagatgaggccgagcccagcaagctgaacagcatcggcaactactacaagccctggttcttcaagcacgtggagaactacctgaagaccaaccgggagggcctggagtacatccccctgcggcactactaccaccgccacaccaggagcatcttctgggagctgcaggacatcatcccctttggaaacaaccccatcttccgctacctgtttggctggatggtgccccccaagatcagcctgctgaagctgacccagggcgagaccctgaggaagctgtatgagcagcaccacgtggtgcaggacatgctggtgcccatgaagtgcctgcagcaggccctgcacaccttccagaatgacatccacgtgtaccccatctggctgtgccccttcatcctgcccagccagcccggcctggtgcaccccaagggaaatgaagctgagctgtacattgatattggagcctacggggagccccgggtgaagcactttgaggcccggagctgcatgaggcagctggagaagtttgtgcgctctgtgcacggcttccagatgctgtatgctgactgctacatgaaccgggaggagttctgggagatgtttgatggcagcctgtaccacaagctgcgggagaagctgggctgccaggatgccttccctgaggtgtatgacaagatctgcaaggccgcccggcactag

SEQ ID NO: 141879 - DNA, 465 bp, Artificial Sequence
  Description of Artificial Sequence: Synthetic coding sequence
tgaagcctgctgaagctgacccagggcgagaccctgaggaagctgtatgagcagcaccacgtggtgcaggacatgctggtgcccatgaagtgcctgcagcaggccctgcacaccttccagaatgacatccacgtgtaccccatctggctgtgccccttcatcctgcccagccagcccggcctggtgcaccccaagggaaatgaagctgagctgtacattgatattggagcctacggggagccccgggtgaagcactttgaggcccggagctgcatgaggcagctggagaagtttgtgcgctctgtgcacggcttccagatgctgtatgctgactgctacatgaaccgggaggagttctgggagatgtttgatggcagcctgtaccacaagctgcgggagaagctgggctgccaggatgccttccctgaggtgtatgacaagatctgcaaggccgcccggcactag

SEQ ID NO: 141880 - DNA, 1428 bp, Artificial Sequence
  Description of Artificial Sequence: Synthetic coding sequence
atgggcgctggggagcagaaccggcagagcgcccactgtgtgcagggcatctgtggctacctggagggagatgaggagggggaggagggggaggtgcgcagcacccaggtgcgggagtggaaggagcagggcagcaagaccttcatgtgcaccggccggcccggctggctgactgtgtccctgcgggtgggcaagtacaagaagacccacaagaacatcatgatcaacctgatggacatcctggaggtggacaccaagaagcagatcgtgcgggtggagcccctggtgaccatgggccaggtgacagccctgctgaccagcatcggctggaccctgcctgtgctgcctgagctggatgacctgactgtgggcggcctcatcatgggcaccggcatcgagagcagcagccacaagtatggcctcttccagcacatctgcacagcctatgagctggtgctggctgatggcagctttgtgcgctgcacccccagtgaaaattctgacctcttctatgctgtgccctggagctgtggcaccctgggcttcctggtggccgctgagatccgcatcatcccagccaagaagtatgtgaagctgcgctttgagcctgtgcggggcctggaggccatctgtgccaagttcacccatgagagccagaggcaggagaaccactttgtggagggcctgctgtacagcctggatgaggccgtcatcatgactggagtgatgacagatgaagctgagcccagcaagctgaacagcatcggcaactactacaagccctggttcttcaagcacgtggagaactacctgaagaccaaccgggagggcctggagtacatccccctgcggcactactaccaccgccacaccaggagcatcttctgggagctgcaggacatcatccccttcggcaacaaccccatcttccgctacctgtttggctggatggtgccccccaagatcagcctgctgaagctgacccagggcgagaccctgaggaagctgtatgagcagcaccacgtggtgcaggacatgctggtgcccatgaagtgcctgcagcaggccctgcacaccttccagaatgacatccacgtgtaccccatctggctgtgccccttcatcctgcccagccagcccggcctggtgcaccccaagggaaatgaggccgagctgtacatcgacatcggggcctatggagagccccgggtgaagcactttgaggcccggagctgcatgaggcagctggagaagtttgtgcgctctgtgcacggcttccagatgctgtatgctgactgctacatgaaccgggaggagttctgggagatgtttgatggcagcctgtaccacaagctgcgggagaagctgggctgccaggatgccttccctgaggtgtatgacaagatctgcaaggccgcccggcactag

SEQ ID NO: 141881 - DNA, 903 bp, Artificial Sequence
  Description of Artificial Sequence: Synthetic coding sequence
atgggcactggaattgagagcagcagccacaagtatggcctcttccagcacatctgcacagcctatgagctggtgctggctgatggcagctttgtgcgctgcaccccatctgagaacagcgacctcttctatgctgtgccctggagctgtggcaccctgggcttcctggtggccgctgagatccgcatcatcccagccaagaagtatgtgaagctgcgctttgagcctgtgcggggcctggaggccatctgtgccaagttcacccatgagagccagaggcaggagaaccactttgtggagggcctgctgtacagcctggatgaagctgtgatcatgactggagtgatgacagatgaggccgagcccagcaaggacatcatcccctttggaaacaaccccatcttccgctacctgtttggctggatggtgccccccaagatcagcctgctgaagctgacccagggcgagaccctgaggaagctgtatgagcagcaccacgtggtgcaggacatgctggtgcccatgaagtgcctgcagcaggccctgcacaccttccagaatgacatccacgtgtaccccatctggctgtgccccttcatcctgcccagccagcccggcctggtgcaccccaagggaaatgaagctgagctgtacattgatattggagcctacggggagccccgggtgaagcactttgaggcccggagctgcatgaggcagctggagaagtttgtgcgctctgtgcacggcttccagatgctgtatgctgactgctacatgaaccgggaggagttctgggagatgtttgatggcagcctgtaccacaagctgcgggagaagctgggctgccaggatgccttccctgaggtgtatgacaagatctgcaaggccgcccggcactag

SEQ ID NO: 141882 - DNA, 729 bp, Artificial Sequence
  Description of Artificial Sequence: Synthetic coding sequence
atggagcctgctgtgtccctggccgtgtgtgccctgctcttcctgctgtgggtgcggctgaagggcctggagtttgtgctgatccaccagcgctgggtgtttgtgtgcctcttcctgctgcccctgagcctcatctttgacatctactactacgtgcgggcctgggtggtgttcaagctgagcagcgccccccggctgcacgagcagagggtgcgggacatccagaagcaggtgcgggagtggaaggagcagggcagcaagaccttcatgtgcaccggccggcccggctggctgactgtgtccctgcgggtgggcaagtacaagaagacccacaagaacatcatgatcaacctgatggacatcctggaggtggacaccttccagaatgacatccacgtgtaccccatctggctgtgccccttcatcctgcccagccagcccggcctggtgcaccccaagggaaatgaagctgagctgtacattgatattggagcctacggggagccccgggtgaagcactttgaggcccggagctgcatgaggcagctggagaagtttgtgcgctctgtgcacggcttccagatgctgtatgctgactgctacatgaaccgggaggagttctgggagatgtttgatggcagcctgtaccacaagctgcgggagaagctgggctgccaggatgccttccctgaggtgtatgacaagatctgcaaggccgcccggcactag

SEQ ID NO: 141883 - DNA, 1203 bp, Artificial Sequence
  Description of Artificial Sequence: Synthetic coding sequence
atgatggacctgaggaacaccccagccaagagcctggacaagttcatcgaggactacctgctgcctgacacctgcttcaggatgcagatcaaccacgccatcgacatcatctgtggcttcctgaaggagcgctgcttccggggcagcagctaccctgtgtgtgtgtccaaggtggtgaagggcggcagcagcggcaagggcaccaccctgcggggccgcagtgatgctgacctggtggtgttcctgagccccctgaccaccttccaggaccagctgaacagaagaggagagttcatccaggagatccggcggcagctggaggcctgccagcgggagcgggccttctctgtgaagtttgaggtgcaggccccccgctggggcaacccccgggccctgagctttgtgctgagcagcctgcagctgggggagggcgtggagtttgatgtgctgcctgcctttgatgccctgggccagctgaccggcggctacaagcccaacccccagatctacgtgaagctgattgaggagtgcacagacctgcagaaggagggggagttcagcacctgcttcacagagctgcagagggacttcctgaagcagaggcccaccaagctgaagagcctcatccggctggtgaagcactggtaccagaactgcaagaagaagctgggcaagctgcccccccagtatgccctggagctgctgactgtgtatgcctgggagcggggctccatgaagacccacttcaacacagcccagggcttcagaacagtgctggagctggtgatcaactaccagcagctgtgcatctactggaccaagtactatgacttcaagaaccccatcatcgagaagtacctgcggcggcagctgaccaagcccaggcctgtgatcctggaccctgctgaccccactggaaacctgggcggcggggaccccaagggctggaggcagctggcccaggaggccgaggcctggctgaactacccctgcttcaagaactgggatggcagccctgtgtcctcctggatcctgctggccgagagcaacagcgcagatgatgaaacagatgacccccggcgctaccagaagtatggctacatcggcacccatgagtacccccacttcagccaccggcccagcaccctgcaggccgccagcaccccccaggccgaggaggactggacctgcaccatcctgtag

SEQ ID NO: 141884 - DNA, 1146 bp, Artificial Sequence
  Description of Artificial Sequence: Synthetic coding sequence
atgatggacctgaggaacaccccagccaagagcctggacaagttcatcgaggactacctgctgcctgacacctgcttcaggatgcagatcaaccacgccatcgacatcatctgtggcttcctgaaggagcgctgcttccggggcagcagctaccctgtgtgtgtgtccaaggtggtgaagggcggcagcagcggcaagggcaccaccctgcggggccgcagtgatgctgacctggtggtgttcctgagccccctgaccaccttccaggaccagctgaacagaagaggagagttcatccaggagatccggcggcagctggaggcctgccagcgggagcgggccttctctgtgaagtttgaggtgcaggccccccgctggggcaacccccgggccctgagctttgtgctgagcagcctgcagctgggggagggcgtggagtttgatgtgctgcctgcctttgatgccctgggccagctgaccggcggctacaagcccaacccccagatctacgtgaagctgattgaggagtgcacagacctgcagaaggagggggagttcagcacctgcttcacagagctgcagagggacttcctgaagcagaggcccaccaagctgaagagcctcatccggctggtgaagcactggtaccagaactgcaagaagaagctgggcaagctgcccccccagtatgccctggagctgctgactgtgtatgcctgggagcggggctccatgaagacccacttcaacacagcccagggcttcagaacagtgctggagctggtgatcaactaccagcagctgtgcatctactggaccaagtactatgacttcaagaaccccatcatcgagaagtacctgcggcggcagctgaccaagcccaggcctgtgatcctggaccctgctgaccccactggaaacctgggcggcggggaccccaagggctggaggcagctggcccaggaggccgaggcctggctgaactacccctgcttcaagaactgggatggcagccctgtgtcctcctggatcctgctggtgaacctgaccctggtgggcagaagaaactacatcatcagcgagcacgctgtgaacctgcagcagaccaggggggccagcctgagctacagcttccaggtggcctag

SEQ ID NO: 141885 - DNA, 1245 bp, Artificial Sequence
  Description of Artificial Sequence: Synthetic coding sequence
atgatggacctgaggaacaccccagccaagagcctggacaagttcatcgaggactacctgctgcctgacacctgcttcaggatgcagatcaaccacgccatcgacatcatctgtggcttcctgaaggagcgctgcttccggggcagcagctaccctgtgtgtgtgtccaaggtggtgaagggcggcagcagcggcaagggcaccaccctgcggggccgcagtgatgctgacctggtggtgttcctgagccccctgaccaccttccaggaccagctgaacagaagaggagagttcatccaggagatccggcggcagctggaggcctgccagcgggagcgggccttctctgtgaagtttgaggtgcaggccccccgctggggcaacccccgggccctgagctttgtgctgagcagcctgcagctgggggagggcgtggagtttgatgtgctgcctgcctttgatgccctgggccagctgaccggcggctacaagcccaacccccagatctacgtgaagctgattgaggagtgcacagacctgcagaaggagggggagttcagcacctgcttcacagagctgcagagggacttcctgaagcagaggcccaccaagctgaagagcctcatccggctggtgaagcactggtaccagaactgcaagaagaagctgggcaagctgcccccccagtatgccctggagctgctgactgtgtatgcctgggagcggggctccatgaagacccacttcaacacagcccagggcttcagaacagtgctggagctggtgatcaactaccagcagctgtgcatctactggaccaagtactatgacttcaagaaccccatcatcgagaagtacctgcggcggcagctgaccaagcccaggcctgtgatcctggaccctgctgaccccactggaaacctgggcggcggggaccccaagggctggaggcagctggcccaggaggccgaggcctggctgaactacccctgcttcaagaactgggatggcagccctgtgtcctcctggatcctgctgacccagcacaccccaggcagcatccaccccactggaagaagaggcctggacctgcaccaccccctgaatgccagcgcctcctggggcaagggcctgcagtgctacctggaccagttcctgcacttccaggtgggcctgctgatccagaggggccagagcagctctgtgtcctggtgcatcatccaggacaggacccaggtgtcctag

SEQ ID NO: 141886 - DNA, 1095 bp, Artificial Sequence
  Description of Artificial Sequence: Synthetic coding sequence
atgatggacctgaggaacaccccagccaagagcctggacaagttcatcgaggactacctgctgcctgacacctgcttcaggatgcagatcaaccacgccatcgacatcatctgtggcttcctgaaggagcgctgcttccggggcagcagctaccctgtgtgtgtgtccaaggtggtgaagggcggcagcagcggcaagggcaccaccctgcggggccgcagtgatgctgacctggtggtgttcctgagccccctgaccaccttccaggaccagctgaacagaagaggagagttcatccaggagatccggcggcagctggaggcctgccagcgggagcgggccttctctgtgaagtttgaggtgcaggccccccgctggggcaacccccgggccctgagctttgtgctgagcagcctgcagctgggggagggcgtggagtttgatgtgctgcctgcctttgatgccctgggccagctgaccggcggctacaagcccaacccccagatctacgtgaagctgattgaggagtgcacagacctgcagaaggagggggagttcagcacctgcttcacagagctgcagagggacttcctgaagcagaggcccaccaagctgaagagcctcatccggctggtgaagcactggtaccagaactgcaagaagaagctgggcaagctgcccccccagtatgccctggagctgctgactgtgtatgcctgggagcggggctccatgaagacccacttcaacacagcccagggcttcagaacagtgctggagctggtgatcaactaccagcagctgtgcatctactggaccaagtactatgacttcaagaaccccatcatcgagaagtacctgcggcggcagctgaccaagcccaggcctgtgatcctggaccctgctgaccccactggaaacctgggcggcggggaccccaagggctggaggcagctggcccaggaggccgaggcctggctgaactacccctgcttcaagaactgggatggcagccctgtgtcctcctggatcctgctggtgcggcccccagccagcagcctgcccttcatcccagcccccctgcacgaggcctag

SEQ ID NO: 141887 - DNA, 2160 bp, Artificial Sequence
  Description of Artificial Sequence: Synthetic coding sequence
atgggaaatggagagagccagctgagctctgtgcctgcccagaagctgggctggttcatccaggagtacctgaagccctatgaggagtgccagaccctgattgatgagatggtgaacaccatctgtgatgtgctgcaggagcctgagcagttccccctggtgcagggcgtggccatcggcggcagctatggcaggaagacagtgctgcggggcaacagtgatggcaccctggtgctcttcttcagtgacctgaagcagttccaggaccagaagaggagccagagggacatcctggacaagacaggagacaagctgaagttctgcctcttcaccaagtggctgaagaacaactttgagatccagaagagcctggatggcttcaccatccaggtgttcaccaagaaccagaggatcagctttgaggtgctggccgccttcaatgccctgagcctgaatgacaaccccagcccctggatctaccgggagctgaagaggagcctggacaagaccaatgccagccctggagaatttgctgtgtgcttcacagagctgcagcagaagttctttgacaacagacctgggaagctgaaggacctgatcctgctgatcaagcactggcaccagcagtgccagaagaagatcaaggacctgcccagcctgagcccctatgccctggagctgctgactgtgtatgcctgggagcagggctgcaggaaggacaactttgatattgctgagggcgtgaggacagtgctggagctgatcaagtgccaggagaagctgtgcatctactggatggtgaactacaactttgaagatgagaccatccggaacatcctgctgcaccagctgcagagcgcccggcctgtgatcctggaccctgtggaccccaccaacaacgtgtctggggacaagatctgctggcagtggctgaagaaggaggcccagacctggctgaccagccccaacctggacaatgagctgcctgcccccagctggaatgtgctgcctgcccccctcttcaccaccccaggccacctgctggacaagttcatcaaggagttcctgcagcccaacaagtgcttcctggagcagattgacagcgctgtgaacatcatccgcaccttcctgaaggagaactgcttccggcagagcacagccaagatccagatcgtgcggggcggcagcacagccaagggcacagccctgaagacaggcagtgatgctgacctggtggtgttccacaacagcctgaagagctacaccagccagaagaatgaaagacacaagatcgtgaaggagatccacgagcagctgaaggccttctggagggagaaggaggaggagctggaggtgtcctttgagccccccaagtggaaggccccccgggtgctgtccttcagcctgaagagcaaggtgctgaatgaatctgtgtcctttgatgtgctgcctgccttcaatgccctgggccagctgagcagcggcagcacccccagccctgaggtgtatgccggcctgattgacctgtacaagagcagtgacctgcccggcggggagttcagcacctgcttcaccgtgctgcagaggaacttcatccgcagccggcccaccaagctgaaggacctgatccggctggtgaagcactggtacaaggaatgtgagaggaagctgaagcccaagggcagcctgccccccaagtatgccctggagctgctgaccatctatgcctgggagcagggcagcggcgtgcctgactttgacacagctgagggcttcagaacagtgctggagctggtgacccagtaccagcagctgtgcatcttctggaaggtgaactacaactttgaagatgaaacagtgaggaagttcctgctgagccagctgcagaagaccaggcctgtgatcctggaccctgctgagcccactggagatgtgggcggcggggaccgctggtgctggcacctgctggccaaggaggccaaggagtggctgagcagcccctgcttcaaggatggcactggaaaccccatccccccctggaaggtgcccaccatgcagaccccaggcagctgtggggcccgcatccaccccatcgtgaatgagatgttcagcagccgcagccaccgcatcctgaacaacaacagcaagaggaacttctag

SEQ ID NO: 141888 - DNA, 2064 bp, Artificial Sequence
  Description of Artificial Sequence: Synthetic coding sequence
atgggaaatggagagagccagctgagctctgtgcctgcccagaagctgggctggttcatccaggagtacctgaagccctatgaggagtgccagaccctgattgatgagatggtgaacaccatctgtgatgtgctgcaggagcctgagcagttccccctggtgcagggcgtggccatcggcggcagctatggcaggaagacagtgctgcggggcaacagtgatggcaccctggtgctcttcttcagtgacctgaagcagttccaggaccagaagaggagccagagggacatcctggacaagacaggagacaagctgaagttctgcctcttcaccaagtggctgaagaacaactttgagatccagaagagcctggatggcttcaccatccaggtgttcaccaagaaccagaggatcagctttgaggtgctggccgccttcaatgccctgagcctgaatgacaaccccagcccctggatctaccgggagctgaagaggagcctggacaagaccaatgccagccctggagaatttgctgtgtgcttcacagagctgcagcagaagttctttgacaacagacctgggaagctgaaggacctgatcctgctgatcaagcactggcaccagcagtgccagaagaagatcaaggacctgcccagcctgagcccctatgccctggagctgctgactgtgtatgcctgggagcagggctgcaggaaggacaactttgatattgctgagggcgtgaggacagtgctggagctgatcaagtgccaggagaagctgtgcatctactggatggtgaactacaactttgaagatgagaccatccggaacatcctgctgcaccagctgcagagcgcccggcctgtgatcctggaccctgtggaccccaccaacaacgtgtctggggacaagatctgctggcagtggctgaagaaggaggcccagacctggctgaccagccccaacctggacaatgagctgcctgcccccagctggaatgtgctgcctgcccccctcttcaccaccccaggccacctgctggacaagttcatcaaggagttcctgcagcccaacaagtgcttcctggagcagattgacagcgctgtgaacatcatccgcaccttcctgaaggagaactgcttccggcagagcacagccaagatccagatcgtgcggggcggcagcacagccaagggcacagccctgaagacaggcagtgatgctgacctggtggtgttccacaacagcctgaagagctacaccagccagaagaatgaaagacacaagatcgtgaaggagatccacgagcagctgaaggccttctggagggagaaggaggaggagctggaggtgtcctttgagccccccaagtggaaggccccccgggtgctgtccttcagcctgaagagcaaggtgctgaatgaatctgtgtcctttgatgtgctgcctgccttcaatgccctgggccagctgagcagcggcagcacccccagccctgaggtgtatgccggcctgattgacctgtacaagagcagtgacctgcccggcggggagttcagcacctgcttcaccgtgctgcagaggaacttcatccgcagccggcccaccaagctgaaggacctgatccggctggtgaagcactggtacaaggaatgtgagaggaagctgaagcccaagggcagcctgccccccaagtatgccctggagctgctgaccatctatgcctgggagcagggcagcggcgtgcctgactttgacacagctgagggcttcagaacagtgctggagctggtgacccagtaccagcagctgtgcatcttctggaaggtgaactacaactttgaagatgaaacagtgaggaagttcctgctgagccagctgcagaagaccaggcctgtgatcctggaccctgctgagcccactggagatgtgggcggcggggaccgctggtgctggcacctgctggccaaggaggccaaggagtggctgagcagcccctgcttcaaggatggcactggaaaccccatccccccctggaaggtgcctgtgaaggtgatctag

SEQ ID NO: 141889 - DNA, 519 bp, Artificial Sequence
  Description of Artificial Sequence: Synthetic coding sequence
atgggaaatggagagagccagctgagctctgtgcctgcccagaagctgggctggttcatccaggagtacctgaagccctatgaggagtgccagaccctgattgatgagatggtgaacaccatctgtgatgtgctgcaggagcctgagcagttccccctggtgcagggcgtggccatcggcggcagctatggcaggaagacagtgctgcggggcaacagtgatggcaccctggtgctcttcttcagtgacctgaagcagttccaggaccagaagaggagccagagggacatcctggacaagacaggagacaagctgaagttctgcctcttcaccaagtggctgaagaacaactttgagatccagaagagcctggatggcttcaccatccaggtgttcaccaagaaccagaggatcagctttgaggtgctggccgccttcaatgccctgagcaagcactgctgggtgtctggagagaagagccagaggagcggctgccagacagccctgtgcaacctgtag

SEQ ID NO: 141890 - DNA, 1053 bp, Artificial Sequence
  Description of Artificial Sequence: Synthetic coding sequence
atggccaccgtgggcgcccccaggcacttctgccgctgtgcctgcttctgcacagacaacctgtatgtggcccgctatggcctgcacgtgcgcttccggggggagcagcagctgcggcgggactatggccccatcctgcggagccggggctgtgtgtctgccaaggacttccagcagctgctggccgagctggagcaggaggtggagcggcggcagaggctgggccaggagagcgctgccaggaaggccctgattgccagcagctaccacccagcccggcctgaggtgtatgacagcctgcaggatgctgccctggcccctgagttcctggccgtgacagagtacagcgtgtccccagatgctgacctgaagggcctgctgcagaggctggagaccgtgtctgaggagaagaggatctacagagtgcctgtgttcaccgcccccttctgccaggccctgctggaggagctggagcactttgagcagagcgacatgcccaagggccggcccaacaccatgaacaactacggcgtgctgctgcacgagctgggcctggatgagcccctgatgacccccctgcgggagcgcttcctgcagcccctgatggccctgctgtacccagactgtggcggcggccgcctggacagccaccgggcctttgtggtgaagtatgcccctggccaggacctggagctgggctgccactatgacaatgctgagctgaccctgaatgtggccctgggcaaggtgttcaccggcggggccctgtactttggaggcctcttccaggcccccacagccctgacagagcccctggaggtggagcacgtggtgggccagggcgtgctgcaccggggcggccagctgcacggggcccggcccctgggcactggagagcgctggaacctggtggtgtggctgcgggccagcgctgtgaggaacagcctgtgccccatgtgctgccgggagccagacctggtggatgatgagggctttggagatggcttcacccgggaggagcccgccaccgtggatgtgtgtgccctgacctag

SEQ ID NO: 141891 - DNA, 3261 bp, Artificial Sequence
  Description of Artificial Sequence: Synthetic coding sequence
atggacctgtacagcaccccagctgctgccctggacagatttgtggcccggcggctgcagcccaggaaggagtttgtggagaaggcccggcgggccctgggcgccctggccgccgccctgcgggagcggggcggccgcctgggcgccgccgccccccgggtgctgaagacagtgaagggcggcagcagcggccggggcacagccctgaagggcggctgtgacagcgagctggtgatcttcctggactgcttcaagagctatgtggaccagagggccaggagagctgagatcctgtctgagatgagggccagcctggagagctggtggcagaaccctgtgcccggcctgcggctgaccttccctgagcagagcgtgcctggggccctgcagttccggctgacctctgtggacctggaggactggatggatgtgtccctggtgcctgccttcaacgtgctgggccaggccggcagcggcgtgaagcccaagccccaggtgtacagcaccctgctgaacagcggctgccagggcggggagcacgccgcctgcttcacagagctgcggaggaactttgtgaacatccggcctgccaagctgaagaacctgatcctgctggtgaagcactggtaccaccaggtgtgcctgcagggcctgtggaaggagaccctgccccctgtgtatgccctggagctgctgaccatctttgcctgggagcagggctgcaagaaggatgccttcagcctggccgagggcctgaggacagtgctgggcctcatccagcagcaccagcacctgtgtgtgttctggacagtgaactacggctttgaggaccctgctgtgggccagttcctgcagaggcagctgaagaggcccaggcctgtgatcctggaccctgctgaccccacctgggacctgggcaatggagctgcctggcactgggacctgctggcccaggaggccgccagctgctatgaccacccctgcttcctgcggggcatgggagaccctgtgcagagctggaagggccctggcctgccccgggccggctgcagcggcctgggccaccccatccagctggaccccaaccagaagaccccagagaacagcaagagcctgaatgctgtgtaccccagggctggcagcaagccacccagctgcccagcccctggccccaccggccagcctgccagcagctctgtgcccggcatggccctggacctgagccagatccccaccaaggagctggaccgcttcatccaggaccacctgaagcccagcccccagttccaggagcaggtgaagaaggccatcgacatcatcctgcgctgcctgcacgagaactgtgtgcacaaggccagccgggtgtccaaaggaggcagctttggccggggcacagacctgagagatggctgtgatgtggagctgatcatcttcctgaactgcttcacagactacaaggaccagggccccaggagagctgagatcctggatgagatgagggcccagctggagagctggtggcaggaccaggtgcccagcctgagcctgcagtttcctgagcagaatgtgcctgaggccctgcagttccagctggtgtccacagccctgaagtcctggacagatgtgtccctgctgcctgcctttgatgctgtgggccagctgagcagcggcaccaagcccaacccccaggtgtacagccggctgctgaccagcggctgccaggagggggagcacaaggcctgctttgctgagctgcggaggaacttcatgaacatccggcctgtgaagctgaagaacctgatcctgctggtgaagcactggtaccggcaggtggccgcccagaacaagggcaagggccctgccccagccagcctgcccccagcctatgccctggagctgctgaccatctttgcctgggagcagggctgccggcaggactgcttcaacatggcccagggcttcagaacagtgctgggcctggtgcagcagcaccagcagctgtgtgtgtactggacagtgaactacagcacagaggaccctgccatgaggatgcacctgctgggccagctgaggaagccccggcccctggtgctggaccctgctgaccccacctggaatgtgggccacggctcctgggagctgctggcccaggaggccgccgccctgggcatgcaggcctgcttcctgagcagagatggcacctctgtgcagccctgggatgtgatgcctgccctgctgtaccagaccccagctggggacctggacaagttcatcagcgagttcctgcagcccaaccggcagttcctggcccaggtgaacaaggctgtggacaccatctgcagcttcctgaaggagaactgcttcaggaacagccccatcaaggtgatcaaggtggtgaagggcggcagcagcgccaagggcacagccctgcggggccgcagtgatgctgacctggtggtgttcctgagctgcttcagccagttcacagagcagggcaacaagagagctgagatcatcagcgagatccgggcccagctggaggcctgccagcaggagcggcagtttgaggtgaagtttgaggtgtccaagtgggagaacccccgggtgctgtccttcagcctgaccagccagaccatgctggaccagagcgtggactttgatgtgctgcctgcctttgatgccctgggccagctggtgtctggcagccggcccagcagccaggtgtatgtggacctgatccacagctacagcaatgctggggagtacagcacctgcttcacagagctgcagagggacttcatcatcagccggcccaccaagctgaagagcctcatccggctggtgaagcactggtaccagcagtgcaccaagatcagcaagggccggggcagcctgcccccccagcacggcctggagctgctgactgtgtatgcctgggagcagggcggcaaggacagccagttcaacatggccgagggcttcagaacagtgctggagctggtgacccagtaccggcagctgtgcatctactggaccatcaactacaatgccaaggacaagacagtgggggacttcctgaagcagcagctgcagaagccccggcccatcatcctggaccctgctgaccccaccggcaacctgggccacaatgcccgctgggacctgctggccaaggaggccgccgcctgcaccagcgccctgtgctgcatgggcagaaatggcatccccatccagccctggcctgtgaaggctgctgtgtag

SEQ ID NO: 141892 - DNA, 1545 bp, Artificial Sequence
  Description of Artificial Sequence: Synthetic coding sequence
atggccctgatgcaggagctgtacagcaccccagccagccggctggacagctttgtggcccagtggctgcagccccaccgggagtggaaggaggaggtgctggatgctgtgaggacagtggaggagttcctgcggcaggagcacttccagggcaagaggggcctggaccaggatgtgcgggtgctgaaggtggtgaaggtgggcagctttggaaatggcaccgtgctgcggagcacccgggaggtggagctggtggccttcctgagctgcttccacagcttccaggaggccgccaagcaccacaaggatgtgctgcggctcatctggaagaccatgtggcagagccaggacctgctggacctgggcctggaggacctgaggatggagcagagggtgcctgatgccctggtgttcaccatccagacccggggcacagctgagcccatcaccgtgaccatcgtgcctgcctaccgggccctgggccccagcctgcccaacagccagcccccacctgaggtgtatgtgtccctcatcaaggcctgtggcggccctggcaacttctgccccagcttcagcgagctgcagaggaactttgtgaagcaccggcccaccaagctgaagagcctgctgcggctggtgaagcactggtaccagcagtatgtgaaggcccggagcccccgggccaacctgccccccctgtatgccctggagctgctgaccatctatgcctgggagatgggcacagaggaggatgagaacttcatgctggatgagggcttcaccaccgtgatggacctgctgctggagtatgaggtgatctgcatctactggaccaagtactacaccctgcacaatgccatcatcgaggactgtgtgaggaagcagctgaagaaggagcggcccatcatcctggaccctgctgaccccaccctgaatgtggccgagggctaccgctgggacatcgtggcccagagggccagccagtgcctgaagcaggactgctgctatgacaaccgggagaaccccatcagctcctggaatgtgaagagggcccgggacatccacctgactgtggagcagaggggctacccagacttcaacctgattgtgaacccctatgagcccatcaggaaggtgaaggagaagatccggaggacccggggctacagcggcctgcagaggctgtccttccaggtgcccggcagcgagcggcagctgctgagcagccgctgcagcctggccaagtatggcatcttcagccacacccacatctacctgctggagaccatccccagcgagatccaggtgtttgtgaagaacccagatggcggcagctatgcctatgccatcaaccccaacagcttcatcctgggcctgaagcagcagatcgaggaccagcagggcctgcccaagaagcagcagcagctggagttccagggccaggtgctgcaggactggctgggcctgggcatctacggcatccaggacagcgacaccctcatcctgagcaagaagaagggggaggccctcttccctgccagctag

SEQ ID NO: 141893 - DNA, 768 bp, Artificial Sequence
  Description of Artificial Sequence: Synthetic coding sequence
atggccctgatgcaggagctgtacagcaccccagccagccggctggacagctttgtggcccagtggctgcagccccaccgggagtggaaggaggaggtgctggatgctgtgaggacagtggaggagttcctgcggcaggagcacttccagggcaagaggggcctggaccaggatgtgcgggtgctgaaggtggtgaaggtgggcagctttggaaatggcaccgtgctgcggagcacccgggaggtggagctggtggccttcctgagctgcttccacagcttccaggaggccgccaagcaccacaaggatgtgctgcggctcatctggaagaccatgtggcagagccaggacctgctggacctgggcctggaggacctgaggatggagcagagggtgcctgatgccctggtgttcaccatccagacccggggcacagctgagcccatcaccgtgaccatcgtgcctgcctaccgggccctgggccccagcctgcccaacagccagcccccacctgaggtgtatgtgtccctcatcaaggcctgtggcggccctggcaacttctgccccagcttcagcgagctgcagaggaactttgtgaagcaccggcccaccaagctgaagagcctgctgcggctggtgaagcactggtaccagcaggcccaccaccctggcagcggccggccccacccccagaggggccggcgggtgcagatgggccaccgctgcagcgagggcctgcctgtgcctgagaccggcctgctgctgtag

SEQ ID NO: 141894 - DNA, 1737 bp, Artificial Sequence
  Description of Artificial Sequence: Synthetic coding sequence
atgccagacagcaactttgctgagaggtctgaggagcaggtgtctggggccaaggtgattgcccaggccctgaagacccaggatgtggagtacatctttggaattgtgggcatccctgtgacagaaattgccatcgccgcccagcagctgggcatcaagtacatcggcatgagaaatgagcaggccgcctgctacgccgccagcgccatcggctacctgaccagcaggcctggggtgtgcctggtggtgtctggccctggcctcatccacgccctgggcggcatggccaatgccaacatgaactgctggcccctgctggtgattggaggcagcagcgagaggaaccaggagaccatgggcgccttccaggagttcccccaggtggaggcctgccgcctgtacaccaagttcagcgcccggcccagcagcattgaggccatcccctttgtgattgagaaggctgtgcgcagcagcatctacggccggcctggggcctgctacgtggacatcccagctgactttgtgaacctgcaggtgaatgtgaacagcatcaagtacatggagcgctgcatgagcccccccatctccatggccgagaccagcgctgtgtgcacagctgccagcgtcatcagaaatgccaagcagcccctgctgatcatcggcaagggggccgcctatgcccatgctgaggagagcatcaagaagctggtggagcagtacaagctgcccttcctgcccacccccatgggcaaaggagtggtgcctgacaaccacccctactgtgtgggcgccgcccggagccgggccctgcagtttgctgatgtgattgtgctgtttggagcccggctgaactggatcctgcacttcggcctgcccccacgctaccagccagatgtgaagttcatccaggtggacatctgtgccgaggagctgggcaacaacgtgaagccagctgtgaccctgctgggcaacatccatgctgtgaccaagcagctgctggaggagctggacaagaccccctggcagtacccacctgagagcaagtggtggaagaccctgcgggagaagatgaagagcaatgaggccgccagcaaggagctggccagcaagaagagcctgcccatgaactactacacagtgttctaccacgtgcaggagcagctgccccgggactgctttgtggtgtctgagggcgccaacaccatggacatcggccgcacagtgctgcagaactacctgcccaggcaccggctggatgctggcaccttcggcaccatgggcgtgggcctgggctttgccatcgctgctgctgtggtggccaaggacaggagccctggccagtggatcatctgtgtggagggggacagcgccttcggcttcagcggcatggaggtggagaccatctgccgctacaacctgcccatcatcctgctggtggtgaacaacaacggcatctaccagggctttgacacagacacctggaaggagatgctgaagttccaggatgccacagctgtggtgccccccatgtgcctgctgcccaacagccactatgagcaggtgatgacagcctttggaggcaagggctactttgtgcagaccccagaggagctgcagaagagcctgcggcagagcctggccgacaccaccaagcccagcctcatcaacatcatgattgagccccaggccaccaggaaggcccaggacttccactggctgaccaggagcaacatgtag

SEQ ID NO: 141895 - DNA, 1563 bp, Artificial Sequence
  Description of Artificial Sequence: Synthetic coding sequence
atgcctggcagcctgcccctgaatgctgaggcctgctggcccaaggatgtgggcatcgtggccctggagatctacttccccagccagtatgtggaccaggccgagctggagaagtatgatggagtggatgctgggaagtacaccatcggcctgggccaggccaagatgggcttctgcacagaccgggaggacatcaacagcctgtgcatgacagtggtgcagaacctgatggagaggaacaacctgtcctatgactgcatcggccgcctggaggtgggcacagagaccatcatcgacaagagcaagtctgtgaagaccaacctgatgcagctgtttgaggagagcggcaacacagacatcgagggcatcgacaccaccaatgcctgctacggcggcacagctgctgtgttcaatgctgtgaactggattgagagcagctcctgggatggccgctatgccctggtggtggccggggacattgctgtgtatgccactggaaatgcccggcccactggaggagtgggcgctgtggccctgctgattggccccaatgcccccctcatctttgagcggggcctgcggggcacccacatgcagcacgcctatgacttctacaagccagacatgctgtctgagtaccccatcgtggatggcaagctgagcatccagtgctacctgagcgccctggaccgctgctacagcgtgtactgcaagaagatccacgcccagtggcagaaggagggcaatgacaaggacttcaccctgaatgactttggcttcatgatcttccacagcccctactgcaagctggtgcagaagagcctggccaggatgctgctgaatgacttcctgaatgaccagaacagagacaagaacagcatctacagcggcctggaggcctttggagatgtgaagctggaggacacctactttgacagagatgtggagaaggccttcatgaaggccagcagcgagctgttcagccagaagaccaaggccagcctgctggtgagcaaccagaatggaaacatgtacaccagctctgtgtatggcagcctggcctctgtgctggcccagtacagcccccagcagctggccggcaagagaattggagtcttctcctatggcagcggcctggccgccaccctgtacagcctgaaggtgacccaggatgccaccccaggcagcgccctggacaagatcacagccagcctgtgtgacctgaagagccggctggacagcaggactggagtggccccagatgtgtttgctgagaacatgaagctgcgggaggacacccaccacctggtgaactacatcccccagggcagcattgacagcctgtttgagggcacctggtacctggtgcgggtggatgagaagcacaggaggacctacgcccggcggcccaccccaaatgatgacaccctggatgagggcgtgggcctggtgcacagcaacatcgccacagagcacatccccagccctgccaagaaggtgccccggctgcctgccacagctgctgagcctgaggccgctgtgatcagcaatggagagcactag

SEQ ID NO: 141896 - DNA, 1563 bp, Artificial Sequence; identical to SEQ ID NO: 141895
  Description of Artificial Sequence: Synthetic coding sequence

SEQ ID NO: 141897 - DNA, 291 bp, Artificial Sequence
  Description of Artificial Sequence: Synthetic coding sequence
atgcctggcagcctgcccctgaatgctgaggcctgctggcccaaggatgtgggcatcgtggccctggagatctacttccccagccagtatgtggaccaggccgagctggagaagtatgatggagtggatgctgggaagtacaccatcggcctgggccaggccaagatgggcttctgcacagaccgggaggacatcaacagcctgtgcatgacagtggtgcagaacctgatggagaggaacaacctgtcctatgactgcatcggccgcctggaggtgggcacagagacctag

SEQ ID NO: 141898 - DNA, 1530 bp, Artificial Sequence
  Description of Artificial Sequence: Synthetic coding sequence
atgcctggcagcctgcccctgaatgctgaggcctgctggcccaaggatgtgggcatcgtggccctggagatctacttccccagccagtatgtggaccaggccgagctggagaagtatgatggagtggatgctgggaagtacaccatcggcctgggccaggccaagatgggcttctgcacagaccgggaggacatcaacagcctgtgcatgacagtggtgcagaacctgatggagaggaacaacctgtcctatgactgcatcggccgcctggaggtgggcacagagaccatcatcgacaagagcaagtctgtgaagaccaacctgatgcagctgtttgaggagagcggcaacacagacatcgagggcatcgacaccaccaatgctgtgaactggattgagagcagctcctgggatggccgctatgccctggtggtggccggggacattgctgtgtatgccactggaaatgcccggcccaccggcggcgtgggcgctgtggccctgctgattggccccaatgcccccctcatctttgagcggggcctgcggggcacccacatgcagcacgcctatgacttctacaagccagacatgctgtctgagtaccccatcgtggatggcaagctgagcatccagtgctacctgagcgccctggaccgctgctacagcgtgtactgcaagaagatccacgcccagtggcagaaggagggcaatgacaaggacttcaccctgaatgactttggcttcatgatcttccacagcccctactgcaagctggtgcagaagagcctggccaggatgctgctgaatgacttcctgaatgaccagaacagagacaagaacagcatctacagcggcctggaggcctttggagatgtgaagctggaggacacctactttgacagagatgtggagaaggccttcatgaaggccagcagcgagctgttcagccagaagaccaaggccagcctgctggtgagcaaccagaatggaaacatgtacaccagctctgtgtatggcagcctggcctctgtgctggcccagtacagcccccagcagctggccggcaagagaattggagtcttctcctatggcagcggcctggccgccaccctgtacagcctgaaggtgacccaggatgccaccccaggcagcgccctggacaagatcacagccagcctgtgtgacctgaagagccggctggacagcaggactggagtggccccagatgtgtttgctgagaacatgaagctgcgggaggacacccaccacctggtgaactacatcccccagggcagcattgacagcctgtttgagggcacctggtacctggtgcgggtggatgagaagcacaggaggacctacgcccggcggcccaccccaaatgatgacaccctggatgaaggagtgggcctggtgcacagcaacatcgccacagagcacatccccagccctgccaagaaggtgccccggctgcctgccacagctgctgagcctgaggccgccgtcatcagcaatggagagcactag

SEQ ID NO: 141899 - DNA, 1527 bp, Artificial Sequence
  Description of Artificial Sequence: Synthetic coding sequence
atgcagaggctgctgacccctgtgaagaggatcctgcagctgaccagggctgtgcaggagaccagcctgaccccagcccggctgctgcctgtggcccaccagcgcttcagcacagccagcgctgtgcccctggccaagacagacacctggcccaaggatgtgggcatcctggccctggaggtgtacttccctgcccagtatgtggaccagacagacctggagaagtacaacaacgtggaggccggcaagtacacagtgggcctgggccagaccaggatgggcttctgcagcgtgcaggaggacatcaacagcctgtgcctgactgtggtgcagaggctgatggagcgcatccagctgccctgggacagcgtgggccgcctggaggtgggcacagagaccatcatcgacaagagcaaggctgtgaagacagtgctgatggagctgttccaggacagcggcaacacagacatcgagggcatcgacaccaccaatgcctgctatggaggaacagccagcctcttcaatgctgccaactggatggagagcagctcctgggatggccgctatgccatggtggtgtgtggggacattgctgtgtaccccagcggaaatgcccggcccaccggcggggccggggctgtggccatgctgattggccccaaggcccccctggccctggagcggggcctgcggggcacccacatggagaatgtgtatgacttctacaagcccaacctggccagcgagtaccccatcgtggatggcaagctgagcatccagtgctacctgcgggccctggaccgctgctacaccagctacaggaagaagatccagaaccagtggaagcaggccggcagtgaccggcccttcaccctggatgacctgcagtacatgatcttccacacccccttctgcaagatggtgcagaagagcctggcccggctgatgtttaatgacttcctgagcgccagcagtgacacccagaccagcctgtacaagggcctggaggccttcggcggcctgaagctggaggacacctacaccaacaaggacctggacaaggccctgctgaaggccagccaggacatgtttgacaagaagaccaaggccagcctgtacctgagcacccacaacggcaacatgtacaccagcagcctgtatggctgcctggccagcctgctgagccaccacagcgcccaggagctggccggcagcagaattggagccttctcctatggcagcggcctggccgccagcttcttctccttccgggtgtcccaggatgctgcccctggcagccccctggacaagctggtgagcagcaccagtgacctgcccaagaggctggccagcaggaaatgtgtgtccccagaggagttcacagagatcatgaaccagcgggagcagttctaccacaaggtgaacttcagccccccaggggacaccaacagcctcttccctggcacctggtacctggagcgggtggatgagcagcacaggaggaaatatgcccggcggcctgtgtag

SEQ ID NO: 141900 - DNA, 1401 bp, Artificial Sequence
  Description of Artificial Sequence: Synthetic coding sequence
atgcagaggctgctgacccctgtgaagaggatcctgcagctgaccagggctgtgcaggagaccagcctgaccccagcccggctgctgcctgtggcccaccagcgcttcagcacagccagcgctgtgcccctggccaagacagacacctggcccaaggatgtgggcatcctggccctggaggtgtacttccctgcccagtatgtggaccagacagacctggagaagtacaacaacgtggaggccggcaagtacacagtgggcctgggccagaccaggatgggcttctgcagcgtgcaggaggacatcaacagcctgtgcctgactgtggtgcagaggctgatggagcgcatccagctgccctgggacagcgtgggccgcctggaggtgggcacagagaccatcatcgacaagagcaaggctgtgaagacagtgctgatggagctgttccaggacagcggcaacacagacatcgagggcatcgacaccaccaatgcctgctatggaggaacagccagcctcttcaatgctgccaactggatggagagcagctcctgggatggcctgcggggcacccacatggagaatgtgtatgacttctacaagcccaacctggccagcgagtaccccatcgtggatggcaagctgagcatccagtgctacctgcgggccctggaccgctgctacaccagctacaggaagaagatccagaaccagtggaagcaggccggcagtgaccggcccttcaccctggatgacctgcagtacatgatcttccacacccccttctgcaagatggtgcagaagagcctggcccggctgatgtttaatgacttcctgagcgccagcagtgacacccagaccagcctgtacaagggcctggaggccttcggcggcctgaagctggaggacacctacaccaacaaggacctggacaaggccctgctgaaggccagccaggacatgtttgacaagaagaccaaggccagcctgtacctgagcacccacaacggcaacatgtacaccagcagcctgtatggctgcctggccagcctgctgagccaccacagcgcccaggagctggccggcagcagaattggagccttctcctatggcagcggcctggccgccagcttcttctccttccgggtgtcccaggatgctgcccctggcagccccctggacaagctggtgagcagcaccagtgacctgcccaagaggctggccagcaggaaatgtgtgtccccagaggagttcacagagatcatgaaccagcgggagcagttctaccacaaggtgaacttcagccccccaggggacaccaacagcctcttccctggcacctggtacctggagcgggtggatgagcagcacaggaggaaatatgcccggcggcctgtgtag

SEQ ID NO: 141901 - DNA, 1161 bp, Artificial Sequence
  Description of Artificial Sequence: Synthetic coding sequence
atgggccagcgggagatgtggaggctgatgagccgcttcaatgccttcaagaggaccaacaccatcctgcaccacctgaggatgagcaagcacacagatgctgctgaggaggtgctgctggagaagaagggctgcaccggggtcatcaccctgaaccggcccaagttcctgaatgccctgaccctgaacatgatccggcagatctacccccagctgaagaagtgggagcaggaccctgagaccttcctgatcatcatcaagggagctgggggcaaggccttctgtgccggcggggacatccgggtcatcagcgaggccgagaaggccaagcagaagatcgcccctgtgttcttccgggaggagtacatgctgaacaatgctgtgggcagctgccagaagccctacgtggccctgatccacggcatcaccatgggcggcggcgtgggcctgtctgtgcacggccagttccgggtggccacagagaagtgcctgtttgccatgcctgagacagccatcggcctcttcccagatgtgggcggcggctacttcctgccccggctgcagggcaagctgggctacttcctggccctgaccggcttccggctgaagggcagagatgtgtaccgggccggcatcgccacccactttgtggacagcgagaagctggccatgctggaggaggacctgctggccctgaagagccccagcaaggagaacatcgcctctgtgctggagaactaccacacagagagcaagattgaccgggacaagagcttcatcctggaggagcacatggacaagatcaacagctgcttcagcgccaacacagtggaggagatcatcgagaacctgcagcaggacggcagcagctttgccctggagcagctgaaggtgatcaacaagatgagccccaccagcctgaagatcaccctgcggcagctgatggagggcagcagcaagaccctgcaggaggtgctgaccatggagtaccgcctgagccaggcctgcatgaggggccatgacttccatgaaggagtgcgggctgtgctgattgacaaggaccagagccccaagtggaagccagctgacctgaaggaggtgacagaggaggacctgaacaaccacttcaagagcctgggcagcagtgacctgaagttctag

SEQ ID NO: 141902 - DNA, 1017 bp, Artificial Sequence
  Description of Artificial Sequence: Synthetic coding sequence
atgggccagcgggagatgtggaggctgatgagccgcttcaatgccttcaagaggaccaacaccatcctgcaccacctgaggatgagcaagcacacagatgctgctgaggaggtgctgctggagaagaagggctgcaccggggtcatcaccctgaaccggcccaagttcctgaatgccctgaccctgaacatgatccggcagatctacccccagctgaagaagtgggagcaggaccctgagaccttcctgatcatcatcaagggagctgggggcaaggccttctgtgccggcggggacatccgggtcatcagcgaggccgagaaggccaagcagaagatcgcccctgtgttcttccgggaggagtacatgctgaacaatgctgtgggcagctgccagaagccctacgtggccctgatccacggcatcaccatgggcggcggcgtgggcctgtctgtgcacggccagttccgggtggccacagagaagtgcctgtttgccatgcctgagacagccatcggcctcttcccagatgtgggcggcggctacttcctgccccggctgcagggcaagctgggctacttcctggccctgaccggcttccggctgaagggcagagatgtgtaccgggccggcatcgccacccactttgtggacagcgagaagctggccatgctggaggaggacctgctggccctgaagagccccagcaaggagaacatcgcctctgtgctggagaactaccacacagagagcaagattgaccgggacaagagcttcatcctggaggagcacatggacaagatcaacagctgcttcagcgccaacacagtggaggagatcatcgagaacctgcagcaggacggcagcagctttgccctggagcagctgaaggtgatcaacaagatgagccccaccagcctgaagatcaccctgcggcagctgatggagggcagcagcaagaccctgcaggaggtgctgaccatggagtaccgcctgagccaggcctgcatgttttag

SEQ ID NO: 141903 - DNA, 117 bp, Artificial Sequence
  Description of Artificial Sequence: Synthetic coding sequence
tgactgattgacaaggaccagagccccaagtggaagccagctgacctgaaggaggtgacagaggaggacctgaacaaccacttcaagagcctgggcagcagtgacctgaagttctag

SEQ ID NO: 141904 - DNA, 903 bp, Artificial Sequence
  Description of Artificial Sequence: Synthetic coding sequence
atgggcaccctgcccaagagggtgaagatcgtggaggtgggccccagagatggcctgcagaatgagaagaacatcgtgtccacccctgtgaagatcaagctgattgacatgctgtctgaggccggcctgagcgtcatcgagaccaccagctttgtgagccccaagtgggtgccccagatgggagaccacacagaggtgctgaagggcatccagaagtttcctggcatcaactaccctgtgctgacccccaacctgaagggctttgaggccgctgtggccgccggggccaaggaggtggtgatctttggagctgccagcgagctgttcaccaagaagaacatcaactgcagcattgaggagagcttccagagatttgatgccatcctgaaggccgcccagagcgccaacatctctgtgcggggctacgtgtcctgtgccctgggctgcccctatgagggcaagatcagccctgccaaggtggccgaggtgaccaagaagttctacagcatgggctgctatgagatcagcctgggggacaccatcggcgtgggcaccccaggcatcatgaaggacatgctgtctgctgtgatgcaggaggtgcccctggccgccctggccgtgcactgccacgacacctacggccaggccctggccaacaccctgatggccctgcagatgggcgtgtctgtggtggacagctctgtggccggcctgggcggctgcccctatgcccagggcgccagcggcaacctggccacagaggacctggtgtacatgctggagggcctgggcatccacactggagtgaacctgcagaagctgctggaggccggcaacttcatctgccaggccctgaacaggaagaccagcagcaaggtggcccaggccacctgcaagctgtag

SEQ ID NO: 141905 - DNA, 978 bp, Artificial Sequence
  Description of Artificial Sequence: Synthetic coding sequence
atggccgccatgaggaaggccctgccccggcggctggtgggcctggccagcctgcgggctgtgtccaccagctccatgggcaccctgcccaagagggtgaagatcgtggaggtgggccccagagatggcctgcagaatgagaagaacatcgtgtccacccctgtgaagatcaagctgattgacatgctgtctgaggccggcctgtctgtgattgagaccaccagctttgtgagccccaagtgggtgccccagatgggagaccacacagaggtgctgaagggcatccagaagtttcctggcatcaactaccctgtgctgacccccaacctgaagggctttgaagctgctgtggccgccggggccaaggaggtggtgatctttggagctgccagcgagctgttcaccaagaagaacatcaactgcagcattgaggagagcttccagagatttgatgccatcctgaaggccgcccagagcgccaacatctctgtgcggggctacgtgtcctgtgccctgggctgcccctatgagggcaagatcagccctgccaaggtggccgaggtgaccaagaagttctacagcatgggctgctatgagatcagcctgggggacaccatcggcgtgggcaccccaggcatcatgaaggacatgctgtctgctgtgatgcaggaggtgcccctggccgccctggccgtgcactgccacgacacctacggccaggccctggccaacaccctgatggccctgcagatgggcgtgtctgtggtggacagctctgtggccggcctgggcggctgcccctatgcccagggcgccagcggcaacctggccacagaggacctggtgtacatgctggagggcctgggcatccacactggagtgaacctgcagaagctgctggaggccggcaacttcatctgccaggccctgaacaggaagaccagcagcaaggtggcccaggccacctgcaagctgtag

SEQ ID NO: 141906 - DNA, 765 bp, Artificial Sequence
  Description of Artificial Sequence: Synthetic coding sequence
atggccgccatgaggaaggccctgccccggcggctggtgggcctggccagcctgcgggctgtgtccaccagctccatgggcaccctgcccaagagggtgaagatcgtggaggtgggccccagagatggcctgcagaatgagaagaacatcgtgtccacccctgtgaagatcaagctgattgacatgctgtctgaggccggcctgtctgtgattgagaccaccagctttgtgagccccaagtgggtgccccagatgggagaccacacagaggtgctgaagggcatccagaagtttcctggcatcaactaccctgtgctgacccccaacctgaagggctttgaagctgctgtgaccaagaagttctacagcatgggctgctatgagatcagcctgggggacaccatcggcgtgggcaccccaggcatcatgaaggacatgctgtctgctgtgatgcaggaggtgcccctggccgccctggccgtgcactgccacgacacctacggccaggccctggccaacaccctgatggccctgcagatgggcgtgtctgtggtggacagctctgtggccggcctgggcggctgcccctatgcccagggcgccagcggcaacctggccacagaggacctggtgtacatgctggagggcctgggcatccacactggagtgaacctgcagaagctgctggaggccggcaacttcatctgccaggccctgaacaggaagaccagcagcaaggtggcccaggccacctgcaagctgtag

SEQ ID NO: 141907 - DNA, 501 bp, Artificial Sequence
  Description of Artificial Sequence: Synthetic coding sequence
atgggcaccctgcccaagagggtgaagatcgtggaggtgggccccagagatggcctgcagaatgagaagaacatcgtgtccacccctgtgaagatcaagctgattgacatgctgtctgaggccggcctgagcgtcatcgagaccaccagctttgtgagccccaagtgggtgccccagatgggagaccacacagaggtgctgaagggcatccagaagtttcctggcatcaactaccctgtgctgacccccaacctgaagggctttgaggccgccatgggcgtgtctgtggtggacagctctgtggccggcctgggcggctgcccctatgcccagggcgccagcggcaacctggccacagaggacctggtgtacatgctggagggcctgggcatccacactggagtgaacctgcagaagctgctggaggccggcaacttcatctgccaggccctgaacaggaagaccagcagcaaggtggcccaggccacctgcaagctgtag

SEQ ID NO: 141908 - DNA, 1563 bp, Artificial Sequence
  Description of Artificial Sequence: Synthetic coding sequence
atggccgccctgaagctgctgagcagcggcctgcggctgtgtgccagcgcccggggcagcggggccacctggtacaagggctgtgtgtgcagcttcagcaccagcgcccaccgccacaccaagttctacacagatcctgtggaggccgtgaaggacatcccagatggagccaccgtgctggtgggcggcttcggcctgtgtggcatccctgagaacctgattgatgccctgctgaagacaggagtgaagggcctgacagctgtgagcaacaatgctggggtggacaactttggcctgggcctgctgctgcggagcaagcagatcaagaggatggtgagcagctatgtgggggagaatgctgagtttgagcggcagtacctgagcggggagctggaggtggagctgaccccccagggcaccctggccgagcgcatccgggccggcggggccggcgtgcctgccttctacacccccaccggctacggcaccctggtgcaggagggcggcagccccatcaagtacaacaaggatggctctgtggccatcgccagcaagccccgggaggtgcgggagttcaacggccagcacttcatcctggaggaggccatcaccggggactttgccctggtgaaggcctggaaggctgacagagctggaaatgtcatcttcaggaagagcgccaggaacttcaacctgcccatgtgcaaggctgctgagaccaccgtggtggaggtggaggagatcgtggacattggagcctttgcccctgaggacatccacatcccccagatctacgtgcacaggctcatcaagggggagaagtatgagaagagaattgagcggctgagcatcaggaaggagggagatggagaggccaagagcgccaagccaggagatgatgtgcgggagcgcatcatcaagagagctgccctggagtttgaagatggcatgtatgccaacctgggcatcggcatccccctgctggccagcaacttcatcagccccaacatcaccgtgcacctgcagagtgaaaatggagtgctgggcctgggcccctacccccggcagcatgaagcagatgctgacctgatcaatgctgggaaggagaccgtgaccatcctgcccggggccagcttcttcagcagtgatgagagctttgccatgatccggggcggccacgtggacctgaccatgctgggcgccatgcaggtgtccaaatatggagacctggccaactggatgatccctgggaagatggtgaagggcatgggcggggccatggacctggtgagcagcgccaagaccaaggtggtggtgaccatggagcacagcgccaagggaaatgcccacaagatcatggagaagtgcaccctgcccctgaccgggaagcagtgtgtgaaccgcatcatcacagagaaggctgtgtttgatgtggacaagaagaagggcctgaccctgattgagctgtgggagggcctgactgtggatgatgtgcagaagagcacaggctgtgactttgctgtgagccccaagctgatgcccatgcagcagatcgccaactag

SEQ ID NO: 141909 - DNA, 1005 bp, Artificial Sequence
  Description of Artificial Sequence: Synthetic coding sequence
atgatggtgcgggagttcaacggccagcacttcatcctggaggaggccatcaccggggactttgccctggtgaaggcctggaaggctgacagagctggaaatgtcatcttcaggaagagcgccaggaacttcaacctgcccatgtgcaaggctgctgagaccaccgtggtggaggtggaggagatcgtggacattggagcctttgcccctgaggacatccacatcccccagatctacgtgcacaggctcatcaagggggagaagtatgagaagagaattgagcggctgagcatcaggaaggagggagatggagaggccaagagcgccaagccaggagatgatgtgcgggagcgcatcatcaagagagctgccctggagtttgaagatggcatgtatgccaacctgggcatcggcatccccctgctggccagcaacttcatcagccccaacatcaccgtgcacctgcagagtgaaaatggagtgctgggcctgggcccctacccccggcagcatgaagcagatgctgacctgatcaatgctgggaaggagaccgtgaccatcctgcccggggccagcttcttcagcagtgatgagagctttgccatgatccggggcggccacgtggacctgaccatgctgggcgccatgcaggtgtccaaatatggagacctggccaactggatgatccctgggaagatggtgaagggcatgggcggggccatggacctggtgagcagcgccaagaccaaggtggtggtgaccatggagcacagcgccaagggaaatgcccacaagatcatggagaagtgcaccctgcccctgaccgggaagcagtgtgtgaaccgcatcatcacagagaaggctgtgtttgatgtggacaagaagaagggcctgaccctgattgagctgtgggagggcctgactgtggatgatgtgcagaagagcacaggctgtgactttgctgtgagccccaagctgatgcccatgcagcagatcgccaactag

SEQ ID NO: 141910 - DNA, 372 bp, Artificial Sequence
  Description of Artificial Sequence: Synthetic coding sequence
atgctgggcgccatgcaggtgtccaagtacggggacctggccaactggatgatccctgggaagatggtgaagggcatgggcggggccatggacctggtgtcctctgccaagaccaaggtggtggtgaccatggagcacagcgccaagggaaatgcccacaagatcatggagaagtgcaccctgcccctgaccgggaagcagtgtgtgaaccgcatcatcacagagaaggctgtgtttgatgtggacaagaagaagggcctgaccctcatcgagctgtgggagggcctgactgtggatgatgtgcagaagagcacaggctgtgactttgctgtgagccccaagctgatgcccatgcagcagatcgccaactag

SEQ ID NO: 141911 - DNA, 372 bp, Artificial Sequence; identical to SEQ ID NO: 141910
  Description of Artificial Sequence: Synthetic coding sequence

SEQ ID NO: 141912 - DNA, 453 bp, Artificial Sequence
  Description of Artificial Sequence: Synthetic coding sequence
agcaatgcctacaaggtggacaactttggcctgggcctgctgctgcggagcaagcagatcaagaggatggtgagcagctatgtgggggagaatgctgagtttgagcggcagtacctgagcggggagctggaggtggagctgaccccccagggcaccctggccgagcgcatccgggccggcggggccggcgtgcctgccttctacacccccaccggctacggcaccctggtgcaggagggcggcagccccatcaagtacaacaaggatggctctgtggccatcgccagcaagccccgggaggtgcgggagttcaacggccagcacttcatcctggaggaggccatcaccggggactttgccctggtgaaggcctggaaggctgacagagctggaaatgtcatcttcaggaagagcgccaggaacttcaacctgcccatgtgcaaggccgcctag

SEQ ID NO: 141913 - DNA, 1131 bp, Artificial Sequence
  Description of Artificial Sequence: Synthetic coding sequence
atgagcaactgcctgcagaacttcctgaagatcaccagcacccggctgctgtgcagccggctgtgccagcagctgcggagcaagaggaagttcttcggcaccgtgcccatcagccggctgcaccggcgggtggtgatcactggaattggcctggtgacccccctgggcgtgggcacccacctggtgtgggaccggctgattggaggagagagcggcatcgtgtccctggtgggggaggagtacaagagcatcccctgcagcgtggccgcctacgtgccccggggcagtgatgagggccagttcaatgagcagaactttgtgtccaagagtgacatcaagtccatgagcagccccaccatcatggccatcggggctgctgagctggccatgaaggacagcggctggcacccccagagcgaggccgaccaggtggccaccggggtggccatcggcatgggcatgatccccctggaggtggtgtctgaaacagccctgaacttccagaccaagggctacaacaaggtgagccccttctttgtgcccaagatcctggtgaacatggctgctggccaggtgtccatccgctacaagctgaagggccccaaccacgctgtgtccacagcctgcaccactggagcccatgctgtgggggacagcttccgcttcatcgcccatggagatgctggccacatcacagccccagaccctgagggggagggcgccctgcgctgcatggctgctgccctgaaggatgctggggtgcagcctgaggagatctcctacatcaatgcccacgccaccagcacccccctgggagatgctgctgagaacaaggccatcaagcacctgttcaaggaccacgcctatgccctggccgtgagcagcaccaagggggccaccggccacctgctgggcgctgctggagctgtggaggccgccttcaccaccctggcctgctactaccagaagctgccccccaccctgaacctggactgcagcgagcctgagtttgacctgaactacgtgcccctgaaggcccaggagtggaagacagagaagcgcttcatcggcctgaccaacagctttggatttggaggcaccaatgccaccctgtgcatcgccggcctgtag

SEQ ID NO: 141914 - DNA, 1380 bp, Artificial Sequence
  Description of Artificial Sequence: Synthetic coding sequence
atgagcaactgcctgcagaacttcctgaagatcaccagcacccggctgctgtgcagccggctgtgccagcagctgcggagcaagaggaagttcttcggcaccgtgcccatcagccggctgcaccggcgggtggtgatcactggaattggcctggtgacccccctgggcgtgggcacccacctggtgtgggaccggctgattggaggagagagcggcatcgtgtccctggtgggggaggagtacaagagcatcccctgcagcgtggccgcctacgtgccccggggcagtgatgagggccagttcaatgagcagaactttgtgtccaagagtgacatcaagtccatgagcagccccaccatcatggccatcggggctgctgagctggccatgaaggacagcggctggcacccccagagcgaggccgaccaggtggccaccggggtggccatcggcatgggcatgatccccctggaggtggtgtctgaaacagccctgaacttccagaccaagggctacaacaaggtgagccccttctttgtgcccaagatcctggtgaacatggctgctggccaggtgtccatccgctacaagctgaagggccccaaccacgctgtgtccacagcctgcaccactggagcccatgctgtgggggacagcttccgcttcatcgcccatggagatgctgatgtgatggtggccggcggcacagacagctgcatcagccccctgagcctggccggcttcagccgggcccgggccctgagcaccaacagcgaccccaagctggcctgccggcccttccaccccaagagagatggctttgtgatgggagagggcgctgctgtgctggtgctggaggagtatgagcacgctgtgcagaggcgggcccgcatctatgcagaggtgctgggctacggcctgtctggagatgctggccacatcacagccccagaccctgagggggagggcgccctgcgctgcatggccgccgccctgaaggatgctggggtgcagcctgaggagatctcctacatcaatgcccacgccaccagcacccccctgggagatgctgctgagaacaaggccatcaagcacctgttcaaggaccacgcctatgccctggccgtgagcagcaccaagggggccaccggccacctgctgggcgccgccggggctgtggaggccgccttcaccaccctggcctgctactaccagaagctgccccccaccctgaacctggactgcagcgagcctgagtttgacctgaactacgtgcccctgaaggcccaggagtggaagacagagaagcgcttcatcggcctgaccaacagctttggatttggaggcaccaatgccaccctgtgcatcgccggcctgtag

SEQ ID NO: 141915 - DNA, 696 bp, Artificial Sequence
  Description of Artificial Sequence: Synthetic coding sequence
atgagcaactgcctgcagaacttcctgaagatcaccagcacccggctgctgtgcagccggctgtgccagcagctgcggagcaagaggaagttcttcggcaccgtgcccatcagccggctgcaccggcgggtggtgatcactggaattggcctggtgacccccctgggcgtgggcacccacctggtgtgggaccggctgattggaggagagagcggcatcgtgtccctggtgggggaggagtacaagagcatcccctgcagcgtggccgcctacgtgccccggggcagtgatgagggccagttcaatgagcagaactttgtgtccaagagtgacatcaagtccatgagcagccccaccatcatggccatcggggctgctgagctggccatgaaggacagcggctggcacccccagagcgaggccgaccaggtggccaccggggtggccatcggcatgggcatgatccccctggaggtggtgtctgaaacagccctgaacttccagaccaagggctacaacaaggtgagccccttctttgtgcccaagatcctggtgaacatggctgctggccaggtgtccatccgctacaagctgaagggccccaaccacgctgtgtccacagcctgcaccactggagcccatgctgtgggggacagcttccgcttcatcgcccatggagatgctgatgtgatgtag

SEQ ID NO: 141916 - DNA, 663 bp, Artificial Sequence
  Description of Artificial Sequence: Synthetic coding sequence
atgagcaactgcctgcagaacttcctgaagatcaccagcacccggctgctgtgcagccggctgtgccagcagctgcggagcaagaggaagttcttcggcaccgtgcccatcagccggctgcaccggcgggtggtgatcactggaattggcctggtgacccccctgggcgtgggcacccacctggtgtgggaccggctgattggaggagagagcggcatcgtgtccctggtgggggaggagtacaagagcatcccctgcagcgtggccgcctacgtgccccggggcagtgatgagggccagttcaatgagcagaactttgtgtccaagagtgacatcaagtccatgagcagccccaccatcatggccatcggggctgctgagctggccatgaaggacagcggctggcacccccagagcgaggccgaccaggtggccaccggggtggccatcggcatgggcatgatccccctggaggtggtgtctgaaacagccctgaacttccagaccaagggctacaacaaggtgagccccttctttgtgcccaagatcctggtgaacatggctgctggccaggtgtccatccgctacaagctgaagggccccaaccacgctgtgtccacagcctgcaccactggagcccatgctgtgggggacagcttctag

SEQ ID NO: 141917 - DNA, 1875 bp, Artificial Sequence
  Description of Artificial Sequence: Synthetic coding sequence
atggagatccctggcagcctgtgcaagaaggtgaagctgagcaacaatgcccagaactggggcatgcagagggccaccaacgtgacctaccaggcccaccacgtgtccaggaacaagaggggccaggtggtgggcacccggggcggcttccggggctgcaccgtgtggctgaccggcctgtctggagctgggaagaccaccgtgtccatggccctggaggagtacctggtgtgccacggcatcccctgctacaccctggatggagacaacatccggcagggcctgaacaagaacctgggcttcagccctgaggaccgggaggagaatgtgagaagaattgctgaggtggccaagctgtttgctgatgctggcctggtgtgcatcaccagcttcatcagcccctacacccaggacagaaataatgcccggcagatccacgagggcgccagcctgcccttctttgaggtgtttgtggatgcccccctgcacgtgtgtgagcagagagatgtgaagggcctgtacaagaaggcccgggccggggagatcaagggcttcaccggcatcgacagtgaatatgagaagccagaggcccctgagctggtgctgaagacagacagctgtgatgtgaatgactgtgtgcagcaggtggtggagctgctgcaggagcgggacatcgtgcctgtggatgccagctatgaggtgaaggagctgtatgtgcctgagaacaagctgcacctggccaagacagatgctgagaccctgcctgccctgaagatcaacaaggtggacatgcagtgggtgcaggtgctggccgagggctgggccacccccctgaatggcttcatgagggagcgggagtacctgcagtgcctgcactttgactgcctgctggatggcggcgtcatcaacctgtctgtgcccatcgtgctgacagccacccatgaggacaaggagcggctggatggctgcacagcctttgccctgatgtatgagggcagaagagtggccatcctgagaaatcctgagttctttgagcacaggaaggaggagcgctgtgcccggcagtggggcaccacctgcaagaaccacccctacatcaagatggtgatggagcagggcgactggctgattggaggagacctgcaggtgctggacagagtgtactggaatgatggcctggaccagtaccgcctgacccccacagagctgaagcagaagttcaaggacatgaatgctgatgctgtgtttgccttccagctgagaaatcctgtgcacaacggccacgccctgctgatgcaggacacccacaagcagctgctggagcggggctacagaagacctgtgctgctgctgcaccccctgggcggctggaccaaggatgatgatgtgcccctgatgtggaggatgaagcagcacgccgctgtgctggaggagggcgtgctgaaccctgagaccaccgtggtggccatcttccccagccccatgatgtatgccggccccacagaggtgcagtggcactgccgggccaggatggtggccggggccaacttctacatcgtgggccgggaccctgctggcatgccccaccctgagaccgggaaggacctgtatgagcccagccatggagccaaggtgctgaccatggcccctggcctcatcaccctggagatcgtgcccttccgggtggccgcctacaacaagaagaagaagaggatggactactatgattctgagcaccatgaagattttgagttcatcagcggcaccaggatgaggaagctggcccgggagggccagaagcccccagagggcttcatggcccccaaggcctggacagtgctgacagagtactacaagagcctggagaaggcctag

SEQ ID NO: 141918 - DNA, 1845 bp, Artificial Sequence
  Description of Artificial Sequence: Synthetic coding sequence
atgagcggcatcaagaagcagaagacagagaaccagcagaagagcaccaacgtggtgtaccaggcccaccacgtgtccaggaacaagaggggccaggtggtgggcacccggggcggcttccggggctgcaccgtgtggctgaccggcctgtctggagctgggaagaccaccatcagctttgccctggaggagtacctggtgtcccatgccatcccctgctacagcctggatggagacaacgtgagacatggcctgaacagaaacctgggcttcagccctggggaccgggaggagaacatcagaagaattgctgaggtggccaagctgtttgctgatgctggcctggtgtgcatcaccagcttcatcagcccctttgccaaggaccgggagaatgccaggaagatccacgagagcgctggcctgcccttctttgagatctttgtggatgcccccctgaacatctgtgagagcagagatgtgaagggcctgtacaagagggcccgggccggggagatcaagggcttcaccggcatcgacagcgactatgagaagccagagaccccagagcgggtgctgaagaccaacctgagcacagtgtctgactgtgtgcaccaggtggtggagctgctgcaggagcagaacatcgtgccctacaccatcatcaaggacatccacgagctgtttgtgcctgagaacaagctggaccacgtgcgggcagaggccgagaccctgcccagcctgagcatcaccaagctggacctgcagtgggtgcaggtgctgtctgagggctgggccacccccctgaagggcttcatgagggagaaggagtacctgcaggtgatgcactttgacaccctgctggatgatggagtcatcaacatgagcatccccatcgtgctgcctgtgtctgctgaggacaagacccggctggagggctgcagcaagtttgtgctggcccacggcggcagaagagtggccatcctgagagatgctgagttctatgagcacaggaaggaggagcgctgcagccgggtgtggggcaccacctgcaccaagcacccccacatcaagatggtgatggagagcggggactggctggtgggcggggacctgcaggtgctggagaagatccgctggaatgatggcctggaccagtaccgcctgacccccctggagctgaagcagaagtgcaaggagatgaatgctgatgctgtgtttgccttccagctgagaaatcctgtgcacaacggccacgccctgctgatgcaggacacccggcggcggctgctggagcggggctacaagcaccctgtgctgctgctgcaccccctgggcggctggaccaaggatgatgatgtgcccctggactggaggatgaagcagcacgccgctgtgctggaggagggcgtgctggaccccaagagcaccatcgtggccatcttccccagccccatgctgtatgccggccccacagaggtgcagtggcactgccgcagcaggatgattgctggggccaacttctacatcgtgggccgggaccctgctggcatgccccaccctgagaccaagaaggacctgtatgagcccacccatggaggcaaggtgctgtccatggcccctggcctgacctctgtggagatcatccccttccgggtggccgcctacaacaaggccaagaaggccatggacttctatgaccctgcccggcacaatgaatttgacttcatcagcggcaccaggatgaggaagctggcccgggagggagaaaatcctccagatggcttcatggcccccaaggcctggaaggtgctgacagactactaccgcagcctggagaagaactag

SEQ ID NO: 141919 - DNA, 1857 bp, Artificial Sequence
  Description of Artificial Sequence: Synthetic coding sequence
tctgggaagaagcaggagaaggaggagaaccagcagaagagcaccaacgtggtgtaccaggcccaccacgtgtccaggaacaagaggggccaggtggtgggcacccggggcggcttccggggctgcaccgtgtggctgaccggcctgagcggggccggcaagaccaccatcagctttgccctggaggagtacctggtgagccacgccatcccctgctacagcctggatggagacaacgtgcgccacggcctgaacagaaacctgggcttcagccctggggaccgggaggagaacatcagaagaattgctgaggtggccaagctgtttgctgatgctggcctggtgtgcatcaccagcttcatcagcccctttgccaaggacagagaaaatgccaggaagatccatgaatctgctggcctgcccttctttgagatctttgtggatgcccccctgaacatctgtgagagcagagatgtgaagggcctgtacaagagggcccgggccggggagatcaagggcttcaccggcatcgacagcgactatgagaagccagagaccccagagcgggtgctgaagaccaacctgagcacagtgtctgactgtgtgcaccaggtggtggagctgctgcaggagcagaacatcgtgccctacaccatcatcaaggacatccacgagctgtttgtgcctgagaacaagctggaccacgtgcgggcagaggccgagaccctgcccagcctgagcatcaccaagctggacctgcagtgggtgcaggtgctgtctgagggctgggccacccccctgaagggcttcatgagggagaaggagtacctgcaggtgatgcactttgacaccctgctggatggcatgttcctgctggatggagtcatcaacatgagcatccccatcgtgctgcctgtgtctgctgaggacaagacccggctggagggctgcagcaagtttgtgctggcccacggcggcagaagagtggccatcctgagagatgctgagttctatgagcacaggaaggaggagcgctgcagccgggtgtggggcaccacctgcaccaagcacccccacatcaagatggtgatggagagcggggactggctggtgggcggggacctgcaggtgctggagaagatccgctggaatgatggcctggaccagtaccgcctgacccccctggagctgaagcagaagtgcaaggagatgaatgctgatgctgtgtttgccttccagctgagaaatcctgtgcacaacggccacgccctgctgatgcaggacacccggcggcggctgctggagcggggctacaagcaccctgtgctgctgctgcaccccctgggcggctggaccaaggatgatgatgtgcccctggactggaggatgaagcagcacgccgctgtgctggaggagggcgtgctggaccccaagagcaccatcgtggccatcttccccagccccatgctgtatgccggccccacagaggtgcagtggcactgccgcagcaggatgattgctggggccaacttctacatcgtgggccgggaccctgctggcatgccccaccctgagaccaagaaggacctgtatgagcccacccatggaggcaaggtgctgtccatggcccctggcctgacctctgtggagatcatccccttccgggtggccgcctacaacaaggccaagaaggccatggacttctatgaccctgcccggcacaatgaatttgacttcatcagcggcaccaggatgaggaagctggcccgggagggagaaaatcctccagatggcttcatggcccccaaggcctggaaggtgctgacagactactaccgcagcctggagaagaactag

SEQ ID NO: 141920 - DNA, 1857 bp, Artificial Sequence
  Description of Artificial Sequence: Synthetic coding sequence
atgattgtgctggtgacagagtgggtggacctgagcctggagaaccagcagaagagcaccaacgtggtgtaccaggcccaccacgtgtccaggaacaagaggggccaggtggtgggcacccggggcggcttccggggctgcaccgtgtggctgaccggcctgtctggagctgggaagaccaccatcagctttgccctggaggagtacctggtgtcccatgccatcccctgctacagcctggatggagacaacgtgagacatggcctgaacagaaacctgggcttcagccctggggaccgggaggagaacatcagaagaattgctgaggtggccaagctgtttgctgatgctggcctggtgtgcatcaccagcttcatcagcccctttgccaaggaccgggagaatgccaggaagatccacgagagcgctggcctgcccttctttgagatctttgtggatgcccccctgaacatctgtgagagcagagatgtgaagggcctgtacaagagggcccgggccggggagatcaagggcttcaccggcatcgacagcgactatgagaagccagagaccccagagcgggtgctgaagaccaacctgagcacagtgtctgactgtgtgcaccaggtggtggagctgctgcaggagcagaacatcgtgccctacaccatcatcaaggacatccacgagctgtttgtgcctgagaacaagctggaccacgtgcgggcagaggccgagaccctgcccagcctgagcatcaccaagctggacctgcagtgggtgcaggtgctgtctgagggctgggccacccccctgaagggcttcatgagggagaaggagtacctgcaggtgatgcactttgacaccctgctggatgatggagtcatcaacatgagcatccccatcgtgctgcctgtgtctgctgaggacaagacccggctggagggctgcagcaagtttgtgctggcccacggcggcagaagagtggccatcctgagagatgctgagttctatgagcacaggaaggaggagcgctgcagccgggtgtggggcaccacctgcaccaagcacccccacatcaagatggtgatggagagcggggactggctggtgggcggggacctgcaggtgctggagaagatccgctggaatgatggcctggaccagtaccgcctgacccccctggagctgaagcagaagtgcaaggagatgaatgctgatgctgtgtttgccttccagctgagaaatcctgtgcacaacggccacgccctgctgatgcaggacacccggcggcggctgctggagcggggctacaagcaccctgtgctgctgctgcaccccctgggcggctggaccaaggatgatgatgtgcccctggactggaggatgaagcagcacgccgctgtgctggaggagggcgtgctggaccccaagagcaccatcgtggccatcttccccagccccatgctgtatgccggccccacagaggtgcagtggcactgccgcagcaggatgattgctggggccaacttctacatcgtgggccgggaccctgctggcatgccccaccctgagaccaagaaggacctgtatgagcccacccatggaggcaaggtgctgtccatggcccctggcctgacctctgtggagatcatccccttccgggtggccgcctacaacaaggccaagaaggccatggacttctatgaccctgcccggcacaatgaatttgacttcatcagcggcaccaggatgaggaagctggcccgggagggagaaaatcctccagatggcttcatggcccccaaggcctggaaggtgctgacagactactaccgcagcctggagaagaactag

SEQ ID NO: 141921 - DNA, 1860 bp, Artificial Sequence
  Description of Artificial Sequence: Synthetic coding sequence
atgagcggcatcaagaagcagaagacagagaaccagcagaagagcaccaacgtggtgtaccaggcccaccacgtgtccaggaacaagaggggccaggtggtgggcacccggggcggcttccggggctgcaccgtgtggctgaccggcctgtctggagctgggaagaccaccatcagctttgccctggaggagtacctggtgtcccatgccatcccctgctacagcctggatggagacaacgtgagacatggcctgaacagaaacctgggcttcagccctggggaccgggaggagaacatcagaagaattgctgaggtggccaagctgtttgctgatgctggcctggtgtgcatcaccagcttcatcagcccctttgccaaggaccgggagaatgccaggaagatccacgagagcgctggcctgcccttctttgagatctttgtggatgcccccctgaacatctgtgagagcagagatgtgaagggcctgtacaagagggcccgggccggggagatcaagggcttcaccggcatcgacagcgactatgagaagccagagaccccagagcgggtgctgaagaccaacctgagcacagtgtctgactgtgtgcaccaggtggtggagctgctgcaggagcagaacatcgtgccctacaccatcatcaaggacatccacgagctgtttgtgcctgagaacaagctggaccacgtgcgggcagaggccgagaccctgcccagcctgagcatcaccaagctggacctgcagtgggtgcaggtgctgtctgagggctgggccacccccctgaagggcttcatgagggagaaggagtacctgcaggtgatgcactttgacaccctgctggatggcatggccctgcctgatggagtcatcaacatgagcatccccatcgtgctgcctgtgtctgctgaggacaagacccggctggagggctgcagcaagtttgtgctggcccatggaggccggcgggtggccatcctgagagatgctgagttctatgagcacaggaaggaggagcgctgcagccgggtgtggggcaccacctgcaccaagcacccccacatcaagatggtgatggagagcggggactggctggtgggcggggacctgcaggtgctggagaagatccgctggaatgatggcctggaccagtaccgcctgacccccctggagctgaagcagaagtgcaaggagatgaatgctgatgctgtgtttgccttccagctgaggaaccctgtgcacaatggacatgccctgctgatgcaggacacccggcggcggctgctggagcggggctacaagcaccctgtgctgctgctgcaccccctgggcggctggaccaaggatgatgatgtgcccctggactggaggatgaagcagcacgccgctgtgctggaggagggcgtgctggaccccaagagcaccatcgtggccatcttccccagccccatgctgtatgccggccccacagaggtgcagtggcactgccgcagcaggatgattgctggggccaacttctacatcgtgggccgggaccctgctggcatgccccaccctgagaccaagaaggacctgtatgagcccacccacggcggcaaggtgctgtccatggcccctggcctgacctctgtggagatcatccccttccgggtggccgcctacaacaaggccaagaaggccatggacttctatgaccctgcccggcacaatgaatttgacttcatcagcggcaccaggatgaggaagctggcccgggagggggagaaccccccagatggcttcatggcccccaaggcctggaaggtgctgacagactactaccgcagcctggagaagaactag

SEQ ID NO: 141922 - DNA, 1503 bp, Artificial Sequence
  Description of Artificial Sequence: Synthetic coding sequence
atggcctccatgctgctggcccagaggctggcctgcagcttccagcacagctaccgcctgctggtgcccggcagccgccacatcagccaggccgccgccaaggtggatgtggagtttgattatgatggccccctgatgaagacagaggtgcccggccccaggagccaggagctgatgaagcagctgaacatcatccagaatgctgaggccgtgcacttcttctgcaactatgaggagagccggggcaactacctggtggatgtggatggcaacaggatgctggacctgtacagccagatcagctctgtgcccatcggctacagccacccagccctgctgaagctgatccagcagccccagaatgcctccatgtttgtgaacagacctgccctgggcatcctgcccccagaaaattttgtggagaagctgcggcagagcctgctgtctgtggcccccaagggcatgagccagctgatcaccatggcctgtggcagctgcagcaatgaaaatgccctgaagaccatcttcatgtggtaccgcagcaaggagcggggccagaggggcttcagccaggaggagctggagacctgcatgatcaaccaggcccctggctgcccagactacagcatcctgtccttcatgggcgccttccacggccgcaccatgggctgcctggccaccacccacagcaaggccatccacaagattgacatccccagctttgactggcccatcgcccccttcccccggctgaagtaccccctggaggagtttgtgaaggagaaccagcaggaggaggcccgctgcctggaggaggtggaggacctgattgtgaagtacaggaagaagaagaagacagtggccggcatcatcgtggagcccatccagagcgagggcggggacaaccacgccagtgatgacttcttcaggaagctgcgggacatcgccaggaagcacggctgtgccttcctggtggatgaggtgcagacaggaggcggctgcaccgggaagttctgggcccacgagcactggggcctggatgatcctgcagatgtgatgaccttcagcaagaagatgatgactggaggcttcttccacaaggaggagttccggcccaatgccccctaccgcatcttcaacacctggctgggggaccccagcaagaacctgctgctggccgaggtgatcaacatcatcaagcgggaggacctgctgaacaatgctgcccatgctgggaaggccctgctgaccggcctgctggacctgcaggcccgctacccccagttcatcagccgggtgcggggccggggcaccttctgcagctttgacaccccagatgacagcatccggaacaagctgatcctgattgccaggaacaagggcgtggtgctgggcggctgtggggacaagagcatccgcttccggcccaccctggtgttccgggaccaccacgcccacctgttcctgaacatcttcagtgacatcctggccgacttcaagtag

SEQ ID NO: 141923 - DNA, 1503 bp, Artificial Sequence; identical to SEQ ID NO: 141922
  Description of Artificial Sequence: Synthetic coding sequence

SEQ ID NO: 141924 - DNA, 1503 bp, Artificial Sequence; identical to SEQ ID NO: 141922
  Description of Artificial Sequence: Synthetic coding sequence

SEQ ID NO: 141925 - DNA, 462 bp, Artificial Sequence
  Description of Artificial Sequence: Synthetic coding sequence
gtggacatggatggagtgctggccgactttgaggccggcctgctgcggggcttcagaagacgcttccctgaggagccccacgtgcccctggagcagaggcggggcttcctggcccgggagcagtaccgggccctgcggccagacctggccgacaaggtggcctctgtgtatgaggcccctggcttcttcctggacctggagcccatccctggggccctggatgctgtgcgggagatgaatgacctgcctgacacccaggtgttcatctgcaccagccccctgctgaagtaccaccactgtgtgggggagaaggaggagacccccagctgggagcacatcctcttcacctgctgccacaacagacacctggtgctgccccccacccggcggcggctgctgtcctggagcgacaactggagggagatcctggacagcaagagaggagctgcccagcgggagtag

SEQ ID NO: 141926 - DNA, 606 bp, Artificial Sequence
  Description of Artificial Sequence: Synthetic coding sequence
atggcccggtctgtgcgggtgctggtggacatggatggagtgctggccgactttgaggccggcctgctgcggggcttcagaagacgcttccctgaggagccccacgtgcccctggagcagaggcggggcttcctggcccgggagcagtaccgggccctgcggccagacctggccgacaaggtggcctctgtgtatgaggcccctggcttcttcctggacctggagcccatccctggggccctggatgctgtgcgggagatgaatgacctgcctgacacccaggtgttcatctgcaccagccccctgctgaagtaccaccactgtgtgggggagaagtaccgctgggtggagcagcacctgggcccccagtttgtggagcgcatcatcctgacccgggacaagacagtggtgctgggggacctgctgattgatgacaaggacacagtgcggggccaggaggagacccccagctgggagcacatcctcttcacctgctgccacaacagacacctggtgctgccccccacccggcggcggctgctgtcctggagcgacaactggagggagatcctggacagcaagagaggagctgcccagcgggagtag

SEQ ID NO: 141927 - DNA, 687 bp, Artificial Sequence
  Description of Artificial Sequence: Synthetic coding sequence
atgatccggctgggcggctggtgtgcccggcggctgtgcagcgctgctgtgcctgctggaagaagaggagctgctgggggcctgggcctggccggcggccgggccctgcgggtgctggtggacatggatggagtgctggccgactttgaaggaggcttcctgaggaagttccgggcccgcttcccagaccagcccttcatcgccctggaggaccggcggggcttctgggtgtctgagcagtatggccgcctgcggcccggcctgtctgagaaggccatcagcatctgggagagcaagaacttcttctttgagctggagcccctgcctggagctgtggaggccgtgaaggagatggccagcctgcagaacacagatgtgttcatctgcaccagccccatcaagatgttcaagtactgcccctatgagaagtatgcctgggtggagaagtactttggaccagacttcctggagcagatcgtgctgacccgggacaagacagtggtgtctgctgacctgctgattgatgacagaccagacatcactggagctgagcccacccccagctgggagcacgtgctcttcaccgcctgccacaaccagcacctgcagctgcagcccccccggcggcggctgcacagctgggcagatgactggaaggccatcctggacagcaagaggccctgctag

SEQ ID NO: 141928 - DNA, 720 bp, Artificial Sequence
  Description of Artificial Sequence: Synthetic coding sequence
atgatccggctgggcggctggtgtgcccggcggctgtgcagcgctgctgtgcctgctggaagaagaggagctgctgggggcctgggcctggccggcggccgggccctgcgggtgctggtggacatggatggagtgctggccgactttgaaggaggcttcctgaggaagttccgggcccgcttcccagaccagcccttcatcgccctggaggaccggcggggcttctgggtgtctgagcagtatggccgcctgcggcccggcctgtctgagaaggccatcagcatctgggagagcaagaacttcttctttgagctggagcccctgcctggagctgtggaggccgtgaaggagatggccagcctgcagaacacagatgtgttcatctgcaccagccccatcaagatgttcaagtactgcccctatgagaagtatgcctgggtggagaagtactttggaccagacttcctggagcagatcgtgctgacccgggacaagacagtggtgtctgctgacctgctgattgatgacagaccagacatcactggaaaccagcccccagctggctccatgagcagcagccccccagccaccaccagcacctgcagctgcagccccccagctgctggctgcacccggggccgcaccaccggccggcccttctggacagccagcggccctgctgagctggactgtgccagcggcagctctgtgggcctgtag

SEQ ID NO: 141929 - DNA, 2853 bp, Artificial Sequence
  Description of Artificial Sequence: Synthetic coding sequence
atgggcgtgcctgccttcttccgctggctgagcaggaagtaccccagcatcatcgtgaactgtgtggaggagaagcccaaggagtgcaatggagtgaagatccctgtggatgccagcaagcccaaccccaatgatgtggagtttgacaacctgtacctggacatgaatggcatcatccacccctgcacccaccctgaggacaagccagcccccaagaatgaagatgagatgatggtggccatctttgagtacatcgacaggctcttcagcatcgtgcggccccggcggctgctgtacatggccattgatggagtggccccccgggccaagatgaaccagcagaggagccgccgcttccgggccagcaaggagggcatggaggccgctgtggagaagcagagggtgcgggaggagatcctggccaagggcggcttcctgcccccagaggagatcaaggagagatttgacagcaactgcatcaccccaggcacagagttcatggacaacctggccaagtgcctgcgctactacatcgctgaccggctgaacaatgaccccggctggaagaacctgaccgtcatcctgagtgatgccagcgcccctggagagggggagcacaagatcatggactacatccggcggcagagggcccagcccaaccacgaccccaacacccaccactgcctgtgtggggctgatgctgacctgatcatgctgggcctggccacccatgagcccaacttcaccatcatccgggaggagttcaagcccaacaagcccaagccctgtggcctgtgcaaccagtttggacatgaggtgaaggactgtgagggcctgccccgggagaagaagggcaagcatgatgagctggccgacagcctgccctgtgccgagggggagttcatcttcctgcggctgaatgtgctgcgggagtacctggagcgggagctgaccatggccagcctgcccttcacctttgatgtggagaggagcattgatgactgggtgttcatgtgcttctttgtgggcaatgacttcctgccccacctgcccagcctggagatcagagaaaatgccatcgaccggctggtgaacatctacaagaatgtggtgcacaagacaggaggctacctgacagaaagtggctacgtgaacctgcagagggtgcagatgatcatgctggccgtgggggaggtggaggacagcatcttcaagaagaggaaggatgatgaagattccttcagaagacggcagaaggagaagaggaagaggatgaagagggaccagcctgccttcaccccatctggcatcctgacccctcatgccctgggcagcaggaacagccctggcagccaggtggccagcaacccccggcaggccgcctatgagatgaggatgcagaacaacagcagccccagcatcagccccaacaccagcttcaccagtgatggcagccccagccccctgggcggcatcaagaggaaggcagaagattctgattctgagcctgagcctgaggacaacgtgcggctgtgggaggccggctggaagcagcgctactacaagaacaagtttgatgtggatgctgctgatgagaagttccggaggaaggtggtgcagagctatgtggagggcctgtgctgggtgctgcgctactactaccagggctgtgcctcctggaagtggtactaccccttccactacgccccctttgccagtgactttgagggcattgctgacatgcccagcgactttgagaagggcaccaagcccttcaagcccctggagcagctgatgggcgtcttccctgctgccagcggcaacttcctgcccccatcctggaggaagctgatgtctgaccctgacagcagcatcatcgacttctacccagaagattttgccatcgacctgaatggcaagaagtatgcctggcagggcgtggccctgctgccctttgtggatgagcggcggctgcgggccgccctggaggaggtgtacccagacctgaccccagaggagaccaggaggaacagcctgggcggagatgtgctgtttgtgggcaagcaccaccccctgcatgacttcatcctggagctgtaccagacaggcagcacagagcctgtggaggtgcccccagagctgtgccacggcatccagggcaagttcagcctggatgaggaggccatcctgcctgaccagatcgtgtgcagccctgtgcccatgctgcgggacctgacccagaacacagtggtgtccatcaacttcaaggacccccagtttgctgaggactacatcttcaaggctgtgatgctgcccggggccaggaagccagctgctgtgctgaagcccagcgactgggagaagagcagcaatggccggcagtggaagccccagctgggcttcaacagagacagaagacctgtgcacctggaccaggccgccttccgcaccctgggccacgtgatgccccggggcagcggcaccggcatctacagcaatgctgcccctcctcctgtgacctaccagggcaacctgtaccggcccctgctgcggggccaggcccagatccccaagctgatgagcaacatgaggccccaggacagctggaggggccccccacccctcttccagcagcagagatttgaccggggcgtgggcgctgagcccctgctgccctggaacaggatgctgcagacccagaatgctgccttccagcccaaccagtaccagatgctggccggccctgggggctaccccccaagaagagatgaccggggcggccggcagggctacccccgggagggcaggaagtaccccctgcccccacccagcggccgctacaactggaactag

SEQ ID NO: 141930 - DNA, 2625 bp, Artificial Sequence
  Description of Artificial Sequence: Synthetic coding sequence
atgatggtggccatctttgagtacatcgacaggctcttcagcatcgtgcggccccggcggctgctgtacatggccattgatggagtggccccccgggccaagatgaaccagcagaggagccgccgcttccgggccagcaaggagggcatggaggccgctgtggagaagcagagggtgcgggaggagatcctggccaagggcggcttcctgcccccagaggagatcaaggagagatttgacagcaactgcatcaccccaggcacagagttcatggacaacctggccaagtgcctgcgctactacatcgctgaccggctgaacaatgaccccggctggaagaacctgaccgtcatcctgagtgatgccagcgcccctggagagggggagcacaagatcatggactacatccggcggcagagggcccagcccaaccacgaccccaacacccaccactgcctgtgtggggctgatgctgacctgatcatgctgggcctggccacccatgagcccaacttcaccatcatccgggaggagttcaagcccaacaagcccaagccctgtggcctgtgcaaccagtttggacatgaggtgaaggactgtgagggcctgccccgggagaagaagggcaagcatgatgagctggccgacagcctgccctgtgccgagggggagttcatcttcctgcggctgaatgtgctgcgggagtacctggagcgggagctgaccatggccagcctgcccttcacctttgatgtggagaggagcattgatgactgggtgttcatgtgcttctttgtgggcaatgacttcctgccccacctgcccagcctggagatcagagaaaatgccatcgaccggctggtgaacatctacaagaatgtggtgcacaagacaggaggctacctgacagaaagtggctacgtgaacctgcagagggtgcagatgatcatgctggccgtgggggaggtggaggacagcatcttcaagaagaggaaggatgatgaagattccttcagaagacggcagaaggagaagaggaagaggatgaagagggaccagcctgccttcaccccatctggcatcctgacccctcatgccctgggcagcaggaacagccctggcagccaggtggccagcaacccccggcaggccgcctatgagatgaggatgcagaacaacagcagccccagcatcagccccaacaccagcttcaccagtgatggcagccccagccccctgggcggcatcaagaggaaggcagaagattctgattctgagcctgagcctgaggacaacgtgcggctgtgggaggccggctggaagcagcgctactacaagaacaagtttgatgtggatgctgctgatgagaagttccggaggaaggtggtgcagagctatgtggagggcctgtgctgggtgctgcgctactactaccagggctgtgcctcctggaagtggtactaccccttccactacgccccctttgccagtgactttgagggcattgctgacatgcccagcgactttgagaagggcaccaagcccttcaagcccctggagcagctgatgggcgtcttccctgctgccagcggcaacttcctgcccccatcctggaggaagctgatgtctgaccctgacagcagcatcatcgacttctacccagaagattttgccatcgacctgaatggcaagaagtatgcctggcagggcgtggccctgctgccctttgtggatgagcggcggctgcgggccgccctggaggaggtgtacccagacctgaccccagaggagaccaggaggaacagcctgggcggagatgtgctgtttgtgggcaagcaccaccccctgcatgacttcatcctggagctgtaccagacaggcagcacagagcctgtggaggtgcccccagagctgtgccacggcatccagggcaagttcagcctggatgaggaggccatcctgcctgaccagatcgtgtgcagccctgtgcccatgctgcgggacctgacccagaacacagtggtgtccatcaacttcaaggacccccagtttgctgaggactacatcttcaaggctgtgatgctgcccggggccaggaagccagctgctgtgctgaagcccagcgactgggagaagagcagcaatggccggcagtggaagccccagctgggcttcaacagagacagaagacctgtgcacctggaccaggccgccttccgcaccctgggccacgtgatgccccggggcagcggcaccggcatctacagcaatgctgcccctcctcctgtgacctaccagggcaacctgtaccggcccctgctgcggggccaggcccagatccccaagctgatgagcaacatgaggccccaggacagctggaggggccccccacccctcttccagcagcagagatttgaccggggcgtgggcgctgagcccctgctgccctggaacaggatgctgcagacccagaatgctgccttccagcccaaccagtaccagatgctggccggccctgggggctaccccccaagaagagatgaccggggcggccggcagggctacccccgggagggcaggaagtaccccctgcccccacccagcggccgctacaactggaactag

SEQ ID NO: 141931 - DNA, 2691 bp, Artificial Sequence
  Description of Artificial Sequence: Synthetic coding sequence
atgaatggcatcatccacccctgcacccaccctgaggacaagccagcccccaagaatgaagatgagatgatggtggccatctttgagtacatcgacaggctcttcagcatcgtgcggccccggcggctgctgtacatggccattgatggagtggccccccgggccaagatgaaccagcagaggagccgccgcttccgggccagcaaggagggcatggaggccgctgtggagaagcagagggtgcgggaggagatcctggccaagggcggcttcctgcccccagaggagatcaaggagagatttgacagcaactgcatcaccccaggcacagagttcatggacaacctggccaagtgcctgcgctactacatcgctgaccggctgaacaatgaccccggctggaagaacctgaccgtcatcctgagtgatgccagcgcccctggagagggggagcacaagatcatggactacatccggcggcagagggcccagcccaaccacgaccccaacacccaccactgcctgtgtggggctgatgctgacctgatcatgctgggcctggccacccatgagcccaacttcaccatcatccgggaggagttcaagcccaacaagcccaagccctgtggcctgtgcaaccagtttggacatgaggtgaaggactgtgagggcctgccccgggagaagaagggcaagcatgatgagctggccgacagcctgccctgtgccgagggggagttcatcttcctgcggctgaatgtgctgcgggagtacctggagcgggagctgaccatggccagcctgcccttcacctttgatgtggagaggagcattgatgactgggtgttcatgtgcttctttgtgggcaatgacttcctgccccacctgcccagcctggagatcagagaaaatgccatcgaccggctggtgaacatctacaagaatgtggtgcacaagacaggaggctacctgacagaaagtggctacgtgaacctgcagagggtgcagatgatcatgctggccgtgggggaggtggaggacagcatcttcaagaagaggaaggatgatgaagattccttcagaagacggcagaaggagaagaggaagaggatgaagagggaccagcctgccttcaccccatctggcatcctgacccctcatgccctgggcagcaggaacagccctggcagccaggtggccagcaacccccggcaggccgcctatgagatgaggatgcagaacaacagcagccccagcatcagccccaacaccagcttcaccagtgatggcagccccagccccctgggcggcatcaagaggaaggcagaagattctgattctgagcctgagcctgaggacaacgtgcggctgtgggaggccggctggaagcagcgctactacaagaacaagtttgatgtggatgctgctgatgagaagttccggaggaaggtggtgcagagctatgtggagggcctgtgctgggtgctgcgctactactaccagggctgtgcctcctggaagtggtactaccccttccactacgccccctttgccagtgactttgagggcattgctgacatgcccagcgactttgagaagggcaccaagcccttcaagcccctggagcagctgatgggcgtcttccctgctgccagcggcaacttcctgcccccatcctggaggaagctgatgtctgaccctgacagcagcatcatcgacttctacccagaagattttgccatcgacctgaatggcaagaagtatgcctggcagggcgtggccctgctgccctttgtggatgagcggcggctgcgggccgccctggaggaggtgtacccagacctgaccccagaggagaccaggaggaacagcctgggcggagatgtgctgtttgtgggcaagcaccaccccctgcatgacttcatcctggagctgtaccagacaggcagcacagagcctgtggaggtgcccccagagctgtgccacggcatccagggcaagttcagcctggatgaggaggccatcctgcctgaccagatcgtgtgcagccctgtgcccatgctgcgggacctgacccagaacacagtggtgtccatcaacttcaaggacccccagtttgctgaggactacatcttcaaggctgtgatgctgcccggggccaggaagccagctgctgtgctgaagcccagcgactgggagaagagcagcaatggccggcagtggaagccccagctgggcttcaacagagacagaagacctgtgcacctggaccaggccgccttccgcaccctgggccacgtgatgccccggggcagcggcaccggcatctacagcaatgctgcccctcctcctgtgacctaccagggcaacctgtaccggcccctgctgcggggccaggcccagatccccaagctgatgagcaacatgaggccccaggacagctggaggggccccccacccctcttccagcagcagagatttgaccggggcgtgggcgctgagcccctgctgccctggaacaggatgctgcagacccagaatgctgccttccagcccaaccagtaccagatgctggccggccctgggggctaccccccaagaagagatgaccggggcggccggcagggctacccccgggagggcaggaagtaccccctgcccccacccagcggccgctacaactggaactag

SEQ ID NO: 141932 - DNA, 1779 bp, Artificial Sequence
  Description of Artificial Sequence: Synthetic coding sequence
atggcccctggccagctggccctcttctctgtgtctgacaagacaggcctggtggagtttgccaggaacctgacagccctgggcctgaacctggtggccagcggcggcacagccaaggccctgagagatgctggcctggccgtgagagatgtgtctgagctgaccggcttccctgagatgctgggcggccgggtgaagaccctgcaccctgctgtgcacgccggcatcctggccaggaacatcccagaagataatgctgacatggcccggctggacttcaacctgatccgggtggtggcctgcaacctgtacccctttgtgaagacagtggccagccctggggtgacagtggaggaggccgtggagcagattgacatcggcggcgtgaccctgctgcgggctgctgccaagaaccacgcccgggtgacagtggtgtgtgagccagaagattatgtggtggtgtccacagagatgcagagcagcgagagcaaggacaccagcctggagacccggcggcagctggccctgaaggccttcacccacacagcccagtatgatgaggccatcagtgactacttcaggaagcagtacagcaaaggagtgtcccagatgcccctgcgctatggcatgaacccccaccagaccccagcccagctgtacaccctgcagcccaagctgcccatcaccgtgctgaatggagcccctggcttcatcaacctgtgtgatgccctgaatgcctggcagctggtgaaggagctgaaggaggccctgggcatcccagctgctgccagcttcaagcacgtgtccccagctggagctgctgtgggcatccccctgtctgaagatgaggccaaggtgtgcatggtgtatgacctgtacaagaccctgacccccatctctgctgcctatgcccgggcccggggagctgacaggatgagcagctttggagactttgtggccctgagtgatgtgtgtgatgtgcccacagccaagatcatcagccgggaggtgtctgatggcatcatcgcccctggctatgaggaggaggccctgaccatcctgagcaagaagaagaatggaaactactgtgtgctgcagatggaccagagctacaagccagatgaaaatgaggtgaggaccctgtttggcctgcacctgagccagaagaggaacaacggggtggtggacaagagcctcttcagcaatgtggtgaccaagaacaaggacctgcctgagagcgccctgcgggacctgattgtggccaccatcgctgtgaagtacacccagagcaacagcgtgtgctacgccaagaatggccaggtgattggcatcggggccggccagcagagccgcatccactgcacccggctggccggggacaaggccaactactggtggctgcggcaccacccccaggtgctgtccatgaagttcaagacaggagtgaagagagctgagatcagcaatgccatcgaccagtatgtgacaggcaccatcggagaagatgaagatctcatcaagtggaaggccctgtttgaggaggtgcctgagctgctgacagaggccgagaagaaggagtgggtggagaagctgacagaggtgtccatcagcagtgatgccttcttccccttccgggacaacgtggaccgggccaagagaagtggagtggcctacatcgccgcccccagcggcagcgctgctgacaaggtggtgattgaggcctgtgatgagctgggcatcatcctggcccacaccaacctgcggctcttccaccactag

SEQ ID NO: 141933 - DNA, 1602 bp, Artificial Sequence
  Description of Artificial Sequence: Synthetic coding sequence
atgctgggcggccgggtgaagaccctgcaccctgctgtgcatgctggcatcctggccaggaacatccctgaggacaatgctgacatggcccggctggacttcaacctgatccgggtggtggcctgcaacctgtacccctttgtgaagacagtggccagccctggggtgacagtggaggaggccgtggagcagattgatattggaggagtgaccctgctgcgggccgccgccaagaaccacgcccgggtgacagtggtgtgtgagcctgaggactatgtggtggtgtccacagagatgcagagcagcgagagcaaggacaccagcctggagacccggcggcagctggccctgaaggccttcacccacacagcccagtatgatgaggccatcagtgactacttcaggaagcagtacagcaagggcgtgtcccagatgcccctgcgctatggcatgaacccccaccagaccccagcccagctgtacaccctgcagcccaagctgcccatcaccgtgctgaatggagcccctggcttcatcaacctgtgtgatgccctgaatgcctggcagctggtgaaggagctgaaggaggccctgggcatcccagctgctgccagcttcaagcacgtgtccccagctggagctgctgtgggcatccccctgtctgaagatgaggccaaggtgtgcatggtgtatgacctgtacaagaccctgacccccatctctgctgcctatgcccgggcccggggagctgacaggatgagcagctttggagactttgtggccctgagtgatgtgtgtgatgtgcccacagccaagatcatcagccgggaggtgtctgatggcatcatcgcccctggctatgaggaggaggccctgaccatcctgagcaagaagaagaatggaaactactgtgtgctgcagatggaccagagctacaagccagatgaaaatgaggtgaggaccctgtttggcctgcacctgagccagaagagaaataatggagtggtggacaagagcctcttcagcaatgtggtgaccaagaacaaggacctgcctgagagcgccctgcgggacctgattgtggccaccatcgctgtgaagtacacccagagcaacagcgtgtgctacgccaagaatggccaggtgattggaattggagctggccagcagagccgcatccactgcacccggctggccggggacaaggccaactactggtggctgcggcaccacccccaggtgctgtccatgaagttcaagacaggagtgaagagagctgagatcagcaatgccatcgaccagtatgtgacaggcaccatcggggaggatgaggacctgatcaagtggaaggccctgtttgaggaggtgcctgagctgctgacagaagctgagaagaaggagtgggtggagaagctgacagaggtgtccatcagcagtgatgccttcttccccttccgggacaacgtggaccgggccaagaggtctggagtggcctacatcgccgcccccagcggcagcgctgctgacaaggtggtgattgaggcctgtgatgagctgggcatcatcctggcccacaccaacctgcggctcttccaccactag

SEQ ID NO: 141934 - DNA, 3252 bp, Artificial Sequence
  Description of Artificial Sequence: Synthetic coding sequence
atgaagggcacccgggccatcggctctgtgcctgagaggagccctgctggggtggacctgagcctgaccggcctgcccccacctgtgtccagaagacctggcagcgctgccaccaccaagcccatcgtgcgctctgtgtctgtggtgacaggcagcgagcagaagaggaaggtgctggaggccaccggccctgggggcagccaggccatcaacaacctgcggcgcagcaacagcaccacccaggtgtcccagcccaggagcggcagcccccggcccacagagcccacagacttcctgatgctgtttgagggcagccccagcggcaagaagaggcctgccagcctgagcacagcccccagcgagaagggggccacctggaatgtgctggatgaccagccccggggcttcaccctgcccagcaatgcccggagcagcagcgccctggacagccctgctggccccaggaggaaggagtgcaccgtggccctggcccccaacttcaccgccaacaacagaagcaacaagggagctgtgggcaactgtgtgaccaccatggtgcacaaccgctacaccccatctgagcgggccccacccctgaagagcagcaaccagacagcccccagcctgaacaacatcatcaaggccgccacctgtgagggcagcgagagcagcggctttgggaagctgcccaagaatgtgtcctctgccacccacagcgccaggaacaacacaggaggcagcacaggcctgcccaggaggaaggaggtgacagaggaggaggccgagcgcttcatccaccaggtgaaccaggccaccgtgaccatccagcgctggtaccgccaccaggtgcagaggagaggagctggggccgcccggctggagcacctgctgcaggccaagcgggaggagcagaggcagaggtctggagagggcaccctgctggacctgcaccagcagaaggaggccgcccggaggaaggcccgggaggagaaggcccggcaggcccggcgggccgccatccaggagctgcagcagaagagggccctgcgggcccagaaggccagcacagctgagcggggccccccagagaacccccgggagaccagggtgcccggcatgaggcagcctgcccaggagctgagccccacccctgggggcacagcccaccaggccctgaaggccaacaacacaggaggcggcctgcctgctgctggccctggggaccgctgcctgcccaccagtgacagcagccctgagccccagcagcccccagaggacaggacccaggatgtgctggcccaggatgctgctggggacaacctggagatgatggcccccagccggggcagcgccaagagccggggccccctggaggagctgctgcacaccctgcagctgctggagaaggagccagatgtgctgccccggcccaggacccaccaccggggccgctatgcctgggccagcgaggtgaccacagaagatgatgccagcagcctgacagctgacaacctggagaagtttgggaagctgagcgccttccctgagcccccagaagatggcaccctgctgtctgaggccaagctgcagagcatcatgtccttcctggatgagatggagaagagcggccaggaccagctggacagccagcaggagggctgggtgcctgaggccggccctggccccctggagctgggcagcgaggtgtccacctctgtgatgaggctgaagctggaggtggaggagaagaagcaggccatgctgctgctgcagagggccctggcccagcagagggacctgacagccaggagagtgaaggagacagagaaggccctgagccggcagctgcagaggcagcgggagcactatgaggccaccatccagaggcacctggccttcatcgaccagctgattgaggacaagaaggtgctgtctgagaagtgtgaggccgtggtggccgagctgaagcaggaggaccagcgctgcacagagcgggtggcccaggcccaggcccagcacgagctggagatcaagaagctgaaggagctgatgtctgccacagagaaggcccggcgggagaagtggatcagcgagaagaccaagaagatcaaggaggtgacagtgcggggcctggagcctgagatccagaagctgattgcccggcacaagcaggaggtgcggcggctgaagagcctgcatgaagctgagctgctgcagagtgatgagcgggccagccagcgctgcctgcggcaggccgaggagctgcgggagcagctggagcgggagaaggaggccctgggccagcaggagcgggagcgggcccggcagcgcttccagcagcacctggagcaggagcagtgggccctgcagcagcagaggcagaggctgtacagcgaggtggccgaggagcgggagcggctgggccagcaggccgcccggcagagagctgagctggaggagctgcggcagcagctggaggagagcagcagcgccctgacccgggccctgcgggcagagtttgagaagggccgggaggagcaggagaggaggcaccagatggagctgaacaccctgaagcagcagctggagctggagcggcaggcctgggaggccggccgcaccaggaaggaggaggcctggctgctgaaccgggagcaggagctgcgggaggagatcaggaagggccgggacaaggagattgagctggtgatccaccggctggaggccgacatggccctggccaaggaggagagcgagaaggctgctgagagccgcatcaagaggctgcgggacaagtatgaagctgagctgtctgagctggagcagagcgagaggaagctgcaggagcgctgcagcgagctgaagggccagctgggggaggccgagggggagaacctgcggctgcagggcctggtgcggcagaaggagcgggccctggaggatgcccaggccgtgaatgagcagctgagcagcgagaggagcaacctggcccaggtgatccggcaggagtttgaagatcggctggccgccagcgaggaggagacccggcaggccaaggccgagctggccaccctgcaggcccggcagcagctggagctggaggaggtgcaccggcgggtgaagacagccctggccaggaaggaggaggccgtgagcagcctgcggacccagcacgaggccgctgtgaagagagctgaccacctggaggagctgctggagcagcaccggcggcccacccccagcaccaagtag

SEQ ID NO: 141935 - DNA, 3135 bp, Artificial Sequence
  Description of Artificial Sequence: Synthetic coding sequence
atgaagggcacccgggccatcggctctgtgcctgagaggagccctgctggggtggacctgagcctgaccggcctgcccccacctgtgtccagaagacctggcagcgctgccaccaccaagcccatcgtgcgctctgtgtctgtggtgacaggcagcgagcagaagaggaaggtgctggaggccaccggccctgggggcagccaggccatcaacaacctgcggcgcagcaacagcaccacccaggtgtcccagcccaggagcggcagcccccggcccacagagcccacagacttcctgatgctgtttgagggcagccccagcggcaagaagaggcctgccagcctgagcacagcccccagcgagaagggggccacctggaatgtgctggatgaccagccccggggcttcaccctgcccagcaatgcccggagcagcagcgccctggacagccctgctggccccaggaggaaggagtgcaccgtggccctggcccccaacttcaccgccaacaacagaagcaacaagggagctgtgggcaactgtgtgaccaccatggtgcacaaccgctacaccccatctgagcgggccccacccctgaagagcagcaaccagacagcccccagcctgaacaacatcatcaaggccgccacctgtgagggcagcgagagcagcggctttgggaagctgcccaagaatgtgtcctctgccacccacagcgccaggaacaacacaggaggcagcacaggcctgcccaggaggaaggaggtgacagaggaggaggccgagcgcttcatccaccaggtgaaccaggccaccgtgaccatccagcgctggtaccgccaccaggtgcagaggagaggagctggggccgcccggctggagcacctgctgcaggccaagcgggaggagcagaggcagaggtctggagagggcaccctgctggacctgcaccagcagaaggaggccgcccggaggaaggcccgggaggagaaggcccggcaggcccggcgggccgccatccaggagctgcagcagaagagggccctgcgggcccagaaggccagcacagctgagcggggccccccagagaacccccgggagaccagggtgcccggcatgaggcagcctgcccaggagctgagccccacccctgggggcacagcccaccaggccctgaaggccaacaacacaggaggcggcctgcctgctgctggccctggggaccgctgcctgcccaccagtgacagcagccctgagccccagcagcccccagaggacaggacccaggatgtgctggcccaggatgctgctggggacaacctggagatgatggcccccagccggggcagcgccaagagccggggccccctggaggagctgctgcacaccctgcagctgctggagaaggagccagatgtgctgccccggcccaggacccaccaccggggccgctatgcctgggcctctgaagaagatgatgccagcagcctgacagctgacaacctggagaagtttgggaagctgagcgccttccctgagcccccagaagatggcaccctgctgtctgaggccaagctgcagagcatcatgtccttcctggatgagatggagaagagcggccaggaccagctggacagccagcaggagggctgggtgcctgaggccggccctggccccctggagctgggcagcgaggtgtccacctctgtgatgaggctgaagctggaggtggaggagaagaagcaggccatgctgctgctgcagagggccctggcccagcagagggacctgacagcccggcgggtgaaggagacagagaaggccctgagccggcagctgcagaggcagcgggagcactatgaggccaccatccagaggcacctggccttcatcgaccagctgattgaggacaagaaggtgctgtctgagaagtgtgaggccgtggtggccgagctgaagcaggaggaccagcgctgcacagagcgggtggcccaggcccaggcccagcacgagctggagatcaagaagctgaaggagctgatgtctgccacagagaaggcccggcgggagaagtggatcagcgagaagaccaagaagatcaaggaggtgacagtgcggggcctggagcctgagatccagaagctgattgcccggcacaagcaggaggtgcggcggctgaagagcctgcacgaggccgagctgctgcagagtgatgagcgggccagccagcgctgcctgcggcaggccgaggagctgcgggagcagctggagcgggagaaggaggccctgggccagcaggagcgggagcgggcccggcagaggcagagagctgagctggaggagctgcggcagcagctggaggagagcagcagcgccctgacccgggccctgcgggcagagtttgagaagggccgggaggagcaggagcggcggcaccagatggagctgaacaccctgaagcagcagctggagctggagcggcaggcctgggaggccggccgcaccaggaaggaggaggcctggctgctgaaccgggagcaggagctgcgggaggagatcaggaagggccgggacaaggagattgagctggtgatccaccggctggaggccgacatggccctggccaaggaggagagcgagaaggctgctgagagccgcatcaagaggctgcgggacaagtatgaggccgagctgtctgagctggagcagagcgagaggaagctgcaggagcgctgcagcgagctgaagggccagctgggggaggccgagggggagaacctgcggctgcagggcctggtgcggcagaaggagcgggccctggaggatgcccaggccgtgaatgagcagctgagcagcgagaggagcaacctggcccaggtgatccggcaggagtttgaggaccggctggccgccagcgaggaggagacccggcaggccaaggccgagctggccaccctgcaggcccggcagcagctggagctggaggaggtgcacagaagagtgaagacagccctggccaggaaggaggaggccgtgagcagcctgcggacccagcatgaagctgctgtgaagagagctgaccacctggaggagctgctggagcagcacagaagacccacccccagcaccaagtag

SEQ ID NO: 141936 - DNA, 3243 bp, Artificial Sequence
  Description of Artificial Sequence: Synthetic coding sequence
atgaagggcacccgggccatcggctctgtgcctgagaggagccctgctggggtggacctgagcctgaccggcctgcccccacctgtgtccagaagacctggcagcgctgccaccaccaagcccatcgtgcgctctgtgtctgtggtgacaggcagcgagcagaagaggaaggtgctggaggccaccggccctgggggcagccaggccatcaacaacctgcggcgcagcaacagcaccacccaggtgtcccagcccaggagcggcagcccccggcccacagagcccacagacttcctgatgctgtttgagggcagccccagcggcaagaagaggcctgccagcctgagcacagcccccagcgagaagggggccacctggaatgtgctggatgaccagccccggggcttcaccctgcccagcaatgcccggagcagcagcgccctggacagccctgctggccccaggaggaaggagtgcaccgtggccctggcccccaacttcaccgccaacaacagaagcaacaagggagctgtgggcaactgtgtgaccaccatggtgcacaaccgctacaccccatctgagcgggccccacccctgaagagcagcaaccagacagcccccagcctgaacaacatcatcaaggccgccacctgtgagggcagcgagagcagcggctttgggaagctgcccaagaatgtgtcctctgccacccacagcgccaggaacaacacaggaggcagcacaggcctgcccaggaggaaggaggtgacagaggaggaggccgagcgcttcatccaccaggtgaaccaggccaccgtgaccatccagcgctggtaccgccaccaggtgcagaggagaggagctggggccgcccggctggagcacctgctgcaggccaagcgggaggagcagaggcagaggtctggagagggcaccctgctggacctgcaccagcagaaggaggccgcccggaggaaggcccgggaggagaaggcccggcaggcccggcgggccgccatccaggagctgcagcagaagagggccctgcgggcccagaaggccagcacagctgagcggggccccccagagaacccccgggagaccagggtgcccggcatgaggcagcctgcccaggagctgagccccacccctgggggcacagcccaccaggccctgaaggccaacaacacaggaggcggcctgcctgctgctggccctggggaccgctgcctgcccaccagtgacagcagccctgagccccagcagcccccagaggacaggacccaggatgtgctggcccaggatgctgctggggacaacctggagatgatggcccccagccggggcagcgccaagagccggggccccctggaggagctgctgcacaccctgcagctgctggagaaggagccagatgtgctgccccggcccaggacccaccaccggggccgctatgcctgggcctctgaagaagatgatgccagcagcctgacagctgacaacctggagaagtttgggaagctgagcgccttccctgagcccccagaagatggcaccctgctgtctgaggccaagctgcagagcatcatgtccttcctggatgagatggagaagagcggccaggaccagctggacagccagcaggagggctgggtgcctgaggccggccctggccccctggagctgggcagcgaggtgtccacctctgtgatgaggctgaagctggaggtggaggagaagaagcaggccatgctgctgctgcagagggccctggcccagcagagggacctgacagcccggcgggtgaaggagacagagaaggccctgagccggcagctgcagaggcagcgggagcactatgaggccaccatccagaggcacctggccttcatcgaccagctgattgaggacaagaaggtgctgtctgagaagtgtgaggccgtggtggccgagctgaagcaggaggaccagcgctgcacagagcgggtggcccaggcccaggcccagcacgagctggagatcaagaagctgaaggagctgatgtctgccacagagaaggcccggcgggagaagtggatcagcgagaagaccaagaagatcaaggaggtgacagtgcggggcctggagcctgagatccagaagctgattgcccggcacaagcaggaggtgcggcggctgaagagcctgcacgaggccgagctgctgcagagtgatgagcgggccagccagcgctgcctgcggcaggccgaggagctgcgggagcagctggagcgggagaaggaggccctgggccagcaggagcgggagcgggcccggcagcgcttccagcagcacctggagcaggagcagtgggccctgcagcagcagaggcagaggctgtacagcgaggtggccgaggagcgggagcggctgggccagcaggccgcccggcagagagctgagctggaggagctgcggcagcagctggaggagagcagcagcgccctgacccgggccctgcgggcagagtttgagaagggccgggaggagcaggagcggcggcaccagatggagctgaacaccctgaagcagcagctggagctggagcggcaggcctgggaggccggccgcaccaggaaggaggaggcctggctgctgaaccgggagcaggagctgcgggaggagatcaggaagggccgggacaaggagattgagctggtgatccaccggctggaggccgacatggccctggccaaggaggagagcgagaaggctgctgagagccgcatcaagaggctgcgggacaagtatgaggccgagctgtctgagctggagcagagcgagaggaagctgcaggagcgctgcagcgagctgaagggccagctgggggaggccgagggggagaacctgcggctgcagggcctggtgcggcagaaggagcgggccctggaggatgcccaggccgtgaatgagcagctgagcagcgagaggagcaacctggcccaggtgatccggcaggagtttgaggaccggctggccgccagcgaggaggagacccggcaggccaaggccgagctggccaccctgcaggcccggcagcagctggagctggaggaggtgcacagaagagtgaagacagccctggccaggaaggaggaggccgtgagcagcctgcggacccagcatgaagctgctgtgaagagagctgaccacctggaggagctgctggagcagcacagaagacccacccccagcaccaagtag

SEQ ID NO: 141937 - DNA, 699 bp, Artificial Sequence
  Description of Artificial Sequence: Synthetic coding sequence
atggatgccctggtggaggatgacatctgcatcctgaaccacgagaaggcccacaagagggacacagtgacccctgtgtccatctacagcggagatgagagcgtggccagccactttgccctggtgacagcctatgaggacatcaagaagaggctgaaggacagcgagaaggagaacagcctgctgaagaagaggatccgcttcctggaggagaagctgattgccaggtttgaggaggagaccagctctgtgggccgggagcaggtgaacaaggcctaccacgcctaccgggaggtgtgcatcgaccgggacaacctgaagagcaagctggacaagatgaacaaggacaacagcgagagcctgaaggtgctgaatgagcagctgcagagcaaggaggtggagctgctgcagctgaggacagaggtggagacccagcaggtgatgaggaacctgaacccccccagcagcaactgggaggtggagaagctgagctgtgacctgaagatccacggcctggagcaggagctggagctgatgaggaaggagtgcagcgacctgaagattgagctgcagaaggccaagcagacagacccctaccaggaggacaacctgaagagccgggacctgcagaagctgagcatcagccgggtgtctgtggcccagcccggggtgcagtggagaaatcatggaattgcctag

SEQ ID NO: 141938 - DNA, 648 bp, Artificial Sequence
  Description of Artificial Sequence: Synthetic coding sequence
atggatgccctggtggaggatgacatctgcatcctgaaccacgagaaggcccacaagagggacacagtgacccctgtgtccatctacagcggagatgagagcgtggccagccactttgccctggtgacagcctatgaggacatcaagaagaggctgaaggacagcgagaaggagaacagcctgctgaagaagaggatccgcttcctggaggagaagctgattgccaggtttgaggaggagaccagctctgtgggccgggagcaggtgaacaaggcctaccacgcctaccgggaggtgtgcatcgaccgggacaacctgaagagcaagctggacaagatgaacaaggacaacagcgagagcctgaaggtgctgaatgagcagctgcagagcaaggaggtggagctgctgcagctgaggacagaggtggagacccagcaggtgatgaggaacctgaacccccccagcagcaactgggaggtggagaagctgagctgtgacctgaagatccacggcctggagcaggagctggagctgatgaggaaggagtgcagcgacctgaagattgagctgcagaaggccaagcagacagacccctaccaggaggacaacctgaagagccgggacctgcagaagctgagcatctcctag

SEQ ID NO: 141939 - DNA, 288 bp, Artificial Sequence
  Description of Artificial Sequence: Synthetic coding sequence
atggatgccctggtggaggatgacatctgcatcctgaaccacgagaaggcccacaagagggacacagtgacccctgtgtccatctacagcggagatgagagcgtggccagccactttgccctggtgacagcctatgaggacatcaagaagaggctgaaggacagcgagaaggagaacagcctgctgaagaagaggatccgcttcctggaggagaagctgattgccaggtttgaggaggagaccagctctgtgggccgggagcaggtgaacaaggcctaccacgcctag

SEQ ID NO: 141940 - DNA, 732 bp, Artificial Sequence
  Description of Artificial Sequence: Synthetic coding sequence
atggatgccctggtggaggatgacatctgcatcctgaaccacgagaaggcccacaagagggacacagtgacccctgtgtccatctacagcggagatgagagcgtggccagccactttgccctggtgacagcctatgaggacatcaagaagaggctgaaggacagcgagaaggagaacagcctgctgaagaagaggatccgcttcctggaggagaagctgattgccaggtttgaggaggagaccagctctgtgggccgggagcaggtgaacaaggcctaccacgcctaccgggaggtgtgcatcgaccgggacaacctgaagagcaagctggacaagatgaacaaggacaacagcgagagcctgaaggtgctgaatgagcagctgcagagcaaggaggtggagctgctgcagctgaggacagaggtggagacccagcaggtgatgaggaacctgaacccccccagcagcaactgggaggtggagaagctgagctgtgacctgaagatccacggcctggagcaggagctggagctgatgaggaaggagtgcagcgacctgaagattgagctgcagaaggccaagcagacagacccctaccaggaggacaacctgaagagccgggacctgcagaagctgagcatcagccggcagagcatctgcagcacagcctggagcgctgtggcccagagctgggacagcatgaactttgaggactgcagcctgtttgcctag

SEQ ID NO: 141941 - DNA, 732 bp, Artificial Sequence; identical to SEQ ID NO: 141940
  Description of Artificial Sequence: Synthetic coding sequence

SEQ ID NO: 141942 - DNA, 1179 bp, Artificial Sequence
  Description of Artificial Sequence: Synthetic coding sequence
atggatgccctggtggaggatgacatctgcatcctgaaccacgagaaggcccacaagagggacacagtgacccctgtgtccatctacagcggagatgagagcgtggccagccactttgccctggtgacagcctatgaggacatcaagaagaggctgaaggacagcgagaaggagaacagcctgctgaagaagaggatccgcttcctggaggagaagctgattgccaggtttgaggaggagaccagctctgtgggccgggagcaggtgaacaaggcctaccacgcctaccgggaggtgtgcatcgaccgggacaacctgaagagcaagctggacaagatgaacaaggacaacagcgagagcctgaaggtgctgaatgagcagctgcagagcaaggaggtggagctgctgcagctgaggacagaggtggagacccagcaggtgatgaggaacctgaacccccccagcagcaactgggaggtggagaagctgagctgtgacctgaagatccacggcctggagcaggagctggagctgatgaggaaggagtgcagcgacctgaagattgagctgcagaaggccaagcagacagacccctaccaggaggacaacctgaagagccgggacctgcagaagctgagcatcagcagtgacaacatgcagcacgcctactgggagctgaagcgggagatgagcaacctgcacctggtgacccaggtgcaggccgagctgctgaggaagctgaagaccagcacagccatcaagaaggcctgtgcccctgtgggctgcagcgaggacctgggccgggacagcaccaagctgcacctgatgaacttcaccgccacctacaccaggcacccccccctgctgcccaacgggaaggccctgtgccacaccaccagcagccccctgcctggagatgtgaaggtgctgtctgagaaggccatcctgcagagctggacagacaatgaaagaagcatccccaatgatggcacctgcttccaggagcacagcagctatggaagaaacagcctggaggacaacagctgggtgttccccagcccccccaagagcagcgagacagccttcggggagaccaagaccaagaccctgcccctgcccaacctgccccccctgcactacctggaccagcacaaccagaactgcctgtacaagaactag

SEQ ID NO: 141943 - DNA, 1269 bp, Artificial Sequence
  Description of Artificial Sequence: Synthetic coding sequence
atggatgtgctgagccctggccagggcaacaacaccaccagccccccagccccctttgaaacaggaggcaacaccaccggcatcagtgatgtgacagtgtcctaccaggtgatcaccagcctgctgctgggcaccctcatcttctgtgctgtgctgggcaatgcctgtgtggtggccgccatcgccctggagaggagcctgcagaatgtggccaactacctgattggcagcctggccgtgacagacctgatggtgtctgtgctggtgctgcccatggccgccctgtaccaggtgctgaacaagtggaccctgggccaggtgacctgtgacctcttcatcgccctggatgtgctgtgctgcaccagcagcatcctgcacctgtgtgccatcgccctggaccgctactgggccatcacagaccccatcgactatgtgaacaagaggaccccaagaagagctgctgccctgatcagcctgacctggctgattggcttcctgatcagcatcccccccatgctgggctggaggaccccagaagatagaagtgaccctgatgcctgcaccatcagcaaggaccacggctacaccatctacagcacctttggagccttctacatccccctgctgctgatgctggtgctgtatggccgcatcttccgggccgcccgcttccgcatcaggaagacagtgaagaaggtggagaagacaggagctgacaccaggcatggagccagccctgccccccagcccaagaagtctgtgaatggagagagcggcagcaggaactggaggctgggcgtggagagcaaggccggcggggccctgtgtgccaacggggctgtgcggcagggagatgatggagctgccctggaggtgattgaggtgcaccgggtgggcaacagcaaggagcacctgcccctgcccagcgaggccggccccaccccctgtgccccagccagctttgagaggaagaatgaaagaaatgctgaggccaagaggaagatggccctggcccgggagaggaagacagtgaagaccctgggcatcatcatgggcaccttcatcctgtgctggctgcccttcttcatcgtggccctggtgctgcccttctgtgagagcagctgccacatgcccaccctgctgggcgccatcatcaactggctgggctacagcaacagcctgctgaaccctgtgatctatgcctacttcaacaaggacttccagaatgccttcaagaagatcatcaagtgcaagttctgccggcagtag

SEQ ID NO: 141944 - DNA, 129 bp, Artificial Sequence
  Description of Artificial Sequence: Synthetic coding sequence
atggatgtgctgagccctggccagggcaacaacaccaccagccccccagccccctttgaaacaggaggcaacaccaccggcatcagtgatgtgacagtgtcctaccaggtgatcaccagcctgctgtag

SEQ ID NO: 141945 - DNA, 1173 bp, Artificial Sequence
  Description of Artificial Sequence: Synthetic coding sequence
atggaggagcccggggcccagtgtgcccctcctcctcctgctggcagcgagacctgggtgccccaggccaacctgagcagcgcccccagccagaactgcagcgccaaggactacatctaccaggacagcatcagcctgccctggaaggtgctgctggtgatgctgctggccctgatcaccctggccaccaccctgagcaatgcctttgtgattgccaccgtgtaccgcaccaggaagctgcacaccccagccaactacctgattgccagcctggccgtgacagacctgctggtgtccatcctggtgatgcccatcagcaccatgtacacagtgacaggccgctggaccctgggccaggtggtgtgtgacttctggctgagcagtgacatcacctgctgcacagccagcatcctgcacctgtgtgtgattgccctggaccgctactgggccatcacagatgctgtggagtacagcgccaagaggacccccaagagagctgctgtgatgattgccctggtgtgggtgttcagcatcagcatcagcctgccccccttcttctggaggcaggccaaggccgaggaggaggtgtctgaatgtgtggtgaacacagaccacatcctgtacacagtgtacagcacagtgggcgccttctacttccccaccctgctgctgattgccctgtatggccgcatctacgtggaggcccggagccgcatcctgaagcagacccccaacagaacaggcaagaggctgacccgggcccagctgatcacagacagccctggcagcaccagctctgtgaccagcatcaacagccgggtgcctgatgtgcccagcgagagcggcagccctgtgtatgtgaaccaggtgaaggtgcgggtgtctgatgccctgctggagaagaagaagctgatggccgcccgggagaggaaggccaccaagaccctgggcatcatcctgggcgccttcatcgtgtgctggctgcccttcttcatcatcagcctggtgatgcccatctgcaaggatgcctgctggttccacctggccatctttgacttcttcacctggctgggctacctgaacagcctcatcaaccccatcatctacaccatgagcaatgaagacttcaagcaggccttccacaagctgatccgcttcaagtgcaccagctag

SEQ ID NO: 141946 - DNA, 1134 bp, Artificial Sequence
  Description of Artificial Sequence: Synthetic coding sequence
atgagccccctgaaccagagcgctgagggcctgccccaggaggccagcaacagaagcctgaatgccacagagaccagcgaggcctgggaccccaggaccctgcaggccctgaagatcagcctggccgtggtgctgagcgtcatcaccctggccaccgtgctgagcaatgcctttgtgctgaccaccatcctgctgaccaggaagctgcacaccccagccaactacctgattggcagcctggccaccacagacctgctggtgtccatcctggtgatgcccatcagcatcgcctacaccatcacccacacctggaactttggccagatcctgtgtgacatctggctgagcagtgacatcacctgctgcacagccagcatcctgcacctgtgtgtgattgccctggaccgctactgggccatcacagatgccctggagtacagcaagagaagaacagctggccatgctgccaccatgattgccatcgtgtgggccatcagcatctgcatcagcatccccccactcttctggaggcaggccaaggcccaggaggagatgtctgactgcctggtgaacaccagccagatctcctacaccatctacagcacctgtggggccttctacatccccagcgtgctgctgatcatcctgtatggccgcatctacagagctgccaggaaccgcatcctgaacccccccagcctgtatggcaagcgcttcaccacagcccacctgatcaccggcagcgctggcagcagcctgtgcagcctgaacagcagcctgcacgagggccacagccacagcgctggcagccccctcttcttcaaccacgtgaagatcaagctggccgacagcgccctggagaggaagaggatctctgctgcccgggagaggaaggccaccaagatcctgggcatcatcctgggcgccttcatcatctgctggctgcccttctttgtggtgtccctggtgctgcccatctgccgggacagctgctggatccacccagccctgtttgacttcttcacctggctgggctacctgaacagcctcatcaaccccatcatctacacagtgttcaatgaggagttccggcaggccttccagaagatcgtgcccttcaggaaggccagctag

SEQ ID NO: 141947 - DNA, 1134 bp, Artificial Sequence; identical to SEQ ID NO: 141946
  Description of Artificial Sequence: Synthetic coding sequence

SEQ ID NO: 141948 - DNA, 1098 bp, Artificial Sequence
  Description of Artificial Sequence: Synthetic coding sequence
atgaacatcaccaactgcaccacagaggcctccatggccatccggcccaagaccatcacagagaagatgctgatctgcatgaccctggtggtgatcaccaccctgaccaccctgctgaacctggccgtcatcatggccatcggcaccaccaagaagctgcaccagcctgccaactacctgatctgcagcctggccgtgacagacctgctggtggccgtgctggtgatgcccctgagcatcatctacatcgtgatggaccgctggaagctgggctacttcctgtgtgaggtgtggctgtctgtggacatgacctgctgcacctgcagcatcctgcacctgtgtgtgattgccctggaccgctactgggccatcaccaatgccatcgagtatgccaggaagaggacagccaagagagctgccctgatgatcctgactgtgtggaccatcagcatcttcatctccatgccacccctcttctggaggagccaccggcggctgagccccccacccagccagtgcaccatccagcacgaccacgtgatctacaccatctacagcaccctgggcgccttctacatccccctgaccctcatcctgatcctgtactaccgcatctaccacgccgccaagagcctgtaccagaagaggggcagcagccgccacctgagcaacagaagcacagacagccagaacagctttgccagctgcaagctgacccagaccttctgtgtgtctgacttcagcaccagtgaccccaccacagaatttgagaagttccacgccagcatccgcatccccccatttgacaatgacctggaccaccctggagagcggcagcagatcagcagcacccgggagaggaaggccgcccgcatcctgggcctcatcctgggcgccttcatcctgtcctggctgcccttcttcatcaaggagctgattgtgggcctgagcatctacacagtgtcctctgaggtggccgacttcctgacctggctgggctacgtgaacagcctcatcaaccccctgctgtacaccagcttcaatgaagacttcaagctggccttcaagaagctgatccgctgccgggagcacacctag

SEQ ID NO: 141949 - DNA, 1098 bp, Artificial Sequence; identical to SEQ ID NO: 141948
  Description of Artificial Sequence: Synthetic coding sequence

SEQ ID NO: 141950 - DNA, 1101 bp, Artificial Sequence
  Description of Artificial Sequence: Synthetic coding sequence
atggacttcctgaacagcagtgaccagaacctgaccagcgaggagctgctgaacaggatgcccagcaagatcctggtgtccctgaccctgagcggcctggccctgatgaccaccaccatcaacagcctggtgattgctgccatcatcgtgaccaggaagctgcaccacccagccaactacctgatctgcagcctggccgtgacagacttcctggtggccgtgctggtgatgcccttcagcatcgtgtacatcgtgcgggagagctggatcatgggccaggtggtgtgtgacatctggctgtctgtggacatcacctgctgcacctgcagcatcctgcacctgagcgccatcgccctggaccgctaccgggccatcacagatgctgtggagtatgccaggaagaggacccccaagcacgccggcatcatgatcaccatcgtgtggatcatctctgtgttcatctccatgcctcctctcttctggaggcaccagggcaccagcagagatgatgagtgcatcatcaagcatgaccacatcgtgtccaccatctacagcacctttggagccttctacatccccctggccctgatcctgatcctgtactacaagatctacagagctgccaagaccctgtaccacaagaggcaggccagccgcatcgccaaggaggaggtgaatggccaggtgctgctggagagcggggagaagagcaccaagtctgtgtccaccagctatgtgctggagaagagcctgagtgaccccagcacagactttgacaagatccacagcacagtgcgcagcctgcggtctgagttcaagcatgagaagtcctggaggcggcagaagatcagcggcacccgggagaggaaggccgccaccaccctgggcctcatcctgggcgccttcgtcatctgctggctgcccttctttgtgaaggagctggtggtgaatgtgtgtgacaagtgcaagatcagcgaggagatgagcaacttcctggcctggctgggctacctgaacagcctcatcaaccccctcatctacaccatcttcaatgaagacttcaagaaggccttccagaagctggtgcgctgccgctgctag

SEQ ID NO: 141951 - DNA, 1416 bp, Artificial Sequence
  Description of Artificial Sequence: Synthetic coding sequence
atggacatcctgtgtgaggagaacaccagcctgagcagcaccaccaacagcctgatgcagctgaatgatgacacccggctgtacagcaatgacttcaacagcggggaggccaacaccagtgatgccttcaactggacagtggacagcgagaacagaaccaacctgagctgtgagggctgcctgagccccagctgcctgagcctgctgcacctgcaggagaagaactggagcgccctgctgacagctgtggtgatcatcctgaccatcgccggcaacatcctggtgatcatggctgtgtccctggagaagaagctgcagaatgccaccaactacttcctgatgagcctggccatcgctgacatgctgctgggcttcctggtgatgcctgtgtccatgctgaccatcctgtatggctaccgctggcccctgcccagcaagctgtgtgctgtgtggatctacctggatgtgctcttcagcacagccagcatcatgcacctgtgtgccatcagcctggaccgctacgtggccatccagaaccccatccaccacagccgcttcaacagcaggaccaaggccttcctgaagatcatcgctgtgtggaccatctctgtgggcatctccatgcccatccctgtgtttggcctgcaggatgacagcaaggtgttcaaggagggcagctgcctgctggctgatgacaactttgtgctgattggcagctttgtgtccttcttcatccccctgaccatcatggtgatcacctacttcctgaccatcaagagcctgcagaaggaggccaccctgtgtgtgtctgacctgggcacccgggccaagctggccagcttctccttcctgccccagagcagcctgagcagcgagaagctgttccagaggagcatccaccgggagcccggcagctacacaggaagaaggaccatgcagagcatcagcaatgagcagaaggcctgcaaggtgctgggcatcgtgttcttcctgtttgtggtgatgtggtgccccttcttcatcaccaacatcatggccgtcatctgcaaggagagctgcaatgaagatgtgattggagccctgctgaatgtgtttgtgtggattggctacctgagcagcgctgtgaaccccctggtgtacaccctcttcaacaagacctacagaagtgccttcagccgctacatccagtgccagtacaaggagaacaagaagcccctgcagctgatcctggtgaacaccatcccagccctggcctacaagagcagccagctgcagatgggccagaagaagaacagcaagcaggatgccaagaccacagacaatgactgcagcatggtggccctgggcaagcagcacagcgaggaggccagcaaggacaacagtgatggagtgaatgagaaggtgtcctgtgtgtag

SEQ ID NO: 141952 - DNA, 1416 bp, Artificial Sequence; identical to SEQ ID NO: 141951
  Description of Artificial Sequence: Synthetic coding sequence

SEQ ID NO: 141953 - DNA, 1164 bp, Artificial Sequence
  Description of Artificial Sequence: Synthetic coding sequence
atgcagttcctgaagagcgccaagcagaagcccaactactaccacatcatgctggtggaggaccaggaggagggcaccctgcaccagttcaactactgtgagcgctgcagcgagagccagaacaacaagtgcatcagctgtgtggaccctgaggacaagtggtaccgctggcccctgcccagcaagctgtgtgctgtgtggatctacctggatgtgctcttcagcacagccagcatcatgcacctgtgtgccatcagcctggaccgctacgtggccatccagaaccccatccaccacagccgcttcaacagcaggaccaaggccttcctgaagatcatcgctgtgtggaccatctctgtgggcatctccatgcccatccctgtgtttggcctgcaggatgacagcaaggtgttcaaggagggcagctgcctgctggctgatgacaactttgtgctgattggcagctttgtgtccttcttcatccccctgaccatcatggtgatcacctacttcctgaccatcaagagcctgcagaaggaggccaccctgtgtgtgtctgacctgggcacccgggccaagctggccagcttctccttcctgccccagagcagcctgagcagcgagaagctgttccagaggagcatccaccgggagcccggcagctacacaggaagaaggaccatgcagagcatcagcaatgagcagaaggcctgcaaggtgctgggcatcgtgttcttcctgtttgtggtgatgtggtgccccttcttcatcaccaacatcatggccgtcatctgcaaggagagctgcaatgaagatgtgattggagccctgctgaatgtgtttgtgtggattggctacctgagcagcgctgtgaaccccctggtgtacaccctcttcaacaagacctacagaagtgccttcagccgctacatccagtgccagtacaaggagaacaagaagcccctgcagctgatcctggtgaacaccatcccagccctggcctacaagagcagccagctgcagatgggccagaagaagaacagcaagcaggatgccaagaccacagacaatgactgcagcatggtggccctgggcaagcagcacagcgaggaggccagcaaggacaacagtgatggagtgaatgagaaggtgtcctgtgtgtag

SEQ ID NO: 141954 - DNA, 1446 bp, Artificial Sequence
  Description of Artificial Sequence: Synthetic coding sequence
atggccctgagctacagagtgtctgagctgcagagcaccatccctgagcacatcctgcagagcacctttgtgcacgtgatcagcagcaactggagcggcctgcagacagagagcatccctgaggagatgaagcagatcgtggaggagcagggcaacaagctgcactgggccgccctgctgatcctgatggtgatcatccccaccatcggcggcaacaccctggtgatcctggccgtgtccctggagaagaagctgcagtatgccaccaactacttcctgatgagcctggccgtggccgacctgctggtgggcctgtttgtgatgcccatcgccctgctgaccatcatgtttgaggccatgtggcccctgcccctggtgctgtgcccagcctggctgttcctggatgtgctcttcagcacagccagcatcatgcacctgtgtgccatctctgtggaccgctacatcgccatcaagaagcccatccaggccaaccagtacaacagccgggccacagccttcatcaagatcaccgtggtgtggctgatcagcatcggcatcgccatccctgtgcccatcaagggcattgaaacagatgtggacaaccccaacaacatcacctgtgtgctgaccaaggagagatttggagacttcatgctgtttggcagcctggccgccttcttcacccccctggccatcatgattgtgacctacttcctgaccatccacgccctgcagaagaaggcctacctggtgaagaacaagccaccccagaggctgacctggctgactgtgtccaccgtcttccagagagatgagaccccctgcagcagccctgagaaggtggccatgctggatggcagcaggaaggacaaggccctgcccaacagcggagatgagaccctgatgaggaggaccagcaccatcggcaagaagtctgtgcagaccatcagcaatgagcagagggccagcaaggtgctgggcatcgtgttcttcctgttcctgctgatgtggtgccccttcttcatcaccaacatcaccctggtgctgtgtgacagctgcaaccagaccaccctgcagatgctgctggagatctttgtgtggattggctacgtgtcctctggagtgaaccccctggtgtacaccctcttcaacaagaccttcagagatgccttcggccgctacatcacctgcaactaccgggccaccaagtctgtgaagaccctgaggaagaggagcagcaagatctacttcaggaaccccatggccgagaacagcaagttcttcaagaagcacggcatcagaaatggcatcaacccagccatgtaccagagccccatgaggctgcggagcagcaccatccagagcagcagcatcatcctgctggacaccctgctgctgacagaaaatgaaggagacaagacagaggagcaggtgtcctatgtgtag

SEQ ID NO: 141955 - DNA, 195 bp, Artificial Sequence
  Description of Artificial Sequence: Synthetic coding sequence
atggtgatcatccccaccatcggcggcaacaccctggtgatcctggccgtgtccctggagaagaagctgcagtatgccaccaactacttcctgatgagcctggccgtggccgacctgctggtgggcctgtttgtgatgcccatcgccctgctgaccatcatgtttggaattgccatccctgtgcccatcaagtag

SEQ ID NO: 141956 - DNA, 1377 bp, Artificial Sequence
  Description of Artificial Sequence: Synthetic coding sequence
atggtgaacctgagaaatgctgtgcacagcttcctggtgcacctgattggcctgctggtgtggcagtgtgacatctctgtgtcccctgtggccgccatcgtgacagacatcttcaacaccagtgatggcggccgcttcaagttcccagatggagtgcagaactggccagccctgagcatcgtcatcatcatcatcatgaccatcggcggcaacatcctggtgatcatggctgtgtccatggagaagaagctgcacaatgccaccaactacttcctgatgagcctggccatcgctgacatgctggtgggcctgctggtgatgcccctgagcctgctggccatcctgtatgactatgtgtggcccctgccccgctacctgtgccctgtgtggatcagcctggatgtgctcttcagcacagccagcatcatgcacctgtgtgccatcagcctggacagatatgtggccatccggaaccccatcgagcacagccgcttcaacagcaggaccaaggccatcatgaagatcgccatcgtgtgggccatcagcattggagtgtctgtgcccatccctgtgattggcctgagagatgaggagaaggtgtttgtgaacaacaccacctgtgtgctgaatgaccccaactttgtgctgattggcagctttgtggccttcttcatccccctgaccatcatggtgatcacctactgcctgaccatctacgtgctgcggcggcaggccctgatgctgctgcacggccacacagaggagcccccaggcctgagcctggacttcctgaagtgctgcaagaggaacacagctgaggaggagaacagcgccaaccccaaccaggaccagaatgcccggcggaggaagaagaaggagcggcggccccggggcaccatgcaggccatcaacaatgaaaggaaggccagcaaggtgctgggcatcgtgttctttgtgttcctgatcatgtggtgccccttcttcatcaccaacatcctgtctgtgctgtgtgagaagagctgcaaccagaagctgatggagaagctgctgaatgtgtttgtgtggattggctacgtgtgcagcggcatcaaccccctggtgtacaccctcttcaacaagatctaccgccgggccttcagcaactacctgcgctgcaactacaaggtggagaagaagccccctgtgcggcagatcccccgggtggccgccacagccctgagcggccgggagctgaatgtgaacatctaccgccacaccaatgagcccgtcatcgagaaggccagtgacaatgagcccggcatcgagatgcaggtggagaacctggagctgcctgtgaaccccagctctgtggtgtctgagcgcatcagctctgtgtag

SEQ ID NO: 141957 - DNA, 747 bp, Artificial Sequence
  Description of Artificial Sequence: Synthetic coding sequence
atggtgaacctgagaaatgctgtgcacagcttcctggtgcacctgattggcctgctggtgtggcagtgtgacatctctgtgtcccctgtggccgccatcgtgacagacatcttcaacaccagtgatggcggccgcttcaagttcccagatggagtgcagaactggccagccctgagcatcgtcatcatcatcatcatgaccatcggcggcaacatcctggtgatcatggctgtgtccatggagaagaagctgcacaatgccaccaactacttcctgatgagcctggccatcgctgacatgctggtgggcctgctggtgatgcccctgagcctgctggccatcctgtatgactatgtgtggcccctgccccgctacctgtgccctgtgtggatcagcctggatgtgctcttcagcacagccagcatcatgcacctgtgtgccatcagcctggaccgctgcatcagcagctacccctgtgactggacagagggcagaagaaaaggagtgcgggagcagcatgatgtgcgggcccagaggcccaagttccgcagctactgggtgctgcggagcttcctgcacacagcagatgattatggagactatgtgctgcctgaccacctgcggagcgcccccaccagctttgatgtgacagcccggccccaccggggcacagcctggaccaagagcggcttccctgaggtgctgcaggaggagtatggccggggccgggagctgtgcaagccctag

SEQ ID NO: 141958 - DNA, 1377 bp, Artificial Sequence; identical to SEQ ID NO: 141956
  Description of Artificial Sequence: Synthetic coding sequence

SEQ ID NO: 141959 - DNA, 840 bp, Artificial Sequence
  Description of Artificial Sequence: Synthetic coding sequence
atggcctccatgagcatcgtgaaggccaccagcaacaccatcagccagtgtggctggagcgccagcgccaactggacccccagcatcagccccagcatggacagaggagagaggagccccagcgccctgagccccacccaggtggccatcagaagacgctgccggcccagcccctacgtggtgaacttcctggtgcccagcggcatcctgattgccattgatgccctgtccttctacctgcccctggagagcggcaactgtgcccccttcaagatgacagtgctgctgggctacagcgtcttcctgctgatgatgaatgacctgctgcctgccaccagcaccagcagccacgccagcctggtgcggccccaccccagccgggaccagaagaggggcgtgtactttgccctgtgcctgagcctgatggtgggcagcctgctggagaccatcttcatcacccacctgctgcacgtggccaccacccagcccctgcccctgccccgctggctgcacagcctgctgctgcactgcaccggccagggccgctgctgccccacagccccccagaagggcaacaagggccctggcctgacccccacccacctgcccggggtgaaggagcctgaggtgtctgctggccagatgcctggccctggagaggccgagctgaccggcggcagcgagtggacccgggcccagcgggagcacgaggcccagaagcagcacagcgtggagctgtgggtgcagttcagccacgccatggatgccctgctcttccggctgtacctgctcttcatggccagcagcatcatcaccgtcatctgcctgtggaacacctag

SEQ ID NO: 141960 - DNA, 1365 bp, Artificial Sequence
  Description of Artificial Sequence: Synthetic coding sequence
atgcagaagcacagccctggccccccagccctggccctgctgagccagagcctgctgaccactggaaatggagacaccctcatcatcaactgccccggcttcggccagcaccgggtggaccctgctgccttccaggccgtgtttgacaggaaggccatcggccctgtgaccaactacagcgtggccacccacgtgaacatctccttcaccctgagcgccatctggaactgctacagccgcatccacaccttcaactgccaccacgcccggccctggcacaaccagtttgtgcagtggaacccagatgaatgtggcggcatcaagaagagcggcatggccacagagaacctgtggctgagtgatgtgttcatcgaggagagcgtggaccagaccccagctggcctgatggcctccatgagcatcgtgaaggccaccagcaacaccatcagccagtgtggctggagcgccagcgccaactggacccccagcatcagccccagcatggaccgggcccgggcctggaggaggatgagccgctccttccagatccaccacaggaccagcttccgcacccggcgggagtgggtgctgctgggcatccagaagaggaccatcaaggtgacagtggccaccaaccagtatgagcaggccatcttccacgtggccatcagaagacgctgccggcccagcccctacgtggtgaacttcctggtgcccagcggcatcctgattgccattgatgccctgtccttctacctgcccctggagagcggcaactgtgcccccttcaagatgacagtgctgctgggctacagcgtcttcctgctgatgatgaatgacctgctgcctgccaccagcaccagcagccacgccagcctggtggcccccctggccctgatgcagacccccctgcctgctggggtgtactttgccctgtgcctgagcctgatggtgggcagcctgctggagaccatcttcatcacccacctgctgcacgtggccaccacccagcccctgcccctgccccgctggctgcacagcctgctgctgcactgcaccggccagggccgctgctgccccacagccccccagaagggcaacaagggccctggcctgacccccacccacctgcccggggtgaaggagcctgaggtgtctgctggccagatgcctggccctggagaggccgagctgactggaggcagcgagtggacccgggcccagcgggagcacgaggcccagaagcagcacagcgtggagctgtgggtgcagttcagccacgccatggatgccctgctcttccggctgtacctgctcttcatggccagcagcatcatcaccgtcatctgcctgtggaacacctag

SEQ ID NO: 141961 - DNA, 1215 bp, Artificial Sequence
  Description of Artificial Sequence: Synthetic coding sequence
atggagcggggctggttccacggcaagggcttcctgctgggcttcatcctgcacctgctgctgcaggacagccacctgcagctggtgaccagcttcctgtggctgaacatgtggaacccagatgaatgtggcggcatcaagaagagcggcatggccacagagaacctgtggctgagtgatgtgttcatcgaggagagcgtggaccagaccccagctggcctgatggcctccatgagcatcgtgaaggccaccagcaacaccatcagccagtgtggctggagcgccagcgccaactggacccccagcatcagccccagcatggacagaggagagaggagccccagcgccctgagccccacccaggtgacccgggcctggaggaggatgagccgctccttccagatccaccacaggaccagcttccgcacccggcgggagtgggtgctgctgggcatccagaagaggaccatcaaggtgacagtggccaccaaccagtatgagcaggccatcttccacgtggccatcagaagacgctgccggcccagcccctacgtggtgaacttcctggtgcccagcggcatcctgattgccattgatgccctgtccttctacctgcccctggagagcggcaactgtgcccccttcaagatgacagtgctgctgggctacagcgtcttcctgctgatgatgaatgacctgctgcctgccaccagcaccagcagccacgccagcctggtgcggccccaccccagccgggaccagaagaggggcgtgtactttgccctgtgcctgagcctgatggtgggcagcctgctggagaccatcttcatcacccacctgctgcacgtggccaccacccagcccctgcccctgccccgctggctgcacagcctgctgctgcactgcaccggccagggccgctgctgccccacagccccccagaagggcaacaagggccctggcctgacccccacccacctgcccggggtgaaggagcctgaggtgtctgctggccagatgcctggccctggagaggccgagctgactggaggcagcgagtggacccgggcccagcgggagcacgaggcccagaagcagcacagcgtggagctgtgggtgcagttcagccacgccatggatgccctgctcttccggctgtacctgctcttcatggccagcagcatcatcaccgtcatctgcctgtggaacacctag

SEQ ID NO: 141962 - DNA, 702 bp, Artificial Sequence
  Description of Artificial Sequence: Synthetic coding sequence
atggtggccatcagaagacgctgccggcccagcccctacgtggtgaacttcctggtgcccagcggcatcctgattgccattgatgccctgtccttctacctgcccctggagagcggcaactgtgcccccttcaagatgacagtgctgctgggctacagcgtcttcctgctgatgatgaatgacctgctgcctgccaccagcaccagcagccacgccagcctggtgcggccccaccccagccgggaccagaagaggggcgtgtactttgccctgtgcctgagcctgatggtgggcagcctgctggagaccatcttcatcacccacctgctgcacgtggccaccacccagcccctgcccctgccccgctggctgcacagcctgctgctgcactgcaccggccagggccgctgctgccccacagccccccagaagggcaacaagggccctggcctgacccccacccacctgcccggggtgaaggagcctgaggtgtctgctggccagatgcctggccctggagaggccgagctgaccggcggcagcgagtggacccgggcccagcgggagcacgaggcccagaagcagcacagcgtggagctgtgggtgcagttcagccacgccatggatgccctgctcttccggctgtacctgctcttcatggccagcagcatcatcaccgtcatctgcctgtggaacacctag

SEQ ID NO: 141963 - DNA, 1344 bp, Artificial Sequence
  Description of Artificial Sequence: Synthetic coding sequence
atggagggcggctggccagcccggcagagcgccctgctgtgcctgactgtgtccctgctgctgcagggcagaggagatgccttcaccatcaactgcagcggctttgaccagcacggcgtggaccctgctgtgttccaggccgtgtttgacaggaaggccttccggcccttcaccaactacagcatccccaccagggtgaacatctccttcaccctgagcgccatcctgggcgtggatgcccagctgcagctgctgaccagcttcctgtggatggacctggtgtgggacaaccccttcatcaactggaaccccaaggaatgtgtgggcatcaacaagctgactgtgctggccgagaacctgtggctgcctgacatcttcatcgtggagagcatggatgtggaccagacccccagcggcctgacagcctacatcagcagcgagggccgcatcaagtatgacaagcccatgagggtgaccagcatctgcaacctggacatcttctacttcccctttgaccagcagaactgcaccttcaccttcagcagcttcctgtacacagtggacagcatgctgctgggcatggacaaggaggtgtgggagatcacagacaccagcaggaaggtgatccagacccagggcgagtgggagctgctgggcatcaacaaggccacccccaagatgtccatgggcaacaacctgtatgaccagatcatgttctacgtggccatcagaagaagacccagcctgtacatcatcaacctgctggtgcccagcagcttcctggtggccattgatgccctgtccttctacctgcctgctgagagcgagaacagagcccccttcaagatcaccctgctgctgggctacaacgtgttcctgctgatgatgaatgacctgctgcctgccagcggcacccccctcatctctgtgtactttgccctgtgcctgagcctgatggtggtgtccctgctggagaccgtcttcatcacctacctgctgcacgtggccaccacccagcccccacccatgccccgctggctgcacagcctgctgctgcactgcaccagccctggccgctgctgccccacagccccccagaagggcaacaagggcctgggcctgaccctgacccacctgcccggccccaaggagcctggagagctggccggcaagaagctgggcccccgggagacagagccagatggcggcagcggctggaccaagacccagctgatggagctgtgggtgcagttcagccacgccatggacaccctgctcttccggctgtacctgctcttcatggccagcagcatcctgaccgtcatcgtgctgtggaacacctag

SEQ ID NO: 141964 - DNA, 1416 bp, Artificial Sequence
  Description of Artificial Sequence: Synthetic coding sequence
atgctggccttcatcctgagccgggccacccccaggcctgccctgggccccctgagctaccgggagcaccgggtggccctgctgcacctgacccacagcatgagcaccaccggccggggcgtgaccttcaccatcaactgcagcggcttcggccagcacggggctgaccccacagccctgaacagcgtcttcaacaggaagcccttccggcctgtgaccaacatctctgtgcccacccaggtgaacatcagctttgccatgtctgccatcctggatgtgaatgagcagctgcacctgctgagcagcttcctgtggctggagatggtgtgggacaaccccttcatctcctggaacccagaagaatgtgagggcatcaccaagatgtccatggccgccaagaacctgtggctgcctgacatcttcatcatcgagctgatggatgtggacaagacccccaagggcctgacagcctacgtgtccaatgaaggccgcatccgctacaagaagcccatgaaggtggacagcatctgcaacctggacatcttctacttcccctttgaccagcagaactgcaccctgaccttcagcagcttcctgtacacagtggacagcatgctgctggacatggagaaggaggtgtgggagatcacagatgccagcaggaacatcctgcagacccatggagagtgggagctgctgggcctgagcaaggccacagccaagctgagcagaggaggcaacctgtatgaccagatcgtgttctacgtggccatcagaagaagacccagcctgtatgtgatcaacctgctggtgcccagcggcttcctggtggccattgatgccctgtccttctacctgcctgtgaagagcggcaacagagtgcccttcaagatcaccctgctgctgggctacaacgtgttcctgctgatgatgtctgacctgctgcccaccagcggcacccccctgattggagtgtactttgccctgtgcctgagcctgatggtgggcagcctgctggagaccatcttcatcacccacctgctgcacgtggccaccacccagcccccacccctgccccgctggctgcacagcctgctgctgcactgcaacagccctggccgctgctgccccacagccccccagaaggaaaataaaggacctggcctgacccccacccacctgcccggggtgaaggagcctgaggtgtctgctggccagatgcctggccctgctgaggccgagctgaccggcggcagcgagtggacccgggcccagcgggagcacgaggcccagaagcagcacagcgtggagctgtggctgcagttcagccacgccatggatgccatgctgttccggctgtacctgctcttcatggccagcagcatcatcaccgtcatctgcctgtggaacacctag

SEQ ID NO: 141965 - DNA, 1371 bp, Artificial Sequence
  Description of Artificial Sequence: Synthetic coding sequence
atggagggctcctggttccacaggaagcgcttctccttctacctgctgctgggcttcctgctgcagggccggggcgtgaccttcaccatcaactgcagcggcttcggccagcacggggctgaccccacagccctgaacagcgtcttcaacaggaagcccttccggcctgtgaccaacatctctgtgcccacccaggtgaacatcagctttgccatgtctgccatcctggatgtgaatgagcagctgcacctgctgagcagcttcctgtggctggagatggtgtgggacaaccccttcatctcctggaaccctgaggagtgtgagggcatcaccaagatgtccatggccgccaagaacctgtggctgcctgacatcttcatcatcgagctgatggatgtggacaagacccccaagggcctgacagcctacgtgtccaatgaaggccgcatccgctacaagaagcccatgaaggtggacagcatctgcaacctggacatcttctacttcccctttgaccagcagaactgcaccctgaccttcagcagcttcctgtacacagtggacagcatgctgctggacatggagaaggaggtgtgggagatcacagatgccagcaggaacatcctgcagacccacggggagtgggagctgctgggcctgagcaaggccacagccaagctgagccggggcggcaacctgtatgaccagatcgtgttctacgtggccatcagaagaagacccagcctgtatgtgatcaacctgctggtgcccagcggcttcctggtggccattgatgccctgtccttctacctgcctgtgaagagcggcaacagagtgcccttcaagatcaccctgctgctgggctacaacgtgttcctgctgatgatgtctgacctgctgcccaccagcggcacccccctcatcggcgtgtactttgccctgtgcctgagcctgatggtgggcagcctgctggagaccatcttcatcacccacctgctgcacgtggccaccacccagcccccacccctgccccgctggctgcacagcctgctgctgcactgcaacagccctggccgctgctgccccacagccccccagaaggagaacaagggccctggcctgacccccacccacctgcccggggtgaaggagcctgaggtgtctgctggccagatgcctggccctgctgaggccgagctgactggaggcagcgagtggacccgggcccagcgggagcacgaggcccagaagcagcacagcgtggagctgtggctgcagttcagccacgccatggatgccatgctgttccggctgtacctgctcttcatggccagcagcatcatcaccgtcatctgcctgtggaacacctag

SEQ ID NO: 141966 - DNA, 1326 bp, Artificial Sequence
  Description of Artificial Sequence: Synthetic coding sequence
atggagggctcctggttccacaggaagcgcttctccttctacctgctgctgggcttcctgctgcagggccggggcgtgaccttcaccatcaactgcagcggcttcggccagcacggggctgaccccacagccctgaacagcgtcttcaacaggaagcccttccggcctgtgaccaacatctctgtgcccacccaggtgaacatcagctttgccatgtctgccatcctggatgtggtgtgggacaaccccttcatctcctggaacccagaagaatgtgagggcatcaccaagatgtccatggccgccaagaacctgtggctgcctgacatcttcatcatcgagctgatggatgtggacaagacccccaagggcctgacagcctacgtgtccaatgaaggccgcatccgctacaagaagcccatgaaggtggacagcatctgcaacctggacatcttctacttcccctttgaccagcagaactgcaccctgaccttcagcagcttcctgtacacagtggacagcatgctgctggacatggagaaggaggtgtgggagatcacagatgccagcaggaacatcctgcagacccatggagagtgggagctgctgggcctgagcaaggccacagccaagctgagcagaggaggcaacctgtatgaccagatcgtgttctacgtggccatcagaagaagacccagcctgtatgtgatcaacctgctggtgcccagcggcttcctggtggccattgatgccctgtccttctacctgcctgtgaagagcggcaacagagtgcccttcaagatcaccctgctgctgggctacaacgtgttcctgctgatgatgtctgacctgctgcccaccagcggcacccccctgattggagtgtactttgccctgtgcctgagcctgatggtgggcagcctgctggagaccatcttcatcacccacctgctgcacgtggccaccacccagcccccacccctgccccgctggctgcacagcctgctgctgcactgcaacagccctggccgctgctgccccacagccccccagaaggaaaataaaggacctggcctgacccccacccacctgcccggggtgaaggagcctgaggtgtctgctggccagatgcctggccctgctgaggccgagctgaccggcggcagcgagtggacccgggcccagcgggagcacgaggcccagaagcagcacagcgtggagctgtggctgcagttcagccacgccatggatgccatgctgttccggctgtacctgctcttcatggccagcagcatcatcaccgtcatctgcctgtggaacacctag

SEQ ID NO: 141967 - DNA, 1371 bp, Artificial Sequence
  Description of Artificial Sequence: Synthetic coding sequence
atgctggccttcatcctgagccgggccacccccaggcctgccctgggccccctgagctaccgggagcaccgggtggccctgctgcacctgacccacagcatgagcaccaccggccggggcgtgaccttcaccatcaactgcagcggcttcggccagcacggggctgaccccacagccctgaacagcgtcttcaacaggaagcccttccggcctgtgaccaacatctctgtgcccacccaggtgaacatcagctttgccatgtctgccatcctggatgtggtgtgggacaaccccttcatctcctggaaccctgaggagtgtgagggcatcaccaagatgtccatggccgccaagaacctgtggctgcctgacatcttcatcatcgagctgatggatgtggacaagacccccaagggcctgacagcctacgtgtccaatgaaggccgcatccgctacaagaagcccatgaaggtggacagcatctgcaacctggacatcttctacttcccctttgaccagcagaactgcaccctgaccttcagcagcttcctgtacacagtggacagcatgctgctggacatggagaaggaggtgtgggagatcacagatgccagcaggaacatcctgcagacccacggggagtgggagctgctgggcctgagcaaggccacagccaagctgagccggggcggcaacctgtatgaccagatcgtgttctacgtggccatcagaagaagacccagcctgtatgtgatcaacctgctggtgcccagcggcttcctggtggccattgatgccctgtccttctacctgcctgtgaagagcggcaacagagtgcccttcaagatcaccctgctgctgggctacaacgtgttcctgctgatgatgtctgacctgctgcccaccagcggcacccccctcatcggcgtgtactttgccctgtgcctgagcctgatggtgggcagcctgctggagaccatcttcatcacccacctgctgcacgtggccaccacccagcccccacccctgccccgctggctgcacagcctgctgctgcactgcaacagccctggccgctgctgccccacagccccccagaaggagaacaagggccctggcctgacccccacccacctgcccggggtgaaggagcctgaggtgtctgctggccagatgcctggccctgctgaggccgagctgactggaggcagcgagtggacccgggcccagcgggagcacgaggcccagaagcagcacagcgtggagctgtggctgcagttcagccacgccatggatgccatgctgttccggctgtacctgctcttcatggccagcagcatcatcaccgtcatctgcctgtggaacacctag

SEQ ID NO: 141968 - DNA, 1326 bp, Artificial Sequence
  Description of Artificial Sequence: Synthetic coding sequence
atgctgagctctgtgatggcccccctgtgggcctgcatcctggtggccgccggcatcctggccacagacacccaccacccccaggacagcgccctgtaccacctgagcaagcagctgctgcagaagtaccacaaggaggtgcggcctgtgtacaactggaccaaggccaccaccgtgtacctggacctgtttgtgcacgccatcctggatgtggatgctgagaaccagatcctgaagacctctgtgtggtaccaggaggtgtggaatgatgagttcctgtcctggaacagctccatgtttgatgagatccgggagatcagcctgcccctgagcgccatctgggccccagacatcatcatcaatgaatttgtggacatcgagcgctacccagacctgccctacgtgtatgtgaacagcagcggcaccatcgagaactacaagcccatccaggtggtgtctgcctgcagcctggagacctacgccttcccctttgatgtgcagaactgcagcctgaccttcaagagcatcctgcacacagtggaggatgtggacctggccttcctgcggagccctgaggacatccagcacgacaagaaggccttcctgaatgattctgagtgggagctgctgtctgtgagcagcacctacagcatcctgcagagcagcgctgggggctttgcccagatccagttcaacgtggtgatgaggaggcaccccctggtgtatgtggtgtccctgctgatccccagcatcttcctgatgctggtggacctgggcagcttctacctgccccccaactgccgggccagaattgtgttcaagacctctgtgctggtgggctacaccgtcttccgggtgaacatgagcaaccaggtgcccaggtctgtgggcagcacccccctcatcggccacttcttcaccatctgcatggccttcctggtgctgagcctggccaagagcatcgtgctggtgaagttcctgcatgatgagcagagaggaggccaggagcagcccttcctgtgcctgcggggggacacagatgctgaccggccccgggtggagccccgggcccagagagctgtggtgacagagagcagcctgtatggagagcacctggcccagcccggcaccctgaaggaggtgtggagccagctgcagagcatcagcaactacctgcagacccaggaccagacagaccagcaggaggccgagtggctggtgctgctgagcagatttgaccggctgctcttccagagctacctgttcatgctgggcatctacaccatcaccctgtgcagcctgtgggccctgtggggcggcgtgtag

SEQ ID NO: 141969 - DNA, 1293 bp, Artificial Sequence
  Description of Artificial Sequence: Synthetic coding sequence
atgattgtgtacttccctggcatcctggccacagacacccaccacccccaggacagcgccctgtaccacctgagcaagcagctgctgcagaagtaccacaaggaggtgcggcctgtgtacaactggaccaaggccaccaccgtgtacctggacctgtttgtgcacgccatcctggatgtggatgctgagaaccagatcctgaagacctctgtgtggtaccaggaggtgtggaatgatgagttcctgtcctggaacagctccatgtttgatgagatccgggagatcagcctgcccctgagcgccatctgggccccagacatcatcatcaatgaatttgtggacatcgagcgctacccagacctgccctacgtgtatgtgaacagcagcggcaccatcgagaactacaagcccatccaggtggtgtctgcctgcagcctggagacctacgccttcccctttgatgtgcagaactgcagcctgaccttcaagagcatcctgcacacagtggaggatgtggacctggccttcctgcggagccctgaggacatccagcacgacaagaaggccttcctgaatgacagcgagtgggagctgctgtctgtgagcagcacctacagcatcctgcagagcagcgctgggggctttgcccagatccagttcaacgtggtgatgagaagacaccccctggtgtatgtggtgtccctgctgatccccagcatcttcctgatgctggtggacctgggcagcttctacctgccccccaactgccgggcccgcatcgtgttcaagacctctgtgctggtgggctacacagtgttccgggtgaacatgagcaaccaggtgcccaggtctgtgggcagcacccccctgattggccacttcttcaccatctgcatggccttcctggtgctgagcctggccaagagcatcgtgctggtgaagttcctgcatgatgagcagaggggcggccaggagcagcccttcctgtgcctgcggggggacacagatgctgaccggccccgggtggagccccgggcccagagagctgtggtgacagagagcagcctgtatggagagcacctggcccagcccggcaccctgaaggaggtgtggagccagctgcagagcatcagcaactacctgcagacccaggaccagacagaccagcaggaggccgagtggctggtgctgctgagcagatttgaccggctgctcttccagagctacctgttcatgctgggcatctacaccatcaccctgtgcagcctgtgggccctgtggggcggcgtgtag

SEQ ID NO: 141970 - DNA, 528 bp, Artificial Sequence
  Description of Artificial Sequence: Synthetic coding sequence
tgagctgagaaccagatcctgaagacctctgtgtggtaccaggaggtgtggaatgatgagttcctgtcctggaacagctccatgtttgatgagatccgggagatcagcctgcccctgagcgccatctgggccccagacatcatcatcaatgaatttgtggacatcgagcgctacccagacctgccctacgtgtatgtgaacagcagcggcaccatcgagaactacaagcccatccaggtggtgtctgcctgcagcctggagacctacgccttcccctttgatgtgcagaactgcagcctgaccttcaagagcatcctgcacacagtggaggatgtggacctggccttcctgcggagccctgaggacatccagcacgacaagaaggccttcctgaatgacagcgagtgggagctgctgtctgtgagcagcacctacagcatcctgcagagcagcgctgggggctttgcccagatccagttcaacggcaccagcagccccagcgcctggcccagctggttcagcgcctag

SEQ ID NO: 141971 - DNA, 1449 bp, Artificial Sequence
  Description of Artificial Sequence: Synthetic coding sequence
atgctggccttcatcctgagccgggccacccccaggcctgccctgggccccctgagctaccgggagcaccgggtggccctgctgcacctgacccacagcatgagcaccaccggccggggcgtgaccttcaccatcaactgcagcggcttcggccagcacggggctgaccccacagccctgaacagcgtcttcaacaggaagcccttccggcctgtgaccaacatctctgtgcccacccaggtgaacatcagctttgccatgtctgccatcctggatgtggtgtgggacaaccccttcatctcctggaaccctgaggagtgtgagggcatcaccaagatgtccatggccgccaagaacctgtggctgcctgacatcttcatcatcgagctgtgtgtgtccagagctggccagcgggaggtgcccagccctggcagccaccgggaccacagcctgcccctgggccccctgatggatgtggacaagacccccaagggcctgacagcctacgtgtccaatgaaggccgcatccgctacaagaagcccatgaaggtggacagcatctgcaacctggacatcttctacttcccctttgaccagcagaactgcaccctgaccttcagcagcttcctgtacacagtggacagcatgctgctggacatggagaaggaggtgtgggagatcacagatgccagcaggaacatcctgcagacccacggggagtgggagctgctgggcctgagcaaggccacagccaagctgagccggggcggcaacctgtatgaccagatcgtgttctacgtggccatcagaagaagacccagcctgtatgtgatcaacctgctggtgcccagcggcttcctggtggccattgatgccctgtccttctacctgcctgtgaagagcggcaacagagtgcccttcaagatcaccctgctgctgggctacaacgtgttcctgctgatgatgtctgacctgctgcccaccagcggcacccccctcatcggcgtgtactttgccctgtgcctgagcctgatggtgggcagcctgctggagaccatcttcatcacccacctgctgcacgtggccaccacccagcccccacccctgccccgctggctgcacagcctgctgctgcactgcaacagccctggccgctgctgccccacagccccccagaaggagaacaagggccctggcctgacccccacccacctgcccggggtgaaggagcctgaggtgtctgctggccagatgcctggccctgctgaggccgagctgactggaggcagcgagtggacccgggcccagcgggagcacgaggcccagaagcagcacagcgtggagctgtggctgcagttcagccacgccatggatgccatgctgttccggctgtacctgctcttcatggccagcagcatcatcaccgtcatctgcctgtggaacacctag

SEQ ID NO: 141972 - DNA, 1137 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgagcggctgcagccctgtgagcagcttcctgctgctcttctgcaacagacctgtgcctgtgtag

SEQ ID NO: 141973 - DNA, 1164 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgcgctacacagtgctgcaccggggccaccaccaggagctggagaagctgcccatccacaatgaccctgagagcctggagagctgcttctag

SEQ ID NO: 141974 - DNA, 1287 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgaggacagacttcctgtttgaccgggacatcctggcccgctactggaccaagccagcccgggccggccccttcagcggcaccctgagcatccgctgcctgacagccaggaagcctgtgctgggagatgctgtggagtgtggcggccagtgggagagccagtgccaccccccagccaccagccccctggtggccgcccagcccagcgacacctag

SEQ ID NO: 141975 - DNA, 1209 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctggagaggagcctgaaccagggcctgggccaggacttccacgccatcgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgagagatgctgtggagtgtggcggccagtgggagagccagtgccaccccccagccaccagccccctggtggccgcccagcccagcgacacctag

SEQ ID NO: 141976 - DNA, 1167 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgagagatgctgtggagtgtggcggccagtgggagagccagtgccaccccccagccaccagccccctggtggccgcccagcccagcgacacctag

SEQ ID NO: 141977 - DNA, 1083 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgcgcttctag

SEQ ID NO: 141978 - DNA, 1236 bp, Artificial Sequence
  Description of Artificial Sequence: Synthetic coding sequence
atggacaagctggatgccaacgtgagcagcgaggagggcttcggctctgtggagaaggtggtgctgctgaccttcctgagcaccgtcatcctgatggccatcctgggcaacctgctggtgatggtggccgtgtgctgggaccggcagctgaggaagatcaagaccaactacttcatcgtgtccctggcctttgctgacctgctggtgtctgtgctggtgatgccctttggagccatcgagctggtgcaggacatctggatctacggggaggtgttctgcctggtgaggaccagcctggatgtgctgctgaccacagccagcatcttccacctgtgctgcatcagcctggaccgctactatgccatctgctgccagcccctggtgtacagaaacaagatgacccccctgcgcatcgccctgatgctgggcggctgctgggtgatccccaccttcatctccttcctgcccatcatgcagggctggaacaacatcggcatcatcgacctgattgagaagaggaagttcaaccagaacagcaacagcacctactgtgtgttcatggtgaacaagccctatgccatcacctgcagcgtggtggccttctacatccccttcctgctgatggtgctggcctactaccgcatctacgtgacagccaaggagcacgcccaccagatccagatgctgcagagagctggggccagcagcgagagccggccccagagcgctgaccagcacagcacccacaggatgaggacagagaccaaggccgccaagaccctgtgcatcatcatgggctgcttctgcctgtgctgggcccccttctttgtgaccaacatcgtggaccccttcatcgactacacagtgcccggccaggtgtggacagccttcctgtggctgggctacatcaacagcggcctgaaccccttcctgtatgccttcctgaacaagagcttccggcgggccttcctgatcatcctgtgctgtgatgatgagcgctacagaagacccagcatcctgggccagacagtgccctgcagcaccaccaccatcaatggcagcacccacgtgctgagcagcggcacagaaacagacaggaagaagctgtggaacaaggaggagaagattgaccagaccatccagatgcccaagaggaagaggaagaagaaggccagcctgtcctatgaggacctgatcctgctgggcaggaagagctgcttccgggagggcaagtag

SEQ ID NO: 141979 - DNA, 1164 bp, Artificial Sequence; identical to SEQ ID NO: 141973
  Description of Artificial Sequence: Synthetic coding sequence

SEQ ID NO: 141980 - DNA, 1137 bp, Artificial Sequence; identical to SEQ ID NO: 141972
  Description of Artificial Sequence: Synthetic coding sequence

SEQ ID NO: 141981 - DNA, 1137 bp, Artificial Sequence; identical to SEQ ID NO: 141972
  Description of Artificial Sequence: Synthetic coding sequence

SEQ ID NO: 141982 - DNA, 1074 bp, Artificial Sequence
  Description of Artificial Sequence: Synthetic coding sequence
atggacctgcctgtgaacctgaccagcttcagcctgagcacccccagccccctggagaccaaccacagcctgggcaaggatgacctgcggcccagcagccccctgctgtctgtgtttggagtgctgatcctgaccctgctgggcttcctggtggccgccacctttgcctggaacctgctggtgctggccaccatcctgcgggtgaggaccttccaccgggtgccccacaacctggtggcctccatggctgtgtctgatgtgctggtggccgccctggtgatgcccctgagcctggtgcatgagctgtctggaagacgctggcagctgggccgccgcctgtgccagctgtggatcgcctgtgatgtgctgtgctgcacagccagcatctggaatgtgacagccatcgccctggaccgctactggagcatcaccaggcacatggagtacaccctgcggaccaggaaatgtgtgtccaatgtgatgattgccctgacctgggccctgtctgctgtgatcagcctggcccccctgctgtttggctggggcgagacctacagcgagggcagcgaggagtgccaggtgtcccgggagcccagctatgctgtgttcagcacagtgggcgccttctacctgcccctgtgtgtggtgctgtttgtgtactggaagatctacaaggccgccaagttccgggtgggcagcaggaagaccaacagcgtgagccccatcagcgaggccgtggaggtgaaggacagcgccaagcagccccagatggtgttcaccgtgagacatgccaccgtgaccttccagcctgagggggacacctggagggagcagaaggagcagagagctgccctgatggtgggcatcctgattggagtgtttgtgctgtgctggatccccttcttcctgacagagctgatcagccccctgtgcagctgtgacatcccagccatctggaagagcatcttcctgtggctgggctacagcaacagcttcttcaaccccctcatctacacagccttcaacaagaactacaacagcgccttcaagaacttcttcagccggcagcactag

SEQ ID NO: 141983 - DNA, 1323 bp, Artificial Sequence
  Description of Artificial Sequence: Synthetic coding sequence
atggtgcctgagcccggccccacagccaacagcaccccagcctggggcgccggccccccatctgcccctgggggcagcggctgggtggccgccgccctgtgtgtggtgattgccctgacagctgctgccaacagcctgctgattgccctgatctgcacccagcctgccctgaggaacaccagcaacttcttcctggtgtccctcttcaccagtgacctgatggtgggcctggtggtgatgcccccagccatgctgaatgccctgtatggccgctgggtgctggcccggggcctgtgcctgctgtggacagcctttgatgtgatgtgctgcagcgccagcatcctgaacctgtgcctgatcagcctggaccgctacctgctgatcctgagccccctgcgctacaagctgaggatgacccccctgcgggccctggccctggtgctgggcgcctggagcctggccgccctggccagcttcctgcccctgctgctgggctggcatgagctgggccacgcccggccccctgtgcccggccagtgccgcctgctggccagcctgccctttgtgctggtggccagcggcctgaccttcttcctgcccagcggggccatctgcttcacctactgccgcatcctgctggccgccaggaagcaggccgtgcaggtggccagcctgaccaccggcatggccagccaggccagcgagaccctgcaggtgcccaggacccccaggcctggggtggagagcgctgacagccggcggctggccaccaagcacagcaggaaggccctgaaggccagcctgaccctgggcatcctgctgggcatgttctttgtgacctggctgcccttctttgtggccaacatcgtgcaggccgtgtgtgactgcatcagccctggcctgtttgatgtgctgacctggctgggctactgcaacagcaccatgaaccccatcatctaccccctcttcatgagggacttcaagagggccctgggccgcttcctgccctgcccccgctgcccccgggagcggcaggccagcctggccagccccagcctgcggaccagccacagcggcccccggcccggcctgagcctgcagcaggtgctgcccctgcccctgcccccagacagcgacagcgacagtgatgctggcagcggcggcagcagcggcctgcggctgacagcccagctgctgctgcctggagaggccacccaggacccccccctgcccaccagggctgctgctgctgtgaacttcttcaacattgatcctgctgagcctgagctgcggccccaccccctgggcatccccaccaactag

SEQ ID NO: 141984 - DNA, 1338 bp, Artificial Sequence
  Description of Artificial Sequence: Synthetic coding sequence
atgatggatgtgaacagcagcggccgcccagacctgtatggccacctgcggagcttcctgctgcctgaggtgggccggggcctgcctgacctgagcccagatggcggcgctgaccctgtggccggctcctgggccccccacctgctgtctgaggtgacagccagccctgcccccacctgggatgcccccccagacaatgccagcggctgtggggagcagatcaactacggccgggtggagaaggtggtgattggcagcatcctgaccctcatcaccctgctgaccatcgccggcaactgcctggtggtgatctctgtgtgctttgtgaagaagctgcggcagcccagcaactacctgattgtgtccctggccctggccgacctgtctgtggccgtggccgtgatgccctttgtgtctgtgacagacctgattggaggcaagtggatcttcggccacttcttctgcaatgtgttcatcgccatggatgtgatgtgctgcacagccagcatcatgaccctgtgtgtgatcagcattgaccgctacctgggcatcacccggcccctgacctaccctgtgcggcagaatggcaagtgcatggccaagatgatcctgtctgtgtggctgctgagcgccagcatcaccctgccccccctgtttggctgggcccagaatgtgaatgatgacaaggtgtgcctgatcagccaggactttggctacaccatctacagcacagctgtggccttctacatccccatgtctgtgatgctgttcatgtactaccagatctacaaggccgccaggaagtctgctgccaagcacaagtttcctggcttcccccgggtggagccagattctgtgattgccctgaatggcatcgtgaagctgcagaaggaggtggaggagtgtgccaacctgagccggctgctgaagcatgagaggaagaacatcagcatcttcaagcgggagcagaaggccgccaccaccctgggcatcatcgtgggcgccttcaccgtgtgctggctgcccttcttcctgctgagcacagcccggcccttcatctgtggcaccagctgcagctgcatccccctgtgggtggagaggaccttcctgtggctgggctacgccaacagcctcatcaaccccttcatctatgccttcttcaacagagacctgcggaccacctaccgcagcctgctgcagtgccagtacagaaacatcaacaggaagctgtctgctgctggcatgcatgaggccctgaagctggccgagaggcctgagaggcctgagtttgtgctgcagaatgctgactactgcaggaagaagggccatgacagctag

SEQ ID NO: 141985 - DNA, 1440 bp, Artificial Sequence
  Description of Artificial Sequence: Synthetic coding sequence
atgatggatgtgaacagcagcggccgcccagacctgtatggccacctgcggagcttcctgctgcctgaggtgggccggggcctgcctgacctgagcccagatggcggcgctgaccctgtggccggctcctgggccccccacctgctgtctgaggtgacagccagccctgcccccacctgggatgcccccccagacaatgccagcggctgtggggagcagatcaactacggccgggtggagaaggtggtgattggcagcatcctgaccctcatcaccctgctgaccatcgccggcaactgcctggtggtgatctctgtgtgctttgtgaagaagctgcggcagcccagcaactacctgattgtgtccctggccctggccgacctgtctgtggccgtggccgtgatgccctttgtgtctgtgacagacctgattggaggcaagtggatcttcggccacttcttctgcaatgtgttcatcgccatggatgtgatgtgctgcacagccagcatcatgaccctgtgtgtgatcagcattgaccgctacctgggcatcacccggcccctgacctaccctgtgcggcagaatggcaagtgcatggccaagatgatcctgtctgtgtggctgctgagcgccagcatcaccctgccccccctgtttggctgggcccagaatgtgaatgatgacaaggtgtgcctgatcagccaggactttggctacaccatctacagcacagctgtggccttctacatccccatgtctgtgatgctgttcatgtactaccagatctacaaggccgccaggaagtctgctgccaagcacaagtttcctggcttcccccgggtggagccagattctgtgattgccctgaatggcatcgtgaagctgcagaaggaggtggaggagtgtgccaacctgagccggctgctgaagcatgagaggaagaacatcagcatcttcaagcgggagcagaaggccgccaccaccctgggcatcatcgtgggcgccttcaccgtgtgctggctgcccttcttcctgctgagcacagcccggcccttcatctgtggcaccagctgcagctgcatccccctgtgggtggagaggaccttcctgtggctgggctacgccaacagcctcatcaaccccttcatctatgccttcttcaacagagacctgcggaccacctaccgcagcctgctgcagtgccagtacagaaacatcaacaggaagctgtctgctgctggcatgcatgaggccctgaagctggccgagaggcctgagaggcctgagtttgtgctgcgggcctgcaccaggagagtgctgctgcggcctgagaagaggcctcctgtgtctgtgtgggtgctgcagagcccagaccaccacaactggctggccgacaagatgctgaccaccgtggagaagaaggtgatgattcatgactag

SEQ ID NO: 141986 - DNA, 1299 bp, Artificial Sequence
  Description of Artificial Sequence: Synthetic coding sequence
atgatggatgtgaacagcagcggccgcccagacctgtatggccacctgcggagcttcctgctgcctgaggtgggccggggcctgcctgacctgagcccagatggcggcgctgaccctgtggccggctcctgggccccccacctgctgtctgaggtgacagccagccctgcccccacctgggatgcccccccagacaatgccagcggctgtggggagcagatcaactacggccgggtggagaaggtggtgattggcagcatcctgaccctcatcaccctgctgaccatcgccggcaactgcctggtggtgatctctgtgtgctttgtgaagaagctgcggcagcccagcaactacctgattgtgtccctggccctggccgacctgtctgtggccgtggccgtgatgccctttgtgtctgtgacagacctgattggaggcaagtggatcttcggccacttcttctgcaatgtgttcatcgccatggatgtgatgtgctgcacagccagcatcatgaccctgtgtgtgatcagcattgaccgctacctgggcatcacccggcccctgacctaccctgtgcggcagaatggcaagtgcatggccaagatgatcctgtctgtgtggctgctgagcgccagcatcaccctgccccccctgtttggctgggcccagaatgtgaatgatgacaaggtgtgcctgatcagccaggactttggctacaccatctacagcacagctgtggccttctacatccccatgtctgtgatgctgttcatgtactaccagatctacaaggccgccaggaagtctgctgccaagcacaagtttcctggcttcccccgggtggagccagattctgtgattgccctgaatggcatcgtgaagctgcagaaggaggtggaggagtgtgccaacctgagccggctgctgaagcatgagaggaagaacatcagcatcttcaagcgggagcagaaggccgccaccaccctgggcatcatcgtgggcgccttcaccgtgtgctggctgcccttcttcctgctgagcacagcccggcccttcatctgtggcaccagctgcagctgcatccccctgtgggtggagaggaccttcctgtggctgggctacgccaacagcctcatcaaccccttcatctatgccttcttcaacagagacctgcggaccacctaccgcagcctgctgcagtgccagtacagaaacatcaacaggaagctgtctgctgctggcatgcatgaggccctgaagctggccgagaggcctgagaggcctgagtttgtgctgtag

SEQ ID NO: 141987 - DNA, 1440 bp, Artificial Sequence
  Description of Artificial Sequence: Synthetic coding sequence
atgatggatgtgaacagcagcggccgcccagacctgtatggccacctgcggagcttcctgctgcctgaggtgggccggggcctgcctgacctgagcccagatggcggcgctgaccctgtggccggctcctgggccccccacctgctgtctgaggtgacagccagccctgcccccacctgggatgcccccccagacaatgccagcggctgtggggagcagatcaactacggccgggtggagaaggtggtgattggcagcatcctgaccctcatcaccctgctgaccatcgccggcaactgcctggtggtgatctctgtgtgctttgtgaagaagctgcggcagcccagcaactacctgattgtgtccctggccctggccgacctgtctgtggccgtggccgtgatgccctttgtgtctgtgacagacctgattggaggcaagtggatcttcggccacttcttctgcaatgtgttcatcgccatggatgtgatgtgctgcacagccagcatcatgaccctgtgtgtgatcagcattgaccgctacctgggcatcacccggcccctgacctaccctgtgcggcagaatggcaagtgcatggccaagatgatcctgtctgtgtggctgctgagcgccagcatcaccctgccccccctgtttggctgggcccagaatgtgaatgatgacaaggtgtgcctgatcagccaggactttggctacaccatctacagcacagctgtggccttctacatccccatgtctgtgatgctgttcatgtactaccagatctacaaggccgccaggaagtctgctgccaagcacaagtttcctggcttcccccgggtggagccagattctgtgattgccctgaatggcatcgtgaagctgcagaaggaggtggaggagtgtgccaacctgagccggctgctgaagcatgagaggaagaacatcagcatcttcaagcgggagcagaaggccgccaccaccctgggcatcatcgtgggcgccttcaccgtgtgctggctgcccttcttcctgctgagcacagcccggcccttcatctgtggcaccagctgcagctgcatccccctgtgggtggagaggaccttcctgtggctgggctacgccaacagcctcatcaaccccttcatctatgccttcttcaacagagacctgcggaccacctaccgcagcctgctgcagtgccagtacagaaacatcaacaggaagctgtctgctgctggcatgcatgaggccctgaagctggccgagaggcctgagaggcctgagtttgtgctgatcaccaggaccagcggcgtgcaccaggccctggagaacttcccctggggcaatgaggtgaaccgctggaggaagagctgtgagtacttctgcacagacaagatgctgaccaccgtggagaagaaggtgatgattcatgactag

SEQ ID NO: 141988 - DNA, 2460 bp, Artificial Sequence
  Description of Artificial Sequence: Synthetic coding sequence
ggcatgctggatggccccagcgccatgacccgcttctgcaacctgattgccagcgagccagacatcgccaaggtgcccctgtgcatcgacagcagcaactttgctgtgattgaagctggcctgaagtgctgccagggcaaatgtattgtgaacagcatcagcctgaaggagggggaggccacagaaacagacaccaagatccgggtgtgcacccgggcctaccacctgctggtgaagaagctgggcttcaaccccaatgacatcatctttgaccccaacatcctgaccatcggcaccggcatggaggagcacaacctgtatgccatcaacttcatccacgccaccaaggtgatcaaggagaccctgcccggggcccgcatcagcggcggcctgagcaacctgtccttctccttccggggcatggaggccatccgggaggccatgcatggagtcttcctgtaccacgccatcaagagcggcatggacatgggcatcgtgaatgccggcaacctgcctgtgtatgatgacatccacaaggagctgctgcagctgtgtgaggacctgatctggaacaaggaccctgaggccacagagaagctgctgcgctatgcccagacccagggcactggaggcaagaaggtgatccagacagatgagtggagaaatggacctgtggaggagcggctggagtatgccctggtgaagggcatcgagaagcacatcatcgaggacacagaggaggcccggctgaaccagaagaagtacccccggcccctgaacatcatcgagggccccctgatgaatggcatgaagatcgtgggggacctgtttggagctgggaagatgttcctgccccaggtgatcaagagcgcccgggtgatgaagaaggctgtgggccacctgatccccttcatggagaaggagcgggaggagaccagggtgctgaatggcaccgtggaggaggaggacccctaccagggcaccatcgtgctggccaccgtgaagggagatgtgcatgacatcggcaagaacatcgtgggcgtggtgctgggctgcaacaacttccgggtcatcgacctgggcgtgatgaccccctgtgacaagatcctgaaggccgccctggaccacaaggctgacatcatcggcctgagcggcctcatcacccccagcctggatgagatgatctttgtggccaaggagatggagcggctggccatccgcatccccctgctgattggaggagccaccaccagcaagacccacacagctgtgaagatcgccccccgctacagcgcccctgtgatccacgtgctggatgccagcaagtctgtggtggtgtgcagccagctgctggatgagaacctgaaggatgagtactttgaggagatcatggaggagtatgaggacatccggcaggaccactatgagagcctgaaggagcggcgctacctgcccctgagccaggccaggaagagcggcttccagatggactggctgtctgagccccaccctgtgaagcccaccttcatcggcacccaggtgtttgaggactatgacctgcagaagctggtggactacatcgactggaagcccttctttgatgtgtggcagctgcggggcaagtaccccaacagaggcttccccaagatcttcaatgacaagacagtgggcggggaggccaggaaggtgtatgatgatgcccacaacatgctgaacaccctcatcagccagaagaagctgcgggcccggggcgtggtgggcttctggccagcccagagcatccaggatgacatccacctgtatgcagaggccgctgtgccccaggccgctgagcccatcgccaccttctacggcctgcggcagcaggccgagaaggacagcgccagcacagagccctactactgcctgagtgacttcatcgcccccctgcacagcggcatccgggactacctgggcctgtttgctgtggcctgctttggagtggaggagctgagcaaggcctatgaagatgatggagatgactacagcagcatcatggtgaaggccctgggggaccggctggccgaggcctttgctgaggagctgcacgagcgggtgcggcgggagctgtgggcctactgcggcagcgagcagctggatgtggccgacctgcggcggctgcgctacaagggcatccggcctgcccctggctaccccagccagcctgaccacacagagaagctgaccatgtggaggctggccgacatcgagcagagcacaggcatccggctgacagagagcctggccatggccccagccagcgctgtgtctggcctgtacttcagcaacctgaagagcaagtactttgctgtgggcaagatcagcaaggaccaggtggaggactatgccctgaggaagaacatctctgtggccgaggtggagaagtggctgggccccatcctgggctatgacacagactag

SEQ ID NO: 141989 - DNA, 3798 bp, Artificial Sequence
  Description of Artificial Sequence: Synthetic coding sequence
atgagccctgccctgcaggacctgagccagcctgagggcctgaagaagaccctgagagatgagatcaatgccatcctgcagaagaggatcatggtgctggatggcggcatgggcaccatgatccagcgggagaagctgaatgaggagcacttccggggccaggagttcaaggaccacgcccggcccctgaagggcaacaatgacatcctgagcatcacccagccagatgtgatctaccagatccacaaggagtacctgctggccggggctgacatcatcgagaccaacaccttcagcagcaccagcatcgcccaggccgactatggcctggagcacctggcctacaggatgaacatgtgcagcgctggggtggccaggaaggctgctgaggaggtgaccctgcagacaggcatcaagagatttgtggccggggccctgggccccaccaacaagaccctgtctgtgagccccagcgtggagaggccagactacagaaacatcacctttgatgagctggtggaggcctaccaggagcaggccaagggcctgctggatggaggagtggacatcctgctgattgagaccatctttgacacagccaatgccaaggccgccctgtttgccctgcagaacctgtttgaggagaagtatgccccccggcccatcttcatcagcggcaccatcgtggacaagagcggccgcaccctgagcggccagacaggagagggcttcgtcatctctgtgagccacggggagcccctgtgcatcggcctgaactgtgccctgggcgctgctgagatgaggcccttcatcgagatcatcggcaagtgcaccacagcctacgtgctgtgctacccaaatgccggcctgcccaacaccttcggggactatgatgagacccccagcatgatggccaagcacctgaaggactttgccatggatggcctggtgaacatcgtgggcggctgctgcggcagcaccccagaccacatccgggagattgctgaggccgtgaagaactgcaagccccgggtgcccccagccacagcctttgagggccacatgctgctgagcggcctggagcccttcagaattggcccctacaccaactttgtgaacatcggggagcgctgcaatgtggccggcagcaggaagtttgccaagctgatcatggccggcaactatgaggaggccctgtgtgtggccaaggtgcaggtggagatgggcgcccaggtgctggatgtgaacatggatgatggcatgctggatggccccagcgccatgacccgcttctgcaacctgattgccagcgagccagacatcgccaaggtgcccctgtgcatcgacagcagcaactttgctgtgattgaggccggcctgaagtgctgccagggcaagtgcatcgtgaacagcatcagcctgaaggagggggaggatgacttcctggagaaggccaggaagatcaagaagtatggagctgccatggtggtgatggcctttgatgaggagggccaggccacagaaacagacaccaagatccgggtgtgcacccgggcctaccacctgctggtgaagaagctgggcttcaaccccaatgacatcatctttgaccccaacatcctgaccatcggcaccggcatggaggagcacaacctgtatgccatcaacttcatccacgccaccaaggtgatcaaggagaccctgcccggggcccgcatcagcggcggcctgagcaacctgtccttctccttccggggcatggaggccatccgggaggccatgcatggagtcttcctgtaccacgccatcaagagcggcatggacatgggcatcgtgaatgccggcaacctgcctgtgtatgatgacatccacaaggagctgctgcagctgtgtgaggacctgatctggaacaaggaccctgaggccacagagaagctgctgcgctatgcccagacccagggcactggaggcaagaaggtgatccagacagatgagtggagaaatggacctgtggaggagcggctggagtatgccctggtgaagggcatcgagaagcacatcatcgaggacacagaggaggcccggctgaaccagaagaagtacccccggcccctgaacatcatcgagggccccctgatgaatggcatgaagatcgtgggggacctgtttggagctgggaagatgttcctgccccaggtgatcaagagcgcccgggtgatgaagaaggctgtgggccacctgatccccttcatggagaaggagcgggaggagaccagggtgctgaatggcaccgtggaggaggaggacccctaccagggcaccatcgtgctggccaccgtgaagggagatgtgcatgacatcggcaagaacatcgtgggcgtggtgctgggctgcaacaacttccgggtcatcgacctgggcgtgatgaccccctgtgacaagatcctgaaggccgccctggaccacaaggctgacatcatcggcctgagcggcctcatcacccccagcctggatgagatgatctttgtggccaaggagatggagcggctggccatccgcatccccctgctgattggaggagccaccaccagcaagacccacacagctgtgaagatcgccccccgctacagcgcccctgtgatccacgtgctggatgccagcaagtctgtggtggtgtgcagccagctgctggatgagaacctgaaggatgagtactttgaggagatcatggaggagtatgaggacatccggcaggaccactatgagagcctgaaggagcggcgctacctgcccctgagccaggccaggaagagcggcttccagatggactggctgtctgagccccaccctgtgaagcccaccttcatcggcacccaggtgtttgaggactatgacctgcagaagctggtggactacatcgactggaagcccttctttgatgtgtggcagctgcggggcaagtaccccaacagaggcttccccaagatcttcaatgacaagacagtgggcggggaggccaggaaggtgtatgatgatgcccacaacatgctgaacaccctcatcagccagaagaagctgcgggcccggggcgtggtgggcttctggccagcccagagcatccaggatgacatccacctgtatgcagaggccgctgtgccccaggccgctgagcccatcgccaccttctacggcctgcggcagcaggccgagaaggacagcgccagcacagagccctactactgcctgagtgacttcatcgcccccctgcacagcggcatccgggactacctgggcctgtttgctgtggcctgctttggagtggaggagctgagcaaggcctatgaagatgatggagatgactacagcagcatcatggtgaaggccctgggggaccggctggccgaggcctttgctgaggagctgcacgagcgggtgcggcgggagctgtgggcctactgcggcagcgagcagctggatgtggccgacctgcggcggctgcgctacaagggcatccggcctgcccctggctaccccagccagcctgaccacacagagaagctgaccatgtggaggctggccgacatcgagcagagcacaggcatccggctgacagagagcctggccatggccccagccagcgctgtgtctggcctgtacttcagcaacctgaagagcaagtactttgctgtgggcaagatcagcaaggaccaggtggaggactatgccctgaggaagaacatctctgtggccgaggtggagaagtggctgggccccatcctgggctatgacacagactag

SEQ ID NO: 141990 - DNA, 3357 bp, Artificial Sequence
  Description of Artificial Sequence: Synthetic coding sequence
atgagccctgccctgcaggacctgagccagcctgagggcctgaagaagaccctgagagatgagatcaatgccatcctgcagaagaggatcatggtgctggatggcggcatgggcaccatgatccagcgggagaagctgaatgaggagcacttccggggccaggagttcaaggaccacgcccggcccctgaagggcaacaatgacatcctgagcatcacccagccagatgtgatctaccagatccacaaggagtacctgctggccggggctgacatcatcgagaccaacaccttcagcagcaccagcatcgcccaggccgactatggcctggagcacctggcctacaggatgaacatgtgcagcgctggggtggccaggaaggctgctgaggaggtgaccctgcagacaggcatcaagagatttgtggccggggccctgggccccaccaacaagaccctgtctgtgagccccagcgtggagaggccagactacagaaacatcacctttgatgagctggtggaggcctaccaggagcaggccaagggcctgctggatggaggagtggacatcctgctgattgagaccatctttgacacagccaatgccaaggccgccctgtttgccctgcagaacctgtttgaggagaagtatgccccccggcccatcttcatcagcggcaccatcgtggacaagagcggccgcaccctgagcggccagacaggagagggcttcgtcatctctgtgagccacggggagcccctgtgcatcggcctgaactgtgccctgggcgctgctgagatgaggcccttcatcgagatcatcggcaagtgcaccacagcctacgtgctgtgctacccaaatgccggcctgcccaacaccttcggggactatgatgagacccccagcatgatggccaagcacctgaaggactttgccatggatggcctggtgaacatcgtgggcggctgctgcggcagcaccccagaccacatccgggagattgctgaggccgtgaagaactgcaagccccgggtgcccccagccacagcctttgagggccacatgctgctgagcggcctggagcccttcagaattggcccctacaccaactttgtgaacatcggggagcgctgcaatgtggccggcagcaggaagtttgccaagctgatcatggccggcaactatgaggaggccctgtgtgtggccaaggtgcaggtggagatgggcgcccaggtgctggatgtgaacatggatgatggcatgctggatggccccagcgccatgacccgcttctgcaacctgattgccagcgagccagacatcgccaaggtgcccctgtgcatcgacagcagcaactttgctgtgattgaggccggcctgaagtgctgccagggcaagtgcatcgtgaacagcatcagcctgaaggagggggaggatgacttcctggagaaggccaggaagatcaagaagtatggagctgccatggtggtgatggcctttgatgaggagggccagacccagggcactggaggcaagaaggtgatccagacagatgagtggagaaatggacctgtggaggagcggctggagtatgccctggtgaagggcatcgagaagcacatcatcgaggacacagaggaggcccggctgaaccagaagaagtacccccggcccctgaacatcatcgagggccccctgatgaatggcatgaagatcgtgggggacctgtttggagctgggaagatgttcctgccccaggtgatcaagagcgcccgggtgatgaagaaggctgtgggccacctgatccccttcatggagaaggagcgggaggagaccagggtgctgaatggcaccgtggaggaggaggacccctaccagggcaccatcgtgctggccaccgtgaagggagatgtgcatgacatcggcaagaacatcgtgggcgtggtgctgggctgcaacaacttccgggtcatcgacctgggcgtgatgaccccctgtgacaagatcctgaaggccgccctggaccacaaggctgacatcatcggcctgagcggcctcatcacccccagcctggatgagatgatctttgtggccaaggagatggagcggctggccatccgcatccccctgctgattggaggagccaccaccagcaagacccacacagctgtgaagatcgccccccgctacagcgcccctgtgatccacgtgctggatgccagcaagtctgtggtggtgtgcagccagctgctggatgagaacctgaaggatgagtactttgaggagatcatggaggagtatgaggacatccggcaggaccactatgagagcctgaaggagcggcgctacctgcccctgagccaggccaggaagagcggcttccagatggactggctgtctgagccccaccctgtgaagcccaccttcatcggcacccaggtgtttgaggactatgacctgcagaagctggtggactacatcgactggaagcccttctttgatgtgtggcagctgcggggcaagtaccccaacagaggcttccccaagatcttcaatgacaagacagtgggcggggaggccaggaaggtgtatgatgatgcccacaacatgctgaacaccctcatcagccagaagaagctgcgggcccggggcgtggtgggcttctggccagcccagagcatccaggatgacatccacctgtatgcagaggccgctgtgccccaggccgctgagcccatcgccaccttctacggcctgcggcagcaggccgagaaggacagcgccagcacagagccctactactgcctgagtgacttcatcgcccccctgcacagcggcatccgggactacctgggcctgtttgctgtggcctgctttggagtggaggagctgagcaaggcctatgaagatgatggagatgactacagcagcatcatggtgaaggccctgggggaccggctggccgaggcctttgctgaggagctgcacgagcgggtgcggcgggagctgtgggcctactgcggcagcgagcagctggatgtggccgacctgcggcggctgcgctacaagggcatccggcctgcccctggctaccccagccagcctgaccacacagagaagctgaccatgtggaggctggccgacatcgagcagagcacaggcatccggctgacagagagcctggccatggccccagccagcgctgtgtctggcctgtacttcagcaacctgaagagcaagtactttgctgtgggcaagatcagcaaggaccaggtggaggactatgccctgaggaagaacatctctgtggccgaggtggagaagtgcatgtctgtgtacaggaagatcggggagtag

SEQ ID NO: 141991 - DNA, 690 bp, Artificial Sequence
  Description of Artificial Sequence: Synthetic coding sequence
atgtctgctggcctgcgggccggctgccacgtggtgctgctgtgccgcttcagcctgggcagcttctctgtgcccagccgggacagcgccagcggccgggcctgcctggccgcccggcccacccccaggacaggccgggtgcctgggaagaaggcccgggccccagctgtggccgcccccagccctgagcggggcccccgggccctgcgggccttcggcgtgcgcagccccccagccacccgggccaatggaagacggcagaagacccgggccctgtgtggccgcctggcctggcgctggctggcctggcccctggccgtggtgacctgtggggagcacgtgttttctgctgcccccagcgcccagggcggggacagcaccacctgccaccccaggagcaagacctgcagaaatcctgagtacctgctggccggggctgacatcatcgagaccaacaccttcagcagcaccagcatcgcccaggccgactatggcctggagcacctggcctacaggatgaacatgtgcagcgctggggtggccaggaaggctgctgaggaggtgaccctgcagacaggcatcaagagatttgtggccggggccctgggccccaccaacaagaccctgtctgtgagccccagcgtggagaggccagactacagaaacatcaacctgcctgtgggcagctag

SEQ ID NO: 141992 - DNA, 3645 bp, Artificial Sequence
  Description of Artificial Sequence: Synthetic coding sequence
atgagccctgccctgcaggacctgagccagcctgagggcctgaagaagaccctgagagatgagatcaatgccatcctgcagaagaggatcatggtgctggatggcggcatgggcaccatgatccagcgggagaagctgaatgaggagcacttccggggccaggagttcaaggaccacgcccggcccctgaagggcaacaatgacatcctgagcatcacccagccagatgtgatctaccagatccacaaggagtacctgctggccggggctgacatcatcgagaccaacaccttcagcagcaccagcatcgcccaggccgactatggcctggagcacctggcctacaggatgaacatgtgcagcgctggggtggccaggaaggctgctgaggaggtgaccctgcagacaggcatcaagagatttgtggccggggccctgggccccaccaacaagaccctgtctgtgagccccagcgtggagaggccagactacagaaacatcacctttgatgagctggtggaggcctaccaggagcaggccaagggcctgctggatggaggagtggacatcctgctgattgagaccatctttgacacagccaatgccaaggccgccctgtttgccctgcagaacctgtttgaggagaagtatgccccccggcccatcttcatcagcggcaccatcgtggacaagagcggccgcaccctgagcggccagacaggagagggcttcgtcatctctgtgagccacggggagcccctgtgcatcggcctgaactgtgccctgggcgctgctgagatgaggcccttcatcgagatcatcggcaagtgcaccacagcctacgtgctgtgctacccaaatgccggcctgcccaacaccttcggggactatgatgagacccccagcatgatggccaagcacctgaaggactttgccatggatggcctggtgaacatcgtgggcggctgctgcggcagcaccccagaccacatccgggagattgctgaggccgtgaagaactgcaagccccgggtgcccccagccacagcctttgagggccacatgctgctgagcggcctggagcccttcagaattggcccctacaccaactttgtgaacatcggggagcgctgcaatgtggccggcagcaggaagtttgccaagctgatcatggccggcaactatgaggaggccctgtgtgtggccaaggtgcaggtggagatgggcgcccaggtgctggatgtgaacatggatgatggcatgctggatggccccagcgccatgacccgcttctgcaacctgattgccagcgagccagacatcgccaaggtgcccctgtgcatcgacagcagcaactttgctgtgattgaggccggcctgaagtgctgccagggcaagtgcatcgtgaacagcatcagcctgaaggagggggaggatgacttcctggagaaggccaggaagatcaagaagtatggagctgccatggtggtgatggcctttgatgaggagggccaggccacagaaacagacaccaagatccgggtgtgcacccgggcctaccacctgctggtgaagaagctgggcttcaaccccaatgacatcatctttgaccccaacatcctgaccatcggcaccggcatggaggagcacaacctgtatgccatcaacttcatccacgccaccaaggtgatcaaggagaccctgcccggggcccgcatcagcggcggcctgagcaacctgtccttctccttccggggcatggaggccatccgggaggccatgcatggagtcttcctgtaccacgccatcaagagcggcatggacatgggcatcgtgaatgccggcaacctgcctgtgtatgatgacatccacaaggagctgctgcagctgtgtgaggacctgatctggaacaaggaccctgaggccacagagaagctgctgcgctatgcccagacccagggcactggaggcaagaaggtgatccagacagatgagtggagaaatggacctgtggaggagcggctggagtatgccctggtgaaggtgatcaagagcgcccgggtgatgaagaaggctgtgggccacctgatccccttcatggagaaggagcgggaggagaccagggtgctgaatggaacagtggaggaggaggacccctaccagggcaccatcgtgctggccaccgtgaagggagatgtgcatgacatcggcaagaacatcgtgggcgtggtgctgggctgcaacaacttccgggtgattgacctgggcgtgatgaccccctgtgacaagatcctgaaggccgccctggaccacaaggctgacatcatcggcctgagcggcctcatcacccccagcctggatgagatgatctttgtggccaaggagatggagcggctggccatccgcatccccctgctgattggaggagccaccaccagcaagacccacacagctgtgaagatcgccccccgctacagcgcccctgtgattcatgtgctggatgccagcaagtctgtggtggtgtgcagccagctgctggatgagaacctgaaggatgagtactttgaggagatcatggaggagtatgaggacatccggcaggaccactatgagagcctgaaggagcggcgctacctgcccctgagccaggccaggaagagcggcttccagatggactggctgtctgagccccaccctgtgaagcccaccttcatcggcacccaggtgtttgaagattatgacctgcagaagctggtggactacatcgactggaagcccttctttgatgtgtggcagctgcggggcaagtaccccaacagaggcttccccaagatcttcaatgacaagacagtgggcggggaggccaggaaggtgtatgatgatgcccacaacatgctgaacaccctcatcagccagaagaagctgcgggcccggggcgtggtgggcttctggccagcccagagcatccaggatgacatccacctgtatgcagaggccgctgtgccccaggccgctgagcccatcgccaccttctacggcctgcggcagcaggccgagaaggacagcgccagcacagagccctactactgcctgagtgacttcatcgcccccctgcacagcggcatccgggactacctgggcctgtttgctgtggcctgcttcggcgtggaggagctgagcaaggcctatgaagatgatggagatgactacagcagcatcatggtgaaggccctgggggaccggctggccgaggcctttgctgaggagctgcacgagcgggtgagaagagagctgtgggcctactgcggcagcgagcagctggatgtggccgacctgcggcggctgcgctacaagggcatccggcctgcccctggctaccccagccagcctgaccacacagagaagctgaccatgtggaggctggccgacatcgagcagagcacaggcatccggctgacagagagcctggccatggccccagccagcgctgtgtctggcctgtacttcagcaacctgaagagcaagtactttgctgtgggcaagatcagcaaggaccaggtggaggactatgccctgaggaagaacatctctgtggccgaggtggagaagtggctgggccccatcctgggctatgacacagactag

SEQ ID NO: 141993 - DNA, 2178 bp, Artificial Sequence
  Description of Artificial Sequence: Synthetic coding sequence
atgggcgccgcctctgtgcgggccggggcccggctggtggaggtggccctgtgcagcttcaccgtgacctgcctggaggtgatgaggcgcttcctgctgctgtatgccacccagcagggccaggccaaggccatcgccgaggagatctgtgagcaggccgtggtgcacggcttctctgctgacctgcactgcatcagcgagagtgacaagtatgacctgaagacagaaacagcccccctggtggtggtggtgtccaccactggaactggagaccccccagacacagccaggaagtttgtgaaggagatccagaaccagaccctgcctgtggacttctttgcccacctgcgctatggcctgctgggcctgggggacagcgagtacacctacttctgcaatggaggcaagatcatcgacaagaggctgcaggagctgggcgcccggcacttctatgacaccggccacgcagatgactgtgtgggcctggagctggtggtggagccctggattgctggcctgtggccagccctgaggaagcacttccgcagcagccggggccaggaggagatcagcggggccctgcctgtggccagccctgccagcagcaggacagacctggtgaagtctgagctgctgcacatcgagagccaggtggagctgctgcgctttgatgacagcggcaggaaggacagcgaggtgctgaagcagaatgctgtgaacagcaaccagagcaatgtggtgattgaagattttgagagcagcctgaccaggtctgtgccccccctgagccaggccagcctgaacatccctggcctgcccccagagtacctgcaggtgcacctgcaggagagcctgggccaggaggagagccaggtgtctgtgaccagcgctgaccctgtgttccaggtgcccatcagcaaggctgtgcagctgaccaccaatgatgccatcaagaccaccctgctggtggagctggacatcagcaacacagacttctcctaccagcctggagatgccttcagcgtcatctgccccaacagcgacagcgaggtgcagagcctgctgcagaggctgcagctggaggacaagcgggagcactgtgtgctgctgaagatcaaggctgacaccaagaagaagggggccaccctgccccagcacatcccagctggctgcagcctgcagttcatcttcacctggtgcctggagatccgggccatccccaagaaggccttcctgcgggccctggtggactacaccagtgacagcgctgagaagaggcggctgcaggagctgtgcagcaagcagggcgctgctgactacagcagatttgtgagagatgcctgtgcctgcctgctggacctgctgctggccttccccagctgccagccccccctgagcctgctgctggagcacctgcccaagctgcagccccggccctacagctgtgccagcagcagcctcttccaccctgggaagctgcactttgtgttcaacatcgtggagttcctgagcacagccaccacagaggtgctgaggaaaggagtgtgcaccggctggctggccctgctggtggcctctgtgctgcagcccaacatccacgccagccatgaagattctgggaaggccctggcccccaagatcagcatcagccccaggaccaccaacagcttccacctgcctgatgaccccagcatccccatcatcatggtgggccctggcaccggcatcgcccccttcatcggcttcctgcagcaccgggagaagctgcaggagcagcacccagatggcaactttggagccatgtggctgttcttcggctgccgccacaaggaccgggactacctgttcaggaaggagctgcggcacttcctgaagcacggcatcctgacccacctgaaggtgtccttcagcagagatgcccctgtgggggaggaggaggccccagccaagtatgtgcaggacaacatccagctgcacggccagcaggtggcccgcatcctgctgcaggagaatggccacatctacgtgtgtggagatgccaagaacatggccaaggatgtgcatgatgccctggtgcagatcatcagcaaggaggtgggcgtggagaagctggaggccatgaagaccctggccaccctgaaggaggagaagcgctacctgcaggacatctggagctag

SEQ ID NO: 141994 - DNA, 177 bp, Artificial Sequence
  Description of Artificial Sequence: Synthetic coding sequence
atgaggcgcttcctgctgctgtatgccacccagcagggccaggccaaggccatcgccgaggagatctgtgagcaggccgtggtgcacggcttctctgctgacctgcactgcatcagcgagagtgacaaggtgtctgtcatccagaacacccccacctttgccatgggcggccgctag

SEQ ID NO: 141995 - DNA, 2097 bp, Artificial Sequence
  Description of Artificial Sequence: Synthetic coding sequence
atgaggcgcttcctgctgctgtatgccacccagcagggccaggccaaggccatcgccgaggagatctgtgagcaggccgtggtgcacggcttctctgctgacctgcactgcatcagcgagagtgacaagtatgacctgaagacagaaacagcccccctggtggtggtggtgtccaccaccggcaccggggaccccccagacacagccaggaagtttgtgaaggagatccagaaccagaccctgcctgtggacttctttgcccacctgcgctatggcctgctgggcctgggggacagcgagtacacctacttctgcaatggaggcaagatcatcgacaagaggctgcaggagctgggcgcccggcacttctatgacaccggccatgctgatgactgtgtgggcctggagctggtggtggagccctggattgctggcctgtggccagccctgaggaagcacttccgcagcagccggggccaggaggagatcagcggggccctgcctgtggccagccctgccagcagcaggacagacctggtgaagtctgagctgctgcacatcgagagccaggtggagctgctgcgctttgatgattctggcaggaaggacagcgaggtgctgaagcagaatgctgtgaacagcaaccagagcaatgtggtgattgaggactttgagagcagcctgaccaggtctgtgccccccctgagccaggccagcctgaacatccctggcctgcccccagagtacctgcaggtgcacctgcaggagagcctgggccaggaggagagccaggtgtctgtgaccagcgctgaccccgtcttccaggtgcccatcagcaaggctgtgcagctgaccaccaatgatgccatcaagaccaccctgctggtggagctggacatcagcaacacagacttctcctaccagcctggagatgccttcagcgtcatctgccccaacagcgacagcgaggtgcagagcctgctgcagaggctgcagctggaggacaagcgggagcactgtgtgctgctgaagatcaaggctgacaccaagaagaagggggccaccctgccccagcacatcccagctggctgcagcctgcagttcatcttcacctggtgcctggagatccgggccatccccaagaaggccttcctgcgggccctggtggactacaccagtgacagcgctgagaagaggcggctgcaggagctgtgcagcaagcagggcgctgctgactacagcagatttgtgagagatgcctgtgcctgcctgctggacctgctgctggccttccccagctgccagccccccctgagcctgctgctggagcacctgcccaagctgcagccccggccctacagctgtgccagcagcagcctcttccaccctgggaagctgcactttgtgttcaacatcgtggagttcctgagcacagccaccacagaggtgctgaggaagggcgtgtgcaccggctggctggccctgctggtggcctctgtgctgcagcccaacatccacgccagccatgaggacagcggcaaggccctggcccccaagatcagcatcagccccaggaccaccaacagcttccacctgcctgatgaccccagcatccccatcatcatggtgggccctggcactggaattgcccccttcatcggcttcctgcagcaccgggagaagctgcaggagcagcacccagatggcaactttggagccatgtggctgttcttcggctgccgccacaaggaccgggactacctgttcaggaaggagctgcggcacttcctgaagcacggcatcctgacccacctgaaggtgtccttcagcagagatgcccctgtgggggaggaggaggccccagccaagtatgtgcaggacaacatccagctgcacggccagcaggtggcccgcatcctgctgcaggagaatggccacatctacgtgtgtggagatgccaagaacatggccaaggatgtgcatgatgccctggtgcagatcatcagcaaggaggtgggcgtggagaagctggaggccatgaagaccctggccaccctgaaggaggagaagcgctacctgcaggacatctggagctag

SEQ ID NO: 141996 - DNA, 471 bp, Artificial Sequence
  Description of Artificial Sequence: Synthetic coding sequence
atgaggcgcttcctgctgctgtatgccacccagcagggccaggccaaggccatcgccgaggagatctgtgagcaggccgtggtgcacggcttctctgctgacctgcactgcatcagcgagagtgacaagtatgacctgaagacagaaacagcccccctggtggtggtggtgtccaccaccggcaccggggaccccccagacacagccaggaagtttgtgaaggagatccagaaccagaccctgcctgtggacttctttgcccacctgcgctatggcctgctgggcctgggggacagcgagtacacctacttctgcaatggaggcaagatcatcgacaagaggctgcaggagctgggcgcccggcacttctatgacaccggccatgctgatgactgtgtgggcctggagctggtggtggagccctggattgctggcctgtggccagccctgaggaagcacttccgctcctag

SEQ ID NO: 141997 - DNA, 126 bp, Artificial Sequence
  Description of Artificial Sequence: Synthetic coding sequence
atgaggcgcttcctgctgctgtatgccacccagcagggccaggccaaggccatcgccgaggagatctgtgagcaggccgtggtgcacggcttctctgctgacctgcactgcatcagcgagagctag

SEQ ID NO: 141998 - DNA, 339 bp, Artificial Sequence
  Description of Artificial Sequence: Synthetic coding sequence
atgaggcgcttcctgctgctgtatgccacccagcagggccaggccaaggccatcgccgaggagatctgtgagcaggccgtggtgcacggcttctctgctgacctgcactgcatcagcgagagtgacaagtatgacctgaagacagaaacagcccccctggtggtggtggtgtccaccaccggcaccggggaccccccagacacagccaggaagtttgtgaaggagatccagaaccagaccctgcctgtggacttctttgcccacctgcgctatggcctgctgggcctgggggacagcgagtacacctacttctgcaatggaggcaagatcattgattag

SEQ ID NO: 141999 - DNA, 249 bp, Artificial Sequence
  Description of Artificial Sequence: Synthetic coding sequence
atgctgtgggaccctgccctgccccggctggccgtgtatgccagctgcctcttcttcagctgcctggatgcccacgagggccctgtgcacggcccccggggccgcggggagggcggccggggcagcgagcggcagagggtgcggcctgggggcggcggcggggccggctctgtgcacatccacctggaggaggaggatggagctgaggaccaggaccacagagatgaggactggatcaccaagaagtag

SEQ ID NO: 142000 - DNA, 1647 bp, Artificial Sequence
  Description of Artificial Sequence: Synthetic coding sequence
atgaccatggctgctgctgctgtggtggcccggggagctggggcccgggccgccacagctgctgccctgcggggcggctgcggcacagctgcccggggccggccctgtgccggccctgcccggcccctgtgcacagcccctggaacagccccagacatgaagcgctacctgtgggagcgctaccgggaggccaagaggagcacagaggagctggtgcccagcatcatgagcaacctgctgaacccagatgccatcttcagcaacaatgagatgagcctgagtgacatcgagatctacggctttgattatgactacaccctggtgttctacagcaagcacctgcacaccctcatcttcaatgctgcccgggacctgctgatcaatgagcaccgctacccagctgagatcagaaaatatgaatatgaccccaactttgccatccggggcctgcactatgatgtgcagagagctgtgctgatgaagattgatgccttccactacatccagctgggcaccgtgtaccggggcctgtctgtggtgcctgatgaggaggtgattgagatgtatgagggcagccacgtgcccctggagcagatgtctgacttctacggcaagagcagccacggcaacaccatgaagcagttcatggacatcttcagcctgcctgagatgaccctgctgagctgtgtgaatgagtacttcctgaagaacaacattgattatgagcctgtgcacctgtacaaggatgtgaaggacagcatcagagatgtgcacatcaagggcatcatgtaccgggccattgaagctgacatcgagaagtacatctgctacgccgagcagaccagggctgtgctggccaagctggccgaccacggcaagaagatgttcctgatcaccaacagccccagcagctttgtggacaagggcatgagctacatcgtgggcaaggactggagggacctgtttgatgtggtgattgtgcaggccgagaagcccaacttcttcaatgacaagagaagacccttcaggaagatgaatgagaagggcgtgctgctgtgggacaagatccacaagctgcagaagggccagatctacaagcagggcaacctgtatgagttcctgaagctgaccggctggaggggcagccgggtgctgtactttggagaccacatctacagcgacctggccgacctgaccctgaagcacggctggaggactggagccatcatccctgagctgcggtctgagctgaagatcatgaacacagagcagtacatccagaccatgacctggctgcagaccctgaccggcctgctggagcagatgcaggtgcacagagatgctgagagccagctggtgctgcaggagtggaagaaggagaggaaggagatgagggagatgaccaagagcttcttcaatgcccagtttggcagcctcttcagaacagaccagaaccccacctacttcctgcggcggctgagcagatttgctgacatctacatggccagcctgagctgcctgctgaactatgatgtgagccacaccttctaccccaggaggacccccctgcagcacgagctgcctgcctggagcgagcggccccccaccttcggcacccccctgctgcaggaggcccaggccaagtag

SEQ ID NO: 142001 - DNA, 1686 bp, Artificial Sequence
  Description of Artificial Sequence: Synthetic coding sequence
atgagcacctcctggagcgaccggctgcagaatgctgctgacatgcctgccaacatggacaagcacgccctgaagaagtaccgccgggaggcctaccaccgggtgtttgtgaacagaagcctggccatggagaagatcaagtgctttggatttgacatggactacaccctggccgtgtacaagagcccagaatatgagagcctgggctttgagctgactgtggagcggctggtgtccatcggctacccccaggagctgctgagctttgcctatgacagcaccttccccacccggggcctggtgtttgacaccctgtatggcaacctgctgaaggtggatgcctacggcaacctgctggtgtgtgcccacggcttcaacttcatccggggccctgagacccgggagcagtaccccaacaagttcatccagagagatgacacagagcgcttctacatcctgaacaccctcttcaacctgcctgagacctacctgctggcctgcctggtggacttcttcaccaactgcccccgctacaccagctgtgaaacaggcttcaaggatggagacctcttcatgagctaccgctccatgttccaggatgtgagagatgctgtggactgggtgcactacaagggcagcctgaaggagaagacagtggagaacctggagaagtatgtggtgaaggatggcaagctgcccctgctgctgagcaggatgaaggaggtgggcaaggtgttcctggccaccaacagcgactacaagtacacagacaagatcatgacctacctgtttgacttcccccacggccccaagccaggcagcagccaccggccctggcagagctactttgacctgatcctggtggatgccaggaagcccctcttcttcggggagggcaccgtgctgcggcaggtggacaccaagacaggcaagctgaagattggcacctacacaggccccctgcagcacggcatcgtgtacagcggcggcagcagtgacaccatctgtgacctgctgggcgccaagggcaaggacatcctgtacatcggggaccacatctttggagacatcctgaagagcaagaagaggcagggctggaggaccttcctggtgattcctgagctggcccaggagctgcacgtgtggacagacaagagcagcctgtttgaggagctgcagagcctggacatcttcctggccgagctgtacaagcacctggacagcagcagcaatgaaagaccagacatcagcagcatccagaggcgcatcaagaaggtgacccatgacatggacatgtgctacggcatgatgggcagcctcttccgcagcggcagccggcagaccctgtttgccagccaggtgatgagatatgctgacctgtatgctgccagcttcatcaacctgctgtactaccccttctcctacctgttccgggccgcccacgtgctgatgcctcatgagagcacagtggagcacacccacgtggacatcaatgagatggagagccccctggccaccaggaacagaacatctgtggacttcaaggacacagactacaagaggcaccagctgaccaggagcatcagcgagatcaagccacccaacctcttccccctggccccccaggagatcacccactgccatgatgaagatgatgatgaggaggaggaggaggaggaggagtag

SEQ ID NO: 142002 - DNA, 600 bp, Artificial Sequence
  Description of Artificial Sequence: Synthetic coding sequence
atggactacaccctggccgtgtacaagagcccagaatatgagagcctgggctttgagctgactgtggagcggctggtgtccatcggctacccccaggagctgctgagctttgcctatgacagcaccttccccacccggggcctggtgtttgacaccctgtatggcaacctgctgaaggtggatgcctacggcaacctgctggtgtgtgcccacggcttcaacttcatccggggcagccaggtggccgtgcagaagaggcctgagacccgggagcagtaccccaacaagttcatccagagagatgacacagagcgcttctacatcctgaacaccctcttcaacctgcctgagacctacctgctggcctgcctggtggacttcttcaccaactgcccccgctacaccagctgtgaaacaggcttcaaggatggagacctcttcatgagctaccgctccatgttccaggatgtgagagatgctgtggactgggtgcactacaagggcagcctgaaggagaagacagtggagaacctggagaagtatgtggtgaaggacagcaagagcagccgcatccagtacttcctgaaggtgctgtggtag

SEQ ID NO: 142003 - DNA, 1686 bp, Artificial Sequence; identical to SEQ ID NO: 142001
  Description of Artificial Sequence: Synthetic coding sequence

SEQ ID NO: 142004 - DNA, 444 bp, Artificial Sequence
  Description of Artificial Sequence: Synthetic coding sequence
gtgctgcggcaggtggacaccaagacaggcaagctgaagattggcacctacacaggccccctgcagcacggcatcgtgtacagcggcggcagcagtgacaccatctgtgacctgctgggcgccaagggcaaggacatcctgtacatcggggaccacatctttggagacatcctgaagagcaagaagaggcagggctggaggaccttcctggtgattcctgagctggcccaggagctgcacgtgtggacagacaagagcagcctgtttgaggagctgcagagcctggacatcttcctggccgagctgtacaagcacctggacagcagcagcaatgaaagaccagacatcagcagcatccagaggcgcatcaagatgcctcatgagagcacagtggagcacacccacgtggacatcaatgagatggagagccccctggccacctag

SEQ ID NO: 142005 - DNA, 1599 bp, Artificial Sequence
  Description of Artificial Sequence: Synthetic coding sequence
atgagcaaggagggcgtgtttgtgaacagaagcctggccatggagaagatcaagtgcttcggctttgacatggactacaccctggccgtgtacaagagcccagaatatgagagcctgggctttgagctgactgtggagcggctggtgtccatcggctacccccaggagctgctgagctttgcctatgacagcaccttccccacccggggcctggtgtttgacaccctgtatggcaacctgctgaaggtggatgcctacggcaacctgctggtgtgtgcccacggcttcaacttcatccggggccctgagacccgggagcagtaccccaacaagttcatccagagagatgacacagagcgcttctacatcctgaacaccctcttcaacctgcctgagacctacctgctggcctgcctggtggacttcttcaccaactgcccccgctacaccagctgtgagaccggcttcaaggatggagacctcttcatgagctaccgctccatgttccaggatgtgagagatgctgtggactgggtgcactacaagggcagcctgaaggagaagacagtggagaacctggagaagtatgtggtgaaggatggcaagctgcccctgctgctgagcaggatgaaggaggtgggcaaggtgttcctggccaccaacagcgactacaagtacacagacaagatcatgacctacctgtttgacttcccccacggccccaagccaggcagcagccaccggccctggcagagctactttgacctgatcctggtggatgccaggaagcccctcttctttggagagggcaccgtgctgcggcaggtggacaccaagacaggcaagctgaagattggcacctacacaggccccctgcagcacggcatcgtgtacagcggcggcagcagtgacaccatctgtgacctgctgggcgccaagggcaaggacatcctgtacatcggggaccacatctttggagacatcctgaagagcaagaagaggcagggctggaggaccttcctggtgattcctgagctggcccaggagctgcacgtgtggacagacaagagcagcctgtttgaggagctgcagagcctggacatcttcctggccgagctgtacaagcacctggacagcagcagcaatgaaagaccagacatcagcagcatccagaggcgcatcaagaaggtgacccatgacatggacatgtgctacggcatgatgggcagcctcttccgcagcggcagccggcagaccctgtttgccagccaggtgatgagatatgctgacctgtatgctgccagcttcatcaacctgctgtactaccccttctcctacctgttccgggccgcccacgtgctgatgcctcatgagagcacagtggagcacacccacgtggacatcaatgagatggagagccccctggccaccaggaacagaacatctgtggacttcaaggacacagactacaagaggcaccagctgaccaggagcatcagcgagatcaagccacccaacctcttccccctggccccccaggagatcacccactgccatgatgaagatgatgatgaggaggaggaggaggaggaggagtag

SEQ ID NO: 142006 - DNA, 798 bp, Artificial Sequence
  Description of Artificial Sequence: Synthetic coding sequence
atgagcacctcctggagcgaccggctgcagaatgctgctgacatgcctgccaacatggacaagcacgccctgaagaagtaccgccgggaggcctaccaccgggtgtttgtgaacagaagcctggccatggagaagatcaagtgctttggatttgacatggactacaccctggccgtgtacaagagcccagaatatgagagcctgggctttgagctgactgtggagcggctggtgtccatcggctacccccaggagctgctgagctttgcctatgacagcaccttccccacccggggcctggtgtttgacaccctgtatggcaacctgctgaaggtggatgcctacggcaacctgctggtgtgtgcccacggcttcaacttcatccggggcagccaggtggccgtgcagaagaggcctgagacccgggagcagtaccccaacaagttcatccagagagatgacacagagcgcttctacatcctgaacaccctcttcaacctgcctgagacctacctgctggcctgcctggtggacttcttcaccaactgcccccgctacaccagctgtgaaacaggcttcaaggatggagacctcttcatgagctaccgctccatgttccaggatgtgagagatgctgtggactgggtgcactacaagggcagcctgaaggagaagacagtggagaacctggagaagtatgtggtgaaggatggcaagctgcccctgctgctgagcaggatgaaggaggtgggcaaggtgttcctggccaccaacagcgactacaagtacacagactag

SEQ ID NO: 142007 - DNA, 525 bp, Artificial Sequence
  Description of Artificial Sequence: Synthetic coding sequence
gtgtccatcggctacccccaggagctgctgagctttgcctatgacagcaccttccccacccggggcctggtgtttgacaccctgtatggcaacctgctgaaggtggatgcctacggcaacctgctggtgtgtgcccacggcttcaacttcatccggggcagccaggtggccgtgcagaagaggcctgagacccgggagcagtaccccaacaagttcatccagagagatgacacagagcgcttctacatcctgaacaccctcttcaacctgcctgagacctacctgctggcctgcctggtggacttcttcaccaactgcccccgctacaccagctgtgagaccggcttcaaggatggagacctcttcatgagctaccgctccatgttccaggatgtgagagatgctgtggactgggtgcactacaagggcagcctgaaggagaagacagtggagaacctggagaagtatgtggtgaaggacagcaagagcagccgcatccagtacttcctgaaggtgctgtggtag

SEQ ID NO: 142008 - DNA, 1011 bp, Artificial Sequence
  Description of Artificial Sequence: Synthetic coding sequence
atgagggcccccagcatggacagagctgctgtggcccgggtgggcgctgtggccagcgcctctgtgtgtgccctggtggccggcgtggtgctggcccagtacatcttcaccctgaagaggaagacaggcaggaagaccaagatcatcgagatgatgcctgagttccagaagagctctgtgcgcatcaagaaccccaccagggtggaggagatcatctgtggcctcatcaagggcggggccgccaagctgcagatcatcacagactttgacatgaccctgagccgcttctcctacaagggcaagcgctgccccacctgccacaacatcatcgacaactgcaagctggtgacagatgaatgtaggaagaagctgctgcagctgaaggagaagtactatgccatcgaggtggaccctgtgctgactgtggaggagaagtacccctacatggtggagtggtacaccaagagccacggcctgctggtgcagcaggccctgcccaaggccaagctgaaggagatcgtggccgagagtgatgtgatgctgaaggagggctatgagaacttctttgacaagctgcagcagcacagcatccctgtgttcatcttctctgctggcattggagatgtgctggaggaggtgatccggcaggccggcgtgtaccaccccaacgtgaaggtggtgagcaacttcatggactttgatgagaccggggtgctgaagggcttcaagggggagctgatccacgtgttcaacaagcatgatggagccctgaggaacacagagtacttcaaccagctgaaggacaacagcaacatcatcctgctgggggacagccagggcgacctgaggatggctgatggagtggccaacgtggagcacatcctgaagattggctacctgaatgacagagtggatgagctgctggagaagtacatggacagctatgacatcgtgctggtgcaggatgagagcctggaggtggccaacagcatcctgcagaagatcctgtag

SEQ ID NO: 142009 - DNA, 858 bp, Artificial Sequence
  Description of Artificial Sequence: Synthetic coding sequence
atgcctgagttccagaagagctctgtgcgcatcaagaaccccaccagggtggaggagatcatctgtggcctcatcaagggcggggccgccaagctgcagatcatcacagactttgacatgaccctgagccgcttctcctacaagggcaagcgctgccccacctgccacaacatcatcgacaactgcaagctggtgacagatgagtgcaggaagaagctgctgcagctgaaggagaagtactatgccatcgaggtggaccctgtgctgactgtggaggagaagtacccctacatggtggagtggtacaccaagagccacggcctgctggtgcagcaggccctgcccaaggccaagctgaaggagatcgtggccgagagtgatgtgatgctgaaggagggctatgagaacttctttgacaagctgcagcagcacagcatccctgtgttcatcttctctgctggcattggagatgtgctggaggaggtgatccggcaggccggcgtgtaccaccccaacgtgaaggtggtgagcaacttcatggactttgatgaaacaggagtgctgaagggcttcaagggggagctgattcatgtgttcaacaagcatgatggagccctgaggaacacagagtacttcaaccagctgaaggacaacagcaacatcatcctgctgggggacagccagggcgacctgaggatggctgatggagtggccaacgtggagcacatcctgaagattggctacctgaatgacagagtggatgagctgctggagaagtacatggacagctatgacatcgtgctggtgcaggatgagagcctggaggtggccaacagcatcctgcagaagatcctgtag

SEQ ID NO: 142010 - DNA, 894 bp, Artificial Sequence
  Description of Artificial Sequence: Synthetic coding sequence
atgaccaaccaggagagcgctgtgcacgtgaagatgatgcctgagttccagaagagctctgtgcgcatcaagaaccccaccagggtggaggagatcatctgtggcctcatcaagggcggggccgccaagctgcagatcatcacagactttgacatgaccctgagccgcttctcctacaagggcaagcgctgccccacctgccacaacatcatcgacaactgcaagctggtgacagatgagtgcaggaagaagctgctgcagctgaaggagaagtactatgccatcgaggtggaccctgtgctgactgtggaggagaagtacccctacatggtggagtggtacaccaagagccacggcctgctggtgcagcaggccctgcccaaggccaagctgaaggagatcgtggccgagagtgatgtgatgctgaaggagggctatgagaacttctttgacaagctgcagcagcacagcatccctgtgttcatcttctctgctggcattggagatgtgctggaggaggtgatccggcaggccggcgtgtaccaccccaacgtgaaggtggtgagcaacttcatggactttgatgaaacaggagtgctgaagggcttcaagggggagctgattcatgtgttcaacaagcatgatggagccctgaggaacacagagtacttcaaccagctgaaggacaacagcaacatcatcctgctgggggacagccagggcgacctgaggatggctgatggagtggccaacgtggagcacatcctgaagattggctacctgaatgacagagtggatgagctgctggagaagtacatggacagctatgacatcgtgctggtgcaggatgagagcctggaggtggccaacagcatcctgcagaagatcctgtag

SEQ ID NO: 142011 - DNA, 894 bp, Artificial Sequence; identical to SEQ ID NO: 142010
  Description of Artificial Sequence: Synthetic coding sequence

SEQ ID NO: 142012 - DNA, 858 bp, Artificial Sequence; identical to SEQ ID NO: 142009
  Description of Artificial Sequence: Synthetic coding sequence

SEQ ID NO: 142013 - DNA, 129 bp, Artificial Sequence
  Description of Artificial Sequence: Synthetic coding sequence
atgcctgagttccagaagagctctgtgcgcatcaagaaccccaccagggtggaggagatcatctgtggcctcatcaagggcggggccgccaagctgcagatcatcacagactttgacatgaccctgtag

SEQ ID NO: 142014 - DNA, 1725 bp, Artificial Sequence
  Description of Artificial Sequence: Synthetic coding sequence
atgtgccccagggctgcccgggccccagccaccctgctgctggccctgggcgctgtgctgtggccagctgctggggcctgggagctgaccatcctgcacaccaatgatgtgcacagccggctggagcagaccagcgaggacagcagcaaatgtgtgaatgccagccgctgcatgggcggcgtggcccggctcttcaccaaggtgcagcagatccggcgggcagagcccaacgtgctgctgctggatgctggggaccagtaccagggcaccatctggttcaccgtgtacaagggagctgaggtggcccacttcatgaatgccctgcgctatgatgccatggccctgggcaaccacgagtttgacaacggggtggagggcctcatcgagcccctgctgaaggaggccaagttccccatcctgagcgccaacatcaaggccaagggccccctggccagccagatcagcggcctgtacctgccctacaaggtgctgcctgtgggagatgaggtggtgggcatcgtgggctacaccagcaaggagacccccttcctgagcaaccctggcaccaacctggtgtttgaagatgagatcacagccctgcagcctgaggtggacaagctgaagaccctgaatgtgaacaagatcatcgccctgggccacagcggctttgagatggacaagctgattgcccagaaggtgcggggcgtggatgtggtggtgggcggccacagcaacaccttcctgtacacaggcaacccccccagcaaggaggtgcctgctgggaagtaccccttcatcgtgaccagtgatgatggcaggaaggtgcctgtggtgcaggcctatgccttcggcaagtacctgggctacctgaagattgaatttgatgaaagaggaaatgtcatcagcagccacggcaaccccatcctgctgaacagcagcatccctgaggaccccagcatcaaggctgacatcaacaagtggaggatcaagctggacaactacagcacccaggagctgggcaagaccatcgtgtacctggatggcagcagccagagctgccgcttccgggagtgcaacatgggcaacctgatctgtgatgccatgatcaacaacaacctgcggcacacagatgagatgttctggaaccacgtgtccatgtgcatcctgaatggaggcggcatccgcagccccattgatgaaagaaataatggcaccatcacctgggagaacctggccgctgtgctgccctttggaggcacctttgacctggtgcagctgaagggcagcaccctgaagaaggcctttgagcacagcgtgcacagatatggccagagcactggagagttcctgcaggtgggcggcatccacgtggtgtatgacctgagcaggaagccaggggacagagtggtgaagctggatgtgctgtgcaccaagtgccgggtgcccagctatgaccccctgaagatggatgaggtgtacaaggtgatcctgcccaacttcctggccaatggaggagatggcttccagatgatcaaggatgagctgctgcggcatgacagcggggaccaggacatcaacgtggtgtccacctacatcagcaagatgaaggtgatctacccagctgtggagggccgcatcaagttcagcacaggcagccactgccacggcagcttcagcctcatcttcctgagcctgtgggccgtcatctttgtgctgtaccagtag

SEQ ID NO: 142015 - DNA, 795 bp, Artificial Sequence
  Description of Artificial Sequence: Synthetic coding sequence
atgtgccccagggctgcccgggccccagccaccctgctgctggccctgggcgctgtgctgtggccagctgctggggcctgggagctgaccatcctgcacaccaatgatgtgcacagccggctggagcagaccagcgaggacagcagcaaatgtgtgaatgccagccgctgcatgggcggcgtggcccggctcttcaccaaggtgcagcagatccggcgggcagagcccaacgtgctgctgctggatgctggggaccagtaccagggcaccatctggttcaccgtgtacaagggagctgaggtggcccacttcatgaatgccctgcgctatgatgccatggccctgggcaaccacgagtttgacaacggggtggagggcctcatcgagcccctgctgaaggaggccaagttccccatcctgagcgccaacatcaaggccaagggccccctggccagccagatcagcggcctgtacctgccctacaaggtgctgcctgtgggagatgaggtggtgggcatcgtgggctacaccagcaaggagacccccttcctgagcaaccctggcaccaacctggtgtttgaagatgagatcacagccctgcagcctgaggtggacaagctgaagaccctgaatgtgaacaagatcatcgccctgggccacagcggctttgagatggacaagctgattgcccagaaggtgcggggcgtggatgtggtggtgggcggccacagcaacaccttcctgtacacaggcaactgcttcaagagaattgcctgggccaggatgagcaggtag

SEQ ID NO: 142016 - DNA, 780 bp, Artificial Sequence
  Description of Artificial Sequence: Synthetic coding sequence
atggacaagctgattgcccagaaggtgcggggcgtggatgtggtggtgggcggccacagcaacaccttcctgtacacaggcaacccccccagcaaggaggtgcctgctgggaagtaccccttcatcgtgaccagtgatgatggcaggaaggtgcctgtggtgcaggcctatgccttcggcaagtacctgggctacctgaagattgaatttgatgaaagaggaaatgtcatcagcagccacggcaaccccatcctgctgaacagcagcatccctgaggaccccagcatcaaggctgacatcaacaagtggaggatcaagctggacaactacagcacccaggagctgggcaagaccatcgtgtacctggatggcagcagccagagctgccgcttccgggagtgcaacatgggcaacctgatctgtgatgccatgatcaacaacaacctgcggcacacagatgagatgttctggaaccacgtgtccatgtgcatcctgaatggaggcggcatccgcagccccattgatgaaagaaataatggcaccatcacctgggagaacctggccgctgtgctgccctttggaggcacctttgacctggtgcagctgaagggcagcaccctgaagaaggcctttgagcacagcgtgcacagatatggccagagcactggagagttcctgcaggtgggggacctgaaggagtgctgccccatctgcatcaaccaggatgacagctggaaggagcagcccacagcccagacctacctgaacacctggttctag

SEQ ID NO: 142017 - DNA, 1575 bp, Artificial Sequence
  Description of Artificial Sequence: Synthetic coding sequence
atgtgccccagggctgcccgggccccagccaccctgctgctggccctgggcgctgtgctgtggccagctgctggggcctgggagctgaccatcctgcacaccaatgatgtgcacagccggctggagcagaccagcgaggacagcagcaaatgtgtgaatgccagccgctgcatgggcggcgtggcccggctcttcaccaaggtgcagcagatccggcgggcagagcccaacgtgctgctgctggatgctggggaccagtaccagggcaccatctggttcaccgtgtacaagggagctgaggtggcccacttcatgaatgccctgcgctatgatgccatggccctgggcaaccacgagtttgacaacggggtggagggcctcatcgagcccctgctgaaggaggccaagttccccatcctgagcgccaacatcaaggccaagggccccctggccagccagatcagcggcctgtacctgccctacaaggtgctgcctgtgggagatgaggtggtgggcatcgtgggctacaccagcaaggagacccccttcctgagcaaccctggcaccaacctggtgtttgaagatgagatcacagccctgcagcctgaggtggacaagctgaagaccctgaatgtgaacaagatcatcgccctgggccacagcggctttgagatggacaagctgattgcccagaaggtgcggggcgtggatgtggtggtgggcggccacagcaacaccttcctgtacacaggcaacccccccagcaaggaggtgcctgctgggaagtaccccttcatcgtgaccagtgatgatggcaggaaggtgcctgtggtgcaggcctatgccttcggcaagtacctgggctacctgaagattgaatttgatgaaagaggaaatgtcatcagcagccacggcaaccccatcctgctgaacagcagcatccctgaggaccccagcatcaaggctgacatcaacaagtggaggatcaagctggacaactacagcacccaggagctgggcaagaccatcgtgtacctggatggcagcagccagagctgccgcttccgggagtgcaacatgggcaacctgatctgtgatgccatgatcaacaacaacctgcggcacacagatgagatgttctggaaccacgtgtccatgtgcatcctgaatggaggcggcatccgcagccccattgatgaaagaaataatggcatccacgtggtgtatgacctgagcaggaagccaggggacagagtggtgaagctggatgtgctgtgcaccaagtgccgggtgcccagctatgaccccctgaagatggatgaggtgtacaaggtgatcctgcccaacttcctggccaatggaggagatggcttccagatgatcaaggatgagctgctgcggcatgacagcggggaccaggacatcaacgtggtgtccacctacatcagcaagatgaaggtgatctacccagctgtggagggccgcatcaagttcagcacaggcagccactgccacggcagcttcagcctcatcttcctgagcctgtgggccgtcatctttgtgctgtaccagtag

SEQ ID NO: 142018 - DNA, 693 bp, Artificial Sequence
  Description of Artificial Sequence: Synthetic coding sequence
tgagatgtggtggtgggcggccacagcaacaccttcctgtacacaggcaacccccccagcaaggaggtgcctgctgggaagtaccccttcatcgtgaccagtgatgatggcaggaaggtgcctgtggtgcaggcctatgccttcggcaagtacctgggctacctgaagattgaatttgatgaaagaggaaatgtcatcagcagccacggcaaccccatcctgctgaacagcagcatccctgaggaccccagcatcaaggctgacatcaacaagtggaggatcaagctggacaactacagcacccaggagctgggcaagaccatcgtgtacctggatggcagcagccagagctgccgcttccgggagtgcaacatgggcaacctgatctgtgatgccatgatcaacaacaacctgcggcacacagatgagatgttctggaaccacgtgtccatgtgcatcctgaatggaggcggcatccgcagccccattgatgagaggaacaacggcatccacgtggtgtatgacctgagcaggaagccaggggacagagtggtgaagctggatgtgctgtgcaccaagtgccgggtgcccagctatgaccccctgaagatggatgaggtgtacaaggtgatcctgcccaacttcctggccaatggaggagatggcttccagatgatcaaggatgagctgtag

SEQ ID NO: 142019 - DNA, 540 bp, Artificial Sequence
  Description of Artificial Sequence: Synthetic coding sequence
tgaaaccccatcctgctgaacagcagcatccctgaggaccccagcatcaaggctgacatcaacaagtggaggatcaagctggacaactacagcacccaggagctgggcaagaccatcgtgtacctggatggcagcagccagagctgccgcttccgggagtgcaacatgggcaacctgatctgtgatgccatgatcaacaacaacctgcggcacacagatgagatgttctggaaccacgtgtccatgtgcatcctgaatggaggcggcatccgcagccccattgatgaaagaaataatggcaccatcacctgggagaacctggccgctgtgctgccctttggaggcacctttgacctggtgcagctgaagggcagcaccctgaagaaggcctttgagcacagcgtgcacagatatggccagagcactggagagttcctgcaggtgggggacctgaaggagtgctgccccatctgcatcaaccaggatgacagctggaaggagcagcccacagcccagacctacctgaacacctggttctag

SEQ ID NO: 142020 - DNA, 687 bp, Artificial Sequence
  Description of Artificial Sequence: Synthetic coding sequence
atggtgcgctacagcctggaccctgagaaccccaccaagagctgcaagagccggggcagcaacctgcgggtgcacttcaagaacacccgggagacagcccaggccatcaagggcatgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagctgcggagcagcagcctgggcaagtggtgtgccttcctggtgtcctccttccagttctgcagcggcagcaccaagaacagctggagccacatctacaccctgtggttcccccccagcctggtggtgtatggcctgaggaagcagtacaagaaccccatgatccagaccaaggccaagtag

SEQ ID NO: 142021 - DNA, 816 bp, Artificial Sequence
  Description of Artificial Sequence: Synthetic coding sequence
atgagccctgagatgggagagctgacccagacccggctgcagaagatctggatcccccacagcagcggcagcagccggctgcagaggcggcggggcagcagcatcccccagttcaccaacagccccaccatggtgatcatggtgggcctgcctgcccggggcaagacctacatcagcaccaagctgacccgctacctgaactggattggcacccccaccaaggacaacatggaggccctgcagatcaggaagcagtgtgccctggccgccctgaaggatgtgcacaactacctgagccatgaggagggccacgtggccgtgtttgatgccaccaacaccacccgggagaggaggagcctcatcctgcagtttgccaaggagcacggctacaagggcgtgtgtgaggagatgacctatgaggagatccaggagcactacccagaggagtttgccctgcgggaccaggacaagtaccgctaccgctaccccaagggggagagctatgaggacctggtgcagaggctggagcctgtgatcatggagctggagcggcaggagaatgtgctggtgatctgccaccaggccgtgatgcgctgcctgctggcctacttcctggacaagagcagtgatgagctgccctacctgaagtgccccctgcacacagtgctgaagctgacccctgtggcctacggctgcaaggtggagagcatctacctgaatgtggaggccgtgaacacccaccgggagaagccagaaaatgtggacatcacccgggagcctgaggaggccctggacacagtgcctgcccactactag

SEQ ID NO: 142022 - DNA, 1416 bp, Artificial Sequence
  Description of Artificial Sequence: Synthetic coding sequence
atgagccctgagatgggagagctgacccagacccggctgcagaagatctggatcccccacagcagcggcagcagccggctgcagaggcggcggggcagcagcatcccccagttcaccaacagccccaccatggtgatcatggtgggcctgcctgcccggggcaagacctacatcagcaccaagctgacccgctacctgaactggattggcacccccaccaaggtgttcaacctgggccagtaccgccgggaggccgtgtcctacaagaactatgagttcttcctgcctgacaacatggaggccctgcagatcaggaagcagtgtgccctggccgccctgaaggatgtgcacaactacctgagccatgaggagggccacgtggccgtgtttgatgccaccaacaccacccgggagaggaggagcctcatcctgcagtttgccaaggagcacggctacaaggtgttcttcatcgagagcatctgcaatgaccccggcatcatcgccgagaacatccggcaggtgaagctgggcagcccagactacatcgactgtgaccgggagaaggtgctggaggacttcctgaagagaattgagtgctatgaggtgaactaccagcccctggatgaggagctggacagccacctgagctacatcaagatctttgatgtgggcacccgctacatggtgaacagagtgcaggaccacatccagagcaggacagtgtactacctgatgaacatccacgtgacccccaggagcatctacctgtgcagacatggagagagcgagctgaacatccggggccgcatcggcggggacagcggcctgtctgtgcggggcaagcagtatgcctatgccctggccaacttcatccagagccagggcatcagcagcctgaaggtgtggaccagccacatgaagaggaccatccagacagctgaggccctgggcgtgccctatgagcagtggaaggccctgaatgaaattgatgctggggtgtgtgaggagatgacctatgaggagatccaggagcactacccagaggagtttgccctgcgggaccaggacaagtaccgctaccgctaccccaagggggagagctatgaggacctggtgcagaggctggagcctgtgatcatggagctggagcggcaggagaatgtgctggtgatctgccaccaggccgtgatgcgctgcctgctggcctacttcctggacaagagcagtgatgagctgccctacctgaagtgccccctgcacacagtgctgaagctgacccctgtggcctacggctgcaaggtggagagcatctacctgaatgtggaggccgtgaacacccaccgggagaagccagaaaatgtggacatcacccgggagcctgaggaggccctggacacagtgcctgcccactactag

SEQ ID NO: 142023 - DNA, 1221 bp, Artificial Sequence
  Description of Artificial Sequence: Synthetic coding sequence
atggaggagaagaccagccgcatcaaggtgttcaacctgggccagtacagaagagaggccgtgtcctacaagaactatgagttcttcctgcctgacaacatggaggccctgcagatcaggaagcagtgtgccctggccgccctgaaggatgtgcacaactacctgagccatgaggagggccacgtggccgtgtttgatgccaccaacaccacccgggagcggcgcagcctcatcctgcagtttgccaaggagcacggctacaaggtgttcttcatcgagagcatctgcaatgaccccggcatcatcgccgagaacatccggcaggtgaagctgggcagcccagactacatcgactgtgaccgggagaaggtgctggaggacttcctgaagagaattgaatgttatgaggtgaactaccagcccctggatgaggagctggacagccacctgagctacatcaagatctttgatgtgggcacccgctacatggtgaacagagtgcaggaccacatccagagcaggacagtgtactacctgatgaacatccacgtgacccccaggagcatctacctgtgccgccacggggagagcgagctgaacatccggggcagaattggaggagacagcggcctgtctgtgcggggcaagcagtatgcctatgccctggccaacttcatccagagccagggcatcagcagcctgaaggtgtggaccagccacatgaagaggaccatccagacagctgaggccctgggcgtgccctatgagcagtggaaggccctgaatgaaattgatgctggggtgtgtgaggagatgacctatgaggagatccaggagcactacccagaggagtttgccctgcgggaccaggacaagtaccgctaccgctaccccaagggggagagctatgaggacctggtgcagaggctggagcccgtcatcatggagctggagcggcaggagaatgtgctggtgatctgccaccaggccgtgatgcgctgcctgctggcctacttcctggacaagagcagtgatgagctgccctacctgaagtgccccctgcacacagtgctgaagctgacccctgtggcctacggctgcaaggtggagagcatctacctgaatgtggaggccgtgaacacccaccgggagaagccagaaaatgtggacatcacccgggagcctgaggaggccctggacacagtgcctgcccactactag

SEQ ID NO: 142024 - DNA, 1416 bp, Artificial Sequence
  Description of Artificial Sequence: Synthetic coding sequence
atgtctggggccagcagcagcgagcagaacaacaacagctatgagaccaagacccccaacctgaggatgtctgagaagaagtgctcctgggccagctacatgaccaacagccccaccctgattgtgatgattggcctgcctgcccggggcaagacctacgtgtccaagaagctgacccgctacctgaactggattggagtgcccaccaaggtgttcaacctgggcgtgtaccgccgggaggccgtgaagagctacaagagctatgacttcttcagacatgacaatgaggaggccatgaagatcaggaagcagtgtgccctggtggccctggaggatgtgaaggcctacctgacagaggagaatggccagattgctgtgtttgatgccaccaacaccacccgggagcggcgggacatgatcctgaactttgctgagcagaacagcttcaaggtgttctttgtggagagcgtgtgtgatgatcctgatgtgattgctgccaacatcctggaggtgaaggtgagcagcccagactacccagagaggaaccgggagaatgtgatggaggacttcctgaagagaattgagtgctacaaggtgacctaccggcccctggaccctgacaactatgacaaggacctgtccttcatcaaggtgatcaacgtgggccagcgcttcctggtgaacagagtgcaggactacatccagagcaagatcgtgtactacctgatgaacatccacgtgcagcccaggaccatctacctgtgcagacatggagagagcgagttcaacctgctgggcaagattggaggagacagcggcctgtctgtgcggggcaagcagtttgcccaggccctgaggaagttcctggaggagcaggagatcacagacctgaaggtgtggaccagccagctgaagaggaccatccagacagctgagagcctgggcgtgccctatgagcagtggaagatcctgaatgaaattgatgctggggtgtgtgaggagatgacctacgccgagattgagaagcgctacccagaggagtttgccctgcgggaccaggagaagtacctgtaccgctacccaggaggagagagctaccaggacctggtgcagaggctggagcctgtgatcatggagctggagcggcagggcaatgtgctggtgatcagccaccaggccgtgatgcgctgcctgctggcctacttcctggacaagggagcagatgagctgccctacctgcgctgccccctgcacaccatcttcaagctgacccctgtggcctacggctgcaaggtggagaccatcaagctgaatgtggaggccgtgaacacccaccgggacaagcccacagctgctgagaccaccctggccgtgagaagaagaccttctgctgccagcctgatgctgccctgctag

SEQ ID NO: 142025 - DNA, 1518 bp, Artificial Sequence
  Description of Artificial Sequence: Synthetic coding sequence
atgtctggggccagcagcagcgagcagaacaacaacagctatgagaccaagacccccaacctgaggatgtctgagaagaagtgctcctgggccagctacatgaccaacagccccaccctgattgtgatgattggcctgcctgcccggggcaagacctacgtgtccaagaagctgacccgctacctgaactggattggagtgcccaccaaggtgttcaacctgggcgtgtaccgccgggaggccgtgaagagctacaagagctatgacttcttcagacatgacaatgaggaggccatgaagatcaggaagcagtgtgccctggtggccctggaggatgtgaaggcctacctgacagaggagaatggccagattgctgtgtttgatgccaccaacaccacccgggagcggcgggacatgatcctgaactttgctgagcagaacagcttcaaggtgttctttgtggagagcgtgtgtgatgatcctgatgtgattgctgccaacatcctggaggtgaaggtgagcagcccagactacccagagaggaaccgggagaatgtgatggaggacttcctgaagagaattgagtgctacaaggtgacctaccggcccctggaccctgacaactatgacaaggacctgtccttcatcaaggtgatcaacgtgggccagcgcttcctggtgaacagagtgcaggactacatccagagcaagatcgtgtactacctgatgaacatccacgtgcagcccaggaccatctacctgtgcagacatggagagagcgagttcaacctgctgggcaagattggaggagacagcggcctgtctgtgcggggcaagcagtttgcccaggccctgaggaagttcctggaggagcaggagatcacagacctgaaggtgtggaccagccagctgaagaggaccatccagacagctgagagcctgggcgtgccctatgagcagtggaagatcctgaatgaaattgatgctggggtgtgtgaggagatgacctacgccgagattgagaagcgctacccagaggagtttgccctgcgggaccaggagaagtacctgtaccgctacccaggaggagagagctaccaggacctggtgcagaggctggagcctgtgatcatggagctggagcggcagggcaatgtgctggtgatcagccaccaggccgtgatgcgctgcctgctggcctacttcctggacaagggagcagatgagctgccctacctgcgctgccccctgcacaccatcttcaagctgacccctgtggcctacggctgcaaggtggagaccatcaagctgaatgtggaggccgtgaacacccaccgggacaagcccaccaacaacttccccaagaaccagacccctgtgaggatgagaagaaacagcttcacccccctgagcagcagcaacaccatcagaagacccaggaactacagcgtgggcagccggcccctgaagcccctgagccccctgcgggcccaggacatgcaggagggcgctgactag

SEQ ID NO: 142026 - DNA, 1122 bp, Artificial Sequence
  Description of Artificial Sequence: Synthetic coding sequence
atgaagatcaggaagcagtgtgccctggtggccctggaggatgtgaaggcctacctgacagaggagaatggccagattgctgtgtttgatgccaccaacaccacccgggagcggcgggacatgatcctgaactttgctgagcagaacagcttcaaggtgttctttgtggagagcgtgtgtgatgatcctgatgtgattgctgccaacatcctggaggtgaaggtgagcagcccagactacccagagaggaaccgggagaatgtgatggaggacttcctgaagagaattgagtgctacaaggtgacctaccggcccctggaccctgacaactatgacaaggacctgtccttcatcaaggtgatcaacgtgggccagcgcttcctggtgaacagagtgcaggactacatccagagcaagatcgtgtactacctgatgaacatccacgtgcagcccaggaccatctacctgtgcagacatggagagagcgagttcaacctgctgggcaagattggaggagacagcggcctgtctgtgcggggcaagcagtttgcccaggccctgaggaagttcctggaggagcaggagatcacagacctgaaggtgtggaccagccagctgaagaggaccatccagacagctgagagcctgggcgtgccctatgagcagtggaagatcctgaatgaaattgatgctggggtgtgtgaggagatgacctacgccgagattgagaagcgctacccagaggagtttgccctgcgggaccaggagaagtacctgtaccgctacccaggaggagagagctaccaggacctggtgcagaggctggagcctgtgatcatggagctggagcggcagggcaatgtgctggtgatcagccaccaggccgtgatgcgctgcctgctggcctacttcctggacaagggagcagatgagctgccctacctgcgctgccccctgcacaccatcttcaagctgacccctgtggcctacggctgcaaggtggagaccatcaagctgaatgtggaggccgtgaacacccaccgggacaagcccacagctgctgagaccaccctggccgtgagaagaagaccttctgctgccagcctgatgctgccctgctag

SEQ ID NO: 142027 - DNA, 795 bp, Artificial Sequence
  Description of Artificial Sequence: Synthetic coding sequence
atggaggacttcctgaagagaattgagtgctacaaggtgacctaccggcccctggaccctgacaactatgacaaggacctgtccttcatcaaggtgatcaacgtgggccagcgcttcctggtgaacagagtgcaggactacatccagagcaagatcgtgtactacctgatgaacatccacgtgcagcccaggaccatctacctgtgcagacatggagagagcgagttcaacctgctgggcaagattggaggagacagcggcctgtctgtgcggggcaagcagtttgcccaggccctgaggaagttcctggaggagcaggagatcacagacctgaaggtgtggaccagccagctgaagaggaccatccagacagctgagagcctgggcgtgccctatgagcagtggaagatcctgaatgaaattgatgctggggtgtgtgaggagatgacctacgccgagattgagaagcgctacccagaggagtttgccctgcgggaccaggagaagtacctgtaccgctacccaggaggagagagctaccaggacctggtgcagaggctggagcctgtgatcatggagctggagcggcagggcaatgtgctggtgatcagccaccaggccgtgatgcgctgcctgctggcctacttcctggacaagggagctggctgcaaggtggagaccatcaagctgaatgtggaggccgtgaacacccaccgggacaagcccacagctgctgagaccaccctggccgtgagaagaagacccagcgctgccagcctgatgctgccctgctag

SEQ ID NO: 142028 - DNA, 1419 bp, Artificial Sequence
  Description of Artificial Sequence: Synthetic coding sequence
atgaccaacagccccaccctcatcgtgatgattggcctgcctgcccggggcaagacctacgtgtccaagaagctgacccgctacctgaactggattggagtgcccaccaaggtgttcaacctgggcgtgtacagaagagaggccgtgaagagctacaagagctatgacttcttcagacatgacaatgaggaggccatgaagatcaggaagcagtgtgccctggtggccctggaggatgtgaaggcctacctgacagaagaaaatggccagattgctgtgtttgatgccaccaacaccacccgggagcggcgggacatgatcctgaactttgctgagcagaacagcttcaaggtgttctttgtggagagcgtgtgtgatgatcctgatgtgattgctgccaacatcctggaggtgaaggtgagcagcccagactacccagagaggaacagagaaaatgtgatggaggacttcctgaagagaattgagtgctacaaggtgacctaccggcccctggaccctgacaactatgacaaggacctgtccttcatcaaggtgatcaacgtgggccagcgcttcctggtgaacagagtgcaggactacatccagagcaagatcgtgtactacctgatgaacatccacgtgcagcccaggaccatctacctgtgccgccacggggagagcgagttcaacctgctgggcaagattggaggagacagcggcctgtctgtgcggggcaagcagtttgcccaggccctgaggaagttcctggaggagcaggagatcacagacctgaaggtgtggaccagccagctgaagaggaccatccagacagctgagagcctgggcgtgccctatgagcagtggaagatcctgaatgaaattgatgctggggtgtgtgaggagatgacctatgcagaaattgagaagcgctacccagaggagtttgccctgcgggaccaggagaagtacctgtaccgctacccaggaggagagagctaccaggacctggtgcagaggctggagcccgtcatcatggagctggagcggcagggcaatgtgctggtgatcagccaccaggccgtgatgcgctgcctgctggcctacttcctggacaagggagcagatgagctgccctacctgcgctgccccctgcacaccatcttcaagctgacccctgtggcctacggctgcaaggtggagaccatcaagctgaatgtggaggccgtgaacacccaccgggacaagcccaccaacaacttccccaagaaccagacccctgtgaggatgagaagaaattccttcacccccctgagcagcagcaacaccatccggcggcccaggaactacagcgtgggcagccggcccctgaagcccctgagccccctgcgggcccaggacatgcaggagggcgctgactag

SEQ ID NO: 142029 - DNA, 1542 bp, Artificial Sequence
  Description of Artificial Sequence: Synthetic coding sequence
atgcccctggagctgacccagagccgggtgcagaagatctgggtgcctgtggaccaccggcccagcctgcccaggagctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagcccctgctgggccaggcctgcctgtag

SEQ ID NO: 142030 - DNA, 1545 bp, Artificial Sequence
  Description of Artificial Sequence: Synthetic coding sequence
atgcccctggagctgacccagagccgggtgcagaagatctgggtgcctgtggaccaccggcccagcctgcccaggagctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagcccctgctgggccaggcctgcctgacctag

SEQ ID NO: 142031 - DNA, 1545 bp, Artificial Sequence; identical to SEQ ID NO: 142030
  Description of Artificial Sequence: Synthetic coding sequence

SEQ ID NO: 142032 - DNA, 1563 bp, Artificial Sequence
  Description of Artificial Sequence: Synthetic coding sequence
atgcccctggagctgacccagagccgggtgcagaagatctgggtgcctgtggaccaccggcccagcctgcccaggagctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagaacatgaagggcagccgcagcagcgctgacagcagcaggaagcactag

SEQ ID NO: 142033 - DNA, 354 bp, Artificial Sequence
  Description of Artificial Sequence: Synthetic coding sequence
atgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagcccctgctgggccaggcctgcctgaactggaagggcgtgatgagaaatgctgcctag

SEQ ID NO: 142034 - DNA, 1581 bp, Artificial Sequence
  Description of Artificial Sequence: Synthetic coding sequence
atgcccctggagctgacccagagccgggtgcagaagatctgggtgcctgtggaccaccggcccagcctgcccaggagctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagcccctgctgggccaggcctgcctgaggacagtgtgccacatcttcagcaagttcagcccctactag

SEQ ID NO: 142035 - DNA, 567 bp, Artificial Sequence
  Description of Artificial Sequence: Synthetic coding sequence
atgaacatccacgtgcagcccaggaccatctacctgtgcagacatggagaaaatgagcacaacctgcagggccgcatcggcggggacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgccagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggtctgagaacatgaagggcagccgcagcagcgctgacagcagcaggaagcactag

SEQ ID NO: 142036 - DNA, 1581 bp, Artificial Sequence; identical to SEQ ID NO: 142034
  Description of Artificial Sequence: Synthetic coding sequence

SEQ ID NO: 142037 - DNA, 1503 bp, Artificial Sequence
  Description of Artificial Sequence: Synthetic coding sequence
atgcccttcaggaaggcctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagaacatgaagggcagccgcagcagcgctgacagcagcaggaagcactag

SEQ ID NO: 142038 - DNA, 279 bp, Artificial Sequence
  Description of Artificial Sequence: Synthetic coding sequence
atctacctgaatgtggagagcgtgtgcacccaccgggagaggagtgaagatgccaagaagggccccaaccccctgatgagaagaaacagcgtgacccccctggccagccctgagcccaccaagaagccccgcatcaacagctttgaggagcacgtggccagcaccagcgctgccctgcccagctgcctgcccccagaggtgcccacccagctgcccggccagcccctgctgggccaggcctgcctgaactggaagggcgtgatgagaaatgctgcctag

SEQ ID NO: 142039 - DNA, 96 bp, Artificial Sequence
  Description of Artificial Sequence: Synthetic coding sequence
atctacctgaatgtggagagcgtgtgcacccaccgggagaggtctgagaacatgaagggcagccgcagcagcgctgacagcagcaggaagcactag

SEQ ID NO: 142040 - DNA, 261 bp, Artificial Sequence
  Description of Artificial Sequence: Synthetic coding sequence
atgccctacctgaagtgccccctgcacacagtgctgaagctgacccctgtggcctacggctgccgggtggagagcatctacctgaatgtggagagcgtgtgcacccaccgggagaggtctgagggcctgagcctcttcccccggctggagtgtggcggcgctgtgacagcccactgcagcctgaacctgctgggcagcagtgaccccccagccagcgccagccgggtggccgagaccaccggctgcaaggagggcacctag

SEQ ID NO: 142041 - DNA, 432 bp, Artificial Sequence
  Description of Artificial Sequence: Synthetic coding sequence
tgagtggaggagcagaacctgaaggacctgcgggtgtggaccagccagctgaagagcaccatccagacagctgaggccctgcggctgccctatgagcagtggaaggccctgaatgaaattgatgccagctaccaggacctggtgcagaggctggagcctgtgatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggtctgagaacatgaagggcagccgcagcagcgctgacagcagcaggaagcactag

SEQ ID NO: 142042 - DNA, 555 bp, Artificial Sequence
  Description of Artificial Sequence: Synthetic coding sequence
atgcccttcaggaaggcctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatgcagaaggccttccagagggacctgagcgccacccccctgtggtgctgcaggaagctgaagagccctgcccgcatcaccaagacagccacccggcagaagccctggaccaccagctag

SEQ ID NO: 142043 - DNA, 1605 bp, Artificial Sequence
  Description of Artificial Sequence: Synthetic coding sequence
atgggagagggcggccagaaggagggggacagccagcaggccggggccctgcccctgctgtgccagctggacaccttcagccccaaggccaccgtgtttggagtgtccatcaacccagcctgtggccccaagctgaccaacagccccaccgtcatcgtgatggtgggcctgcctgcccggggcaagacctacatcagcaagaagctgacccgctacctgaactggattggagtgcccaccaaggtgttcaacgtgggggagtacagaagagaggccgtgaagcagtacagcagctacaacttcttccggccagacaatgaggaggccatgaaggtgaggaagcagtgtgccctggccgccctgagagatgtgaagagctacctggccaaggagggcggccagattgctgtgtttgatgccaccaacaccacccgggagaggaggcacatgatcctgcactttgccaaggaaaatgacttcaaggccttcttcattgaatctgtgtgtgatgaccccaccgtggtggccagcaacatcatggaggtgaagatcagcagcccagactacaaggactgcaacagcgctgaggccatggatgacttcatgaagaggatcagctgctatgaggccagctaccagcccctggaccctgacaagtgtgaccgggacctgagcctcatcaaggtgattgatgtgggccgccgcttcctggtgaacagagtgcaggaccacatccagagcagaattgtgtactacctgatgaacatccacgtgcagcccaggaccatctacctgtgccgccacggggagaatgagcacaacctgcagggcagaattggaggagacagcggcctgagcagccggggcaagaagtttgccagcgccctgagcaagtttgtggaggagcagaacctgaaggacctgcgggtgtggaccagccagctgaagagcaccatccagacagctgaggccctgcggctgccctatgagcagtggaaggccctgaatgaaattgatgctggggtgtgtgaggagctgacctatgaggagatccgggacacctacccagaggagtatgccctgcgggagcaggacaagtactactaccgctaccccactggagagagctaccaggacctggtgcagaggctggagcccgtcatcatggagctggagcggcaggagaatgtgctggtgatctgccaccaggccgtgctgcgctgcctgctggcctacttcctggacaagtctgctgaggagatgccctacctgaagtgccccctgcacacagtgctgaagctgacccctgtggcctacggctgccgggtggagagcatctacctgaatgtggagagcgtgtgcacccaccgggagaggagtgaagatgccaagaagggccccaaccccctgatgagaagaaattctgtgacccccctggccagccctgagcccaccaagaagccccgcatcaacagctttgaggagcacgtggccagcaccagcgctgccctgcccagctgcctgcccccagaggtgcccacccagctgcccggccagaacatgaagggcagccgcagcagcgctgacagcagcaggaagcactag

SEQ ID NO: 142044 - DNA, 594 bp, Artificial Sequence
  Description of Artificial Sequence: Synthetic coding sequence
atggaccccccagctggctttgtgcgggccggcaacccagctgtggccgccccccagagccccctgagccctgagggcgcccacttccgggccgcccaccaccccaggagcacaggcagccgctgccccggcagcctgcagcccagccggcccctggtggccaactggctgcagagcctgcctgagatgcctgtggacttcaccggctactggaagatgctggtgaatgaaaattttgaggagtacctgcgggccctggatgtgaatgtggccctgaggaagatcgccaacctgctgaagccagacaaggagatcgtgcaggatggagaccacatgatcatccgcaccctgagcaccttcaggaactacatcatggacttccaggtgggcaaggagtttgaggaggacctgaccggcattgatgacaggaagtgcatgaccaccgtgtcctgggatggagacaagctgcagtgtgtgcagaagggggagaaggagggccggggctggacccagtggattgaaggagatgagctgcacctggagatgagggtggagggcgtggtgtgcaagcaggtgttcaagaaggtgcagtag

SEQ ID NO: 142045 - DNA, 528 bp, Artificial Sequence
  Description of Artificial Sequence: Synthetic coding sequence
atgaccaactgccccaccctcatcgtgatggtgggcctgcctgcccggggcaagacctacatcagcaagaagctgacccgctacctgaactggattggagtgcccacccgggagttcaacgtgggccagtacagaagagatgtggtgaagacctacaagagctttgagttcttcctgcctgacaatgaggagggcctgaagatcaggaagcagtgtgccctggccgccctgagagatgtgcggcgcttcctgtctgaggagggcggccacgtggccgtgtttgatgccaccaacaccacccgggagcggcgggccaccatcttcaactttggagagcagaatggctacaagaccttctttgtggagagcatctgtgtggaccctgaggtgattgctgccaacatcgtgcaggtgaagctgggcagcccagactatgtgaacagagacagtgatgaggccacagaggacttcatgagaagaattgagtgctatgaaaattcctatgagagcctggatgaggacctgtag

SEQ ID NO: 142046 - DNA, 1377 bp, Artificial Sequence
  Description of Artificial Sequence: Synthetic coding sequence
atggaccggggcagcctgggcggcagcagcctgacagacctgggccctggcagcagccggcgggtgtgcatgaccaactgccccaccctgattgtgatggtgggcctgcctgcccggggcaagacctacatcagcaagaagctgacccgctacctgaactggattggagtgcccacccgggagttcaacgtgggccagtacagaagagatgtggtgaagacctacaagagctttgagttcttcctgcctgacaatgaggagggcctgaagatcaggaagcagtgtgccctggccgccctgagagatgtgcggcgcttcctgtctgaggagggcggccacgtggccgtgtttgatgccaccaacaccacccgggagcggcgggccaccatcttcaactttggagagcagaatggctacaagaccttctttgtggagagcatctgtgtggaccctgaggtgattgctgccaacatcgtgcaggtgaagctgggcagcccagactatgtgaacagagacagtgatgaggccacagaggacttcatgagaagaattgaatgttatgagaacagctatgagagcctggatgaggacctggaccgggacctgagctacatcaagatcatggatgtgggccagagctatgtggtgaacagagtggccgaccacatccagagcagaattgtgtactacctgatgaacatccacgtgacccccaggagcatctacctgtgccgccacggggagagcgagctgaacctgaagggcagaattggaggagaccccggcctgagcccccggggccgggagtttgccaagagcctggcccagttcatcagtgaccagaacatcaaggacctgaaggtgtggaccagccagatgaagaggaccatccagacagctgaggccctgggcgtgccctatgagcagtggaaggtgctgaatgaaattgatgctggggtgtgtgaggagatgacctatgaggagatccaggacaactaccccctggagtttgccctgcgggaccaggacaagtaccgctaccgctaccccaagggggagagctatgaggacctggtgcagaggctggagcccgtcatcatggagctggagcggcaggagaatgtgctggtgatctgccaccaggccgtgatgcgctgcctgctggcctacttcctggacaaggctgctgagcagctgccctacctgaagtgccccctgcacacagtgctgaagctgacccctgtggcctacggctgcaaggtggagagcatcttcctgaatgtggccgctgtgaacacccaccgggaccggccccagaatgtggacatcagccggcccccagaggaggccctggtgacagtgcctgcccaccagtag

SEQ ID NO: 142047 - DNA, 1308 bp, Artificial Sequence
  Description of Artificial Sequence: Synthetic coding sequence
atgaccaactgccccaccctcatcgtgatggtgggcctgcctgcccggggcaagacctacatcagcaagaagctgacccgctacctgaactggattggagtgcccacccgggagttcaacgtgggccagtacagaagagatgtggtgaagacctacaagagctttgagttcttcctgcctgacaatgaggagggcctgaagatcaggaagcagtgtgccctggccgccctgagagatgtgcggcgcttcctgtctgaggagggcggccacgtggccgtgtttgatgccaccaacaccacccgggagcggcgggccaccatcttcaactttggagagcagaatggctacaagaccttctttgtggagagcatctgtgtggaccctgaggtgattgctgccaacatcgtgcaggtgaagctgggcagcccagactatgtgaacagagacagtgatgaggccacagaggacttcatgagaagaattgagtgctatgaaaattcctatgagagcctggatgaggacctggaccgggacctgagctacatcaagatcatggatgtgggccagagctatgtggtgaacagagtggccgaccacatccagagccgcatcgtgtactacctgatgaacatccacgtgacccccaggagcatctacctgtgcagacatggagagagcgagctgaacctgaagggccgcatcggcggggaccccggcctgagcccccggggccgggagtttgccaagagcctggcccagttcatcagtgaccagaacatcaaggacctgaaggtgtggaccagccagatgaagaggaccatccagacagctgaggccctgggcgtgccctatgagcagtggaaggtgctgaatgaaattgatgctggggtgtgtgaggagatgacctatgaggagatccaggacaactaccccctggagtttgccctgcgggaccaggacaagtaccgctaccgctaccccaagggggagagctatgaggacctggtgcagaggctggagcctgtgatcatggagctggagcggcaggagaatgtgctggtgatctgccaccaggccgtgatgcgctgcctgctggcctacttcctggacaaggctgctgagcagctgccctacctgaagtgccccctgcacacagtgctgaagctgacccctgtggcctacggctgcaaggtggagagcatcttcctgaatgtggccgctgtgaacacccaccgggaccggccccagaatgtggacatcagcaggcctcctgaggaggccctggtgacagtgcctgcccaccagtag

SEQ ID NO: 142048 - DNA, 429 bp, Artificial Sequence
  Description of Artificial Sequence: Synthetic coding sequence
atggccagcccccgggagctgacccagaaccccctgaagaagatctggatgccctacagcaatggccggcctgccctgcacgcctgccagaggggcgtgtgcatgaccaactgccccaccctcatcgtgatggtgggcctgcctgcccggggcaagacctacatcagcaagaagctgacccgctacctgaactggattggagtgcccacccgggagttcaacgtgggccagtacagaagagatgtggtgaagacctacaagagctttgagttcttcctgcctgacaatgaggagggcctgaagatcaggaagttcctgatgccccagaccccaccagaaaatggagagcggcccagcctcatcctggagaacaggatggccacccggcccttcctgagcagccccagcgtgtggatcctgcggagctag

SEQ ID NO: 142049 - DNA, 777 bp, Artificial Sequence
  Description of Artificial Sequence: Synthetic coding sequence
atggccgccccagcccctggcctcatcagcgtcttcagcagcagccaggagctgggcgccgccctggcccagctggtggcccagagagctgcctgctgcctggccggggcccgggccaggtttgccctgggcctgagcggcggcagcctggtgtccatgctggcccgggagctgcctgctgctgtggccccagctggccctgccagcctggcccgctggaccctgggcttctgtgatgagcggctggtgccctttgaccacgccgagagcacctacggcctgtaccgcacccacctgctgagccggctgcccatccctgagagccaggtgatcaccatcaaccctgagctgcctgtggaggaggccgctgaggactatgccaagaagctgcggcaggccttccagggcgacagcatccctgtgtttgacctgctgatcctgggcgtgggcccagatggccacacctgcagcctcttcccagaccaccccctgctgcaggagcgggagaagatcgtggcccccatcagtgacagccccaagcccccaccccagagggtgaccctgaccctgcctgtgctgaatgctgccaggacagtcatctttgtggccaccggggagggcaaggctgctgtgctgaagaggatcctggaggaccaggaggagaaccccctgcctgctgccctggtgcagccccacacaggcaagctgtgctggttcctggatgaagctgctgcccggctgctgactgtgccctttgagaagcacagcaccctgtag

SEQ ID NO: 142050 - DNA, 1428 bp, Artificial Sequence
  Description of Artificial Sequence: Synthetic coding sequence
atggccgccaagagccagcccaacatccccaaggccaagagcctggatggagtgaccaatgacagaacagccagccagggccagtggggccgggcctgggaggtggactggttcagcctggccagcgtcatcttcctgctgctgtttgcccccttcatcgtgtactacttcatcatggcctgtgaccagtacagctgtgccctgactggacctgtggtggacatcgtgactggacatgcccggctgagtgacatctgggccaagaccccacccatcaccaggaaggccgcccagctgtacaccctgtgggtgaccttccaggtgctgctgtacaccagcctgcctgacttctgccacaagttcctgcccggctacgtgggcggcatccaggagggcgctgtgaccccagctggggtggtgaacaagtaccagatcaatggcctgcaggcctggctgctgacccacctgctgtggtttgccaatgcccacctgctgtcctggttcagccccaccatcatctttgacaactggatccccctgctgtggtgtgccaacatcctgggctatgctgtgtccacctttgccatggtgaagggctacttcttccccaccagcgcccgggactgcaagttcaccggcaacttcttctacaactacatgatgggcatcgagttcaaccccagaattggcaagtggtttgacttcaagctgttcttcaacggccggcccggcatcgtggcctggaccctcatcaacctgagctttgctgccaagcagcgggagctgcacagccacgtgaccaatgccatggtgctggtgaatgtgctgcaggccatctacgtgattgacttcttctggaatgagacctggtacctgaagaccatcgacatctgccacgaccacttcggctggtacctgggctggggagactgtgtgtggctgccctacctgtacaccctgcagggcctgtacctggtgtaccaccctgtgcagctgagcacccctcatgctgtgggcgtgctgctgctgggcctggtgggctactacatcttccgggtggccaaccaccagaaggacctcttccggaggacagatggccgctgcctgatctggggcaggaagcccaaggtgattgaatgttcctacaccagcgcagatggccagaggcaccacagcaagctgctggtgtctggcttctggggcgtggcccggcacttcaactacgtgggggacctgatgggcagcctggcctactgcctggcctgtggcggcggccacctgctgccctacttctacatcatctacatggccatcctgctgacccaccgctgcctgagagatgagcaccgctgtgccagcaaatatggccgggactgggagcgctacacagctgctgtgccctaccgcctgctgcccggcatcttctag

SEQ ID NO: 142051 - DNA, 1428 bp, Artificial Sequence; identical to SEQ ID NO: 142050
  Description of Artificial Sequence: Synthetic coding sequence

SEQ ID NO: 142052 - DNA, 327 bp, Artificial Sequence
  Description of Artificial Sequence: Synthetic coding sequence
atggccgccaagagccagcccaacatccccaaggccaagagcctggatggagtgaccaatgacagaacagccagccagggccagtggggccgggcctgggaggtggactggttcagcctggccagcgtcatcttcctgctgctgtttgcccccttcatcgtgtactacttcatcatggcctgtgaccagtacagctgtgccctgactggacctgtggtggacatcgtgactggacatgcccggctgagtgacatctgggccaagaccccacccatcaccaggaaggccgcccagctgtacaccctgtgggtgaccttccaggtgtag

SEQ ID NO: 142053 - DNA, 495 bp, Artificial Sequence
  Description of Artificial Sequence: Synthetic coding sequence
atggccgccaagagccagcccaacatccccaaggccaagagcctggatggagtgaccaatgacagaacagccagccagggccagtggggccgggcctgggaggtggactggttcagcctggccagcgtcatcttcctgctgctgtttgcccccttcatcgtgtactacttcatcatggcctgtgaccagtacagctgtgccctgactggacctgtggtggacatcgtgactggacatgcccggctgagtgacatctgggccaagaccccacccatcaccaggaaggccgcccagctgtacaccctgtgggtgaccttccaggtgctgctgtacaccagcctgcctgacttctgccacaagttcctgcccggctacgtgggcggcatccaggagggcgctgtgaccccagctggggtggtgaacaagtaccagatcaatggcctgcaggcctggctgctgacccacctgctgtggtttgccaatgcccacctgtag

SEQ ID NO: 142054 - DNA, 276 bp, Artificial Sequence
  Description of Artificial Sequence: Synthetic coding sequence
atggccgccaagagccagcccaacatccccaaggccaagagcctggatggagtgaccaatgacagaacagccagccagggccagtggggccgggcctgggaggtggactggttcagcctggccagcgtcatcttcctgctgctgtttgcccccttcatcgtgtactacttcatcatggcctgtgaccagtacagctgtgccctgactggacctgtggtggacatcgtgactggacatgcccggctgagtgacatctgggccaagaccccaccctag

SEQ ID NO: 142055 - DNA, 318 bp, Artificial Sequence
  Description of Artificial Sequence: Synthetic coding sequence
atggccgccaagagccagcccaacatccccaaggccaagagcctggatggagtgaccaatgacagaacagccagccagggccagtggggccgggcctgggaggtggactggttcagcctggccagcgtcatcttcctgctgctgtttgcccccttcatcgtgtactacttcatcatggcctgtgaccagtacagctgtgccctgactggacctgtggtggacatcgtgactggacatgcccggctgagtgacatctgggccaagaccccacccatcaccaggaaggccgcccagctgtacaccctgtgggtgacctag

SEQ ID NO: 142056 - DNA, 846 bp, Artificial Sequence
  Description of Artificial Sequence: Synthetic coding sequence
atggacagctacagcacctacctggccaccgtgaaggtgtctggctcctggctggaggagcaggatgaggacatctatgaggtggagagccgggtgcccctgccccaccccttccccctgtgtgagcacctggatgagaacaacagcgtgattgtgaacaccagcatcttccacttcatccacaagagaaatggccacatcctgaagctgatcagcaagatcagcctgcccaccccaccctacagcctggagcacgccaaggtgacccagacagagctgatgagggagagcttccggcagaagcaggaggccacagagagcctgaagtgccaggaggagctgcgggagcggctgcacgaggagagccgggcccgggagcagctggccgtggagctgagcaaggccgagggcgtgattgatggctatgcagatgagaagaccctgtttgagcggcagatccaggagaagacagacatcatcgaccggctggagcaggagctgctgtgtgccagcaaccggctgcaggagctggaggccgagcagcagcagatccaggaggagcgggagctgctgagccggcagaaggaggccatgaaggccgaggccggccctgtggagcagcagctgctgcaggagacagagaagctgatgaaggagaagctggaggtgcagtgccaggccgagaaggtgagagatgacctgcagaagcaggtgaaggccctggagattgatgtggaggagcaggtgagccgcttcatcgagctggagcaggagaagaacacagagctgatggacctgcggcagcagaaccaggccctggagaagcagctggagaagatgaggtag

SEQ ID NO: 142057 - DNA, 11724 bp, Artificial Sequence
  Description of Artificial Sequence: Synthetic coding sequence
atggaggatgaggagcggcagaagaagctggaggccggcaaggccaagctggcccagttccggcagaggaaggcccagagtgatggccagagccccagcaagaagcagaagaagaagaggaagaccagcagcagcaagcatgatgtgtctgcccaccacgacctgaacatcgaccagagccagtgcaatgagatgtacatcaacagcagccagagggtggagagcaccgtcatccctgagagcaccatcatgaggaccctgcacagcggggagatcaccagccatgagcagggcttctctgtggagctggagagcgagatcagcaccacagcagatgactgcagcagcgaggtgaatggctgcagctttgtgatgaggacaggcaagcccaccaacctgctgcgggaggaggagtttggagtggatgacagctacagcgagcagggcgcccaggacagccccacccacctggagatgatggagagcgagctggccggcaagcagcatgaaattgaggagctgaaccgggagctggaggagatgagggtgacctatggaacagagggcctgcagcagctgcaggagtttgaggccgccatcaagcagagagatggcatcatcacccagctgacagccaacctgcagcaggcccggcgggagaaggatgagaccatgagggagttcctggagctgacagagcagagccagaagctgcagatccagttccagcagctgcaggccagcgagaccctgaggaacagcacccacagcagcacagctgctgacctgctgcaggccaagcagcagatcctgacccaccagcagcagctggaggagcaggaccacctgctggaggactaccagaagaagaaggaggacttcaccatgcagatctccttcctgcaggagaagatcaaggtgtatgagatggagcaggacaagaaggtggagaacagcaacaaggaggagatccaggagaaggagaccatcatcgaggagctgaacaccaagatcatcgaggaggagaagaagaccctggagctgaaggacaagctgaccacagctgacaagctgctgggggagctgcaggagcagatcgtgcagaagaaccaggagatcaagaacatgaagctggagctgaccaacagcaagcagaaggagcggcagagcagcgaggagatcaagcagctgatgggcaccgtggaggagctgcagaagaggaaccacaaggacagccagtttgaaacagacatcgtgcagaggatggagcaggagacccagaggaagctggagcagctgcgggcagagctggatgagatgtatggccagcagatcgtgcagatgaagcaggagctgatccggcagcacatggcccagatggaggagatgaagaccaggcacaagggggagatggagaatgccctgcggagctacagcaacatcaccgtgaatgaagaccagatcaagctgatgaatgtggccatcaatgagctgaacatcaagctgcaggacaccaacagccagaaggagaagctgaaggaggagctgggcctcatcctggaggagaagtgtgccctgcagaggcagctggaggacctggtggaggagctgtccttcagccgggagcagatccagagggcccggcagaccatcgccgagcaggagagcaagctgaatgaggcccacaagagcctgagcacagtggaggacctgaaggccgagatcgtgtctgccagcgagagcaggaaggagctggagctgaagcatgaagctgaggtgaccaactacaagatcaagctggagatgctggagaaggagaagaatgctgtgctggacaggatggccgagagccaggaggccgagctggagcggctgcggacccagctgctcttcagccatgaggaggagctgagcaagctgaaggaggacctggagattgagcaccgcatcaacatcgagaagctgaaggacaacctgggcatccactacaagcagcagattgatggcctgcagaatgagatgagccagaagattgagaccatgcagtttgagaaggacaacctgatcaccaagcagaaccagctgatcctggagatcagcaagctgaaggacctgcagcagagcctggtgaacagcaagtctgaggagatgaccctgcagatcaatgagctgcagaaggagattgagatcctgcggcaggaggagaaggagaagggcaccctggagcaggaggtgcaggagctgcagctgaagacagagctgctggagaagcagatgaaggagaaggaaaatgacctgcaggagaagtttgcccagctggaggccgagaacagcatcctgaaggatgagaagaagaccctggaggacatgctgaagatccacacccctgtgtcccaggaggagcggctcatcttcctggacagcatcaagagcaagagcaaggacagcgtgtgggagaaggagattgagatcctgattgaggagaatgaagacctgaagcagcagtgcatccagctgaatgaggagattgagaagcagaggaacaccttctcctttgctgagaagaactttgaggtgaactaccaggagctgcaggaggagtatgcctgcctgctgaaggtgaaggatgacctggaggacagcaagaacaagcaggagctggagtacaagagcaagctgaaggccctgaatgaggagctgcacctgcagaggatcaaccccaccaccgtgaagatgaagagctctgtgtttgatgaggacaagacctttgtggccgagaccctggagatgggagaggtggtggagaaggacaccacagagctgatggagaagctggaggtgaccaagcgggagaagctggagctgagccagaggctgagtgacctgtctgagcagctgaagcagaagcacggggagatctccttcctgaatgaggaggtgaagagcctgaagcaggagaaggagcaggtgtccctgcgctgccgggagctggagatcatcatcaaccacaacagagcagaaaatgtgcagagctgtgacacccaggtgagcagcctgctggatggagtggtgaccatgaccagcagaggagctgagggctctgtgtccaaggtgaacaagagctttggagaggagagcaagatcatggtggaggacaaggtgtcctttgagaacatgacagtgggggaggagagcaagcaggagcagctgatcctggaccacctgcccagcgtgaccaaggagagcagcctgcgggccacccagcccagtgaaaatgacaagctgcagaaggagctgaatgtgctgaagtctgagcagaatgacctgcggctgcagatggaggcccagaggatctgcctgagcctggtgtacagcacccacgtggaccaggtgcgggagtacatggagaatgagaaggacaaggccctgtgcagcctgaaggaggagctgatctttgcccaggaggagaagatcaaggagctgcagaagatccaccagctggagctgcagaccatgaagacccaggagactggagatgagggcaagcccctgcacctgctgattggcaagctgcagaaggctgtgtctgaggagtgcagctacttcctgcagaccctgtgcagcgtgctgggggagtactacaccccagccctgaagtgtgaggtgaatgctgaggacaaggagaacagcggggactacatcagtgaaaatgaagatcctgagctgcaggactaccgctatgaggtgcaggacttccaggagaacatgcacaccctgctgaacaaggtgacagaggagtacaacaagctgctggtgctgcagacccggctgagcaagatctggggccagcagacagatggcatgaagctggagtttggagaggagaacctgcccaaggaggagacagagttcctgagcatccacagccagatgaccaacctggaggacattgatgtgaaccacaagagcaagctgagcagcctgcaggacctggagaagaccaagctggaggagcaggtgcaggagctggagagcctcatcagcagcctgcagcagcagctgaaggagacagagcagaactatgaagctgagatccactgcctgcagaagaggctgcaggccgtgtctgagagcacagtgccccccagcctgcctgtggacagcgtggtgatcacagaaagtgatgcccagaggaccatgtacccaggcagctgtgtgaagaagaacattgatggcaccatcgagttctctggagaatttggagtgaaggaggagaccaacatcgtgaagctgctggagaagcagtaccaggagcagctggaggaggaggtggccaaggtgattgtgtccatgagcatcgcctttgcccagcagacagagctgagccgcatcagcggcggcaaggaaaatacagccagcagcaagcaggcccatgctgtgtgccagcaggagcagcactacttcaatgagatgaagctgagccaggaccagatcggcttccagacctttgaaacagtggatgtgaagttcaaggaggagttcaagcccctgagcaaggagctgggggagcacggcaaggagatcctgctgagcaacagcgacccccatgacatccctgagagcaaggactgtgtgctgaccatcagcgaggagatgttcagcaaggacaagaccttcatcgtgcggcagagcatccatgatgagatctctgtgtcctccatggatgccagccggcagctgatgctgaatgaggagcagctggaggacatgaggcaggagctggtgcggcagtaccaggagcaccagcaggccacagagctgctgcggcaggcccacatgaggcagatggagcggcagcgggaggaccaggagcagctgcaggaggagatcaagaggctgaaccggcagctggcccagaggagcagcattgacaatgaaaacctggtgtctgagcgggagcgggtgctgctggaggagctggaggccctgaagcagctgagcctggccggccgggagaagctgtgctgtgagctgaggaacagcagcacccagacccagaatggaaatgaaaaccagggcgaggtggaggagcagaccttcaaggagaaggagctggacaggaagccagaagatgtgcccccagagatcctgagcaatgaaagatatgccctgcagaaggccaacaaccggctgctgaagatcctgctggaggtggtgaagaccacagctgctgtggaggagaccatcggccgccacgtgctgggcatcctggacaggagcagcaagagccagagcagcgccagcctcatctggaggtctgaggccgaggcctctgtgaagagctgtgtgcatgaggagcacaccagggtgacagatgagagcatccccagctacagcggcagtgacatgcccagaaatgacatcaacatgtggagcaaggtgacagaggagggcacagagctgagccagaggctggtgcgcagcggctttgctggaacagaaattgatcctgaaaatgaggagctgatgctgaacatcagcagccggctgcaggccgctgtggagaagctgctggaggccatcagcgagaccagcagccagctggagcacgccaaggtgacccagacagagctgatgagggagagcttccggcagaagcaggaggccacagagagcctgaagtgccaggaggagctgcgggagcggctgcacgaggagagccgggcccgggagcagctggccgtggagctgagcaaggccgagggcgtgattgatggctatgcagatgagaagaccctgtttgagcggcagatccaggagaagacagacatcatcgaccggctggagcaggagctgctgtgtgccagcaaccggctgcaggagctggaggccgagcagcagcagatccaggaggagcgggagctgctgagccggcagaaggaggccatgaaggccgaggccggccctgtggagcagcagctgctgcaggagacagagaagctgatgaaggagaagctggaggtgcagtgccaggccgagaaggtgagagatgacctgcagaagcaggtgaaggccctggagattgatgtggaggagcaggtgagccgcttcatcgagctggagcaggagaagaacacagagctgatggacctgcggcagcagaaccaggccctggagaagcagctggagaagatgaggaagttcctggatgagcaggccatcgaccgggagcacgagagagatgtgttccagcaggagatccagaagctggagcagcagctgaaggtggtgccccgcttccagcccatcagcgagcaccagacccgggaggtggagcagctggccaaccacctgaaggagaagacagacaagtgcagcgagctgctgctgagcaaggagcagctgcagagggacatccaggagagaaatgaggagattgagaagctggagttccgggtgcgggagctggagcaggccctgctggtgtctgctgacaccttccagaaggtggaggacaggaagcactttggagctgtggaggccaagccagagctgagcctggaggtgcagctgcaggccgagagagatgccatcgacaggaaggagaaggagatcaccaacctggaggagcagctggagcagttccgggaggagctggagaacaagaatgaggaggtgcagcagctgcacatgcagctggagatccagaagaaggagagcaccacccggctgcaggagctggagcaggagaacaagctgttcaaggatgacatggagaagctgggcctggccatcaaggagagtgatgccatgagcacccaggaccagcacgtgctgtttgggaagtttgcccagatcatccaggagaaggaggtggagattgaccagctgaatgagcaggtgaccaagctgcagcagcagctgaagatcaccacagacaacaaggtgattgaggagaagaatgaactcatccgggacctggagacccagatcgagtgcctgatgtctgaccaggagtgtgtgaagaggaaccgggaggaggagattgagcagctgaatgaagtcatcgagaagctgcagcaggagctggccaacatcggccagaagacctccatgaatgcccacagcctgtctgaggaggccgacagcctgaagcaccagctggatgtggtgattgctgagaagctggccctggagcagcaggtggagacagccaatgaggagatgaccttcatgaagaatgtgctgaaggagaccaacttcaagatgaaccagctgacccaggagctgttcagcctgaagcgggagcgggagagcgtggagaagatccagagcatccctgagaacagcgtgaatgtggccatcgaccacctgagcaaggacaagccagagctggaggtggtgctgacagaagatgccctgaagagcctggagaaccagacctacttcaagagctttgaggagaatggcaagggcagcatcatcaacctggagacccggctgctgcagctggagagcacagtgtctgccaaggacctggagctgacccagtgctacaagcagatcaaggacatgcaggagcagggccagtttgaaacagagatgctgcagaagaagatcgtgaacctgcagaagatcgtggaggagaaggtggccgccgccctggtgtcccagatccagctggaggccgtgcaggagtatgccaagttctgccaggacaaccagaccatcagcagcgagcctgagaggaccaacatccagaacctgaaccagctgcgggaggatgagctgggcagtgacatcagcgccctgaccctgcgcatcagcgagctggagagccaggtggtggagatgcacaccagcctcatcctggagaaggagcaggtggagattgctgagaagaatgtgctggagaaggagaagaagctgctggagctgcagaagctgctggagggcaatgagaagaagcagcgggagaaggagaagaagaggagcccccaggatgtggaggtgctgaagaccaccacagagctgttccacagcaatgaggagagcggcttcttcaatgagctggaggccctgcgggcagagagcgtggccaccaaggccgagctggccagctacaaggagaaggccgagaagctgcaggaggagctgctggtgaaggagaccaacatgaccagcctgcagaaggacctgagccaggtgcgggaccacctggccgaggccaaggagaagctgagcatcctggagaaggaggatgaaacagaggtgcaggagagcaagaaggcctgcatgtttgagcccctgcccatcaagctgagcaagagcatcgccagccagacagatggcaccctgaagatcagcagcagcaaccagaccccccagatcctggtgaagaatgccggcatccagatcaacctgcagagtgaatgtagcagcgaggaggtgacagagatcatcagccagttcacagagaagattgagaagatgcaggagctgcacgccgctgagatcctggacatggagagccgccacatcagcgagacagagaccctgaagcgggagcactacgtggccgtgcagctgctgaaggaggagtgtggcaccctgaaggctgtgatccagtgcctgcggagcaaggagggcagcagcatccctgagctggcccacagtgatgcctaccagacccgggagatctgcagcagtgacagcggcagtgactggggccagggcatctacctgacccacagccagggctttgatattgccagcgagggccgcggggaggagagcgagagcgccacagacagcttccccaagaagatcaagggcctgctgcgggctgtgcacaatgaaggcatgcaggtgctgagcctgacagagagcccctacagtgatggagaggaccacagcatccagcaggtgtctgagccctggctggaggagaggaaggcctacatcaacaccatcagcagcctgaaggacctgatcaccaagatgcagctgcagcgggaggccgaggtgtatgacagcagccagagccatgagagcttcagtgactggagaggagagctgctgctggccctgcagcaggtgttcctggaggagaggtctgtgctgctggccgccttcagaacagagctgacagccctgggcaccacagatgctgtgggcctgctgaactgcctggagcagaggatccaggagcagggcgtggagtaccaggccgccatggagtgcctgcagaaggctgacagaagaagcctgctgtctgagatccaggccctgcacgcccagatgaatggaaggaagatcaccctgaagcgggagcaggagagcgagaagcccagccaggagctgctggagtacaacatccagcagaagcagagccagatgctggagatgcaggtggagctgagctccatgaaggaccgggccacagagctgcaggagcagctgagcagcgagaagatggtggtggccgagctgaagtctgagctggcccagaccaagctggagctggagaccaccctgaaggcccagcacaagcacctgaaggagctggaggccttccggctggaggtgaaggacaagacagatgaggtgcacctgctgaatgacaccctggccagcgagcagaagaagagccgggagctgcagtgggccctggagaaggagaaggccaagctgggccgctctgaggagcgggacaaggaggagctggaggacctgaagttcagcctggagagccagaagcagaggaacctgcagctgaacctgctgctggagcagcagaagcagctgctgaatgaaagccagcagaagattgagagccagaggatgctgtatgatgcccagctgtctgaggagcagggcaggaacctggagctgcaggtgctgctggagagcgagaaggtgcgcatccgggagatgagcagcaccctggaccgggagcgggagctgcacgcccagctgcagagcagtgatggcaccggccagagcaggcctcccctgcccagcgaggacctgctgaaggagctgcagaagcagctggaggagaagcacagcagaattgtggagctgctgaatgaaacagagaagtacaagctggacagcctgcagacccggcagcagatggagaaggaccggcaggtgcacaggaagaccctgcagacagagcaggaggccaacacagagggccagaagaagatgcatgagctgcagagcaaggtggaggacctgcagaggcagctggaggagaagaggcagcaggtgtacaagctggacctggagggccagaggctgcagggcatcatgcaggagttccagaagcaggagctggagcgggaggagaagcgggagagccgccgcatcctgtaccagaacctgaatgagcccaccacctggagcctgaccagtgacaggaccaggaactgggtgctgcagcagaagattgaaggagagaccaaggagagcaactatgccaagctgattgagatgaatggaggcggcaccggctgcaaccacgagctggagatgatccggcagaagctgcagtgtgtggccagcaagctgcaggtgctgccccagaaggccagcgagcggctgcagtttgaaacagcagatgatgaggacttcatctgggtgcaggagaacattgatgagatcatcctgcagctgcagaagctgaccggccagcagggcgaggagcccagcctggtgagccccagcaccagctgtggcagcctgacagagcggctgctgcggcagaatgctgagctgaccggccacatcagccagctgacagaggagaagaatgacctgaggaacatggtgatgaagctggaggagcagatccgctggtaccggcagacaggagctggccgggacaacagcagccgcttcagcctgaatggaggagccaacatcgaggccatcatcgccagcgagaaggaggtgtggaaccgggagaagctgaccctgcagaagagcctgaagagagctgaggccgaggtgtacaagctgaaggccgagctgagaaatgacagcctgctgcagaccctgagcccagattctgaacatgtgaccctgaagaggatctacggcaagtacctgcgggcagagagcttcaggaaggccctgatctaccagaagaagtacctgctgctgctgctgggcggcttccaggagtgtgaagatgccaccctggccctgctggccaggatgggcggccagcctgccttcacagacctggaggtgatcaccaaccggcccaagggcttcacccgcttccgctctgctgtgcgggtgtccatcgccatcagcaggatgaagttcctggtgcggcgctggcaccgggtgactggatctgtgtccatcaacatcaacagagatggcttcggcctgaaccagggcgctgagaagacagacagcttctaccacagcagcggcggcctggagctgtatggagagcccaggcacaccacctaccgcagcagaagtgacctggactacatccgcagccccctgcccttccagaaccgctacccaggcaccccagctgacttcaaccctggcagcctggcctgcagccagctgcagaactatgaccctgaccgggccctgacagactacatcacccggctggaggccctgcagaggcggctgggcaccatccagagcggcagcaccacccagttccacgccggcatgagaagatag

SEQ ID NO: 142058 - DNA, 11574 bp, Artificial Sequence
  Description of Artificial Sequence: Synthetic coding sequence
atggaggatgaggagcggcagaagaagctggaggccggcaaggccaagattgaggagctgagcctggccttcctggtgcggcagctggcccagttccggcagaggaaggcccagagtgatggccagagccccagcaagaagcagaagaagaagaggaagaccagcagcagcaagcatgatgtgtctgcccaccacgacctgaacatcgaccagagccagtgcaatgagatgtacatcaacagcagccagagggtggagagcaccgtcatccctgagagcaccatcatgaggaccctgcacagcggggagatcaccagccatgagcagggcttctctgtggagctggagagcgagatcagcaccacagcagatgactgcagcagcgaggtgaatggctgcagctttgtgatgaggacaggcaagcccaccaacctgctgcgggaggaggagtttggagtggatgacagctacagcgagcagggcgcccaggacagccccacccacctggagatgatggagagcgagctggccggcaagcagcatgaaattgaggagctgaaccgggagctggaggagatgagggtgacctatggaacagagggcctgcagcagctgcaggagtttgaggccgccatcaagcagagagatggcatcatcacccagctgacagccaacctgcagcaggcccggcgggagaaggatgagaccatgagggagttcctggagctgacagagcagagccagaagctgcagatccagttccagcagctgcaggccagcgagaccctgaggaacagcacccacagcagcacagctgctgacctgctgcaggccaagcagcagatcctgacccaccagcagcagctggaggagcaggaccacctgctggaggactaccagaagaagaaggaggacttcaccatgcagatctccttcctgcaggagaagatcaaggtgtatgagatggagcaggacaagaaggtggagaacagcaacaaggaggagatccaggagaaggagaccatcatcgaggagctgaacaccaagatcatcgaggaggagaagaagaccctggagctgaaggacaagctgaccacagctgacaagctgctgggggagctgcaggagcagatcgtgcagaagaaccaggagatcaagaacatgaagctggagctgaccaacagcaagcagaaggagcggcagagcagcgaggagatcaagcagctgatgggcaccgtggaggagctgcagaagaggaaccacaaggacagccagtttgaaacagacatcgtgcagaggatggagcaggagacccagaggaagctggagcagctgcgggcagagctggatgagatgtatggccagcagatcgtgcagatgaagcaggagctgatccggcagcacatggcccagatggaggagatgaagaccaggcacaagggggagatggagaatgccctgcggagctacagcaacatcaccgtgaatgaagaccagatcaagctgatgaatgtggccatcaatgagctgaacatcaagctgcaggacaccaacagccagaaggagaagctgaaggaggagctgggcctcatcctggaggagaagtgtgccctgcagaggcagctggaggacctggtggaggagctgtccttcagccgggagcagatccagagggcccggcagaccatcgccgagcaggagagcaagctgaatgaggcccacaagagcctgagcacagtggaggacctgaaggccgagatcgtgtctgccagcgagagcaggaaggagctggagctgaagcatgaagctgaggtgaccaactacaagatcaagctggagatgctggagaaggagaagaatgctgtgctggacaggatggccgagagccaggaggccgagctggagcggctgcggacccagctgctcttcagccatgaggaggagctgagcaagctgaaggaggacctggagattgagcaccgcatcaacatcgagaagctgaaggacaacctgggcatccactacaagcagcagattgatggcctgcagaatgagatgagccagaagattgagaccatgcagtttgagaaggacaacctgatcaccaagcagaaccagctgatcctggagatcagcaagctgaaggacctgcagcagagcctggtgaacagcaagtctgaggagatgaccctgcagatcaatgagctgcagaaggagattgagatcctgcggcaggaggagaaggagaagggcaccctggagcaggaggtgcaggagctgcagctgaagacagagctgctggagaagcagatgaaggagaaggaaaatgacctgcaggagaagtttgcccagctggaggccgagaacagcatcctgaaggatgagaagaagaccctggaggacatgctgaagatccacacccctgtgtcccaggaggagcggctcatcttcctggacagcatcaagagcaagagcaaggacagcgtgtgggagaaggagattgagatcctgattgaggagaatgaagacctgaagcagcagtgcatccagctgaatgaggagattgagaagcagaggaacaccttctcctttgctgagaagaactttgaggtgaactaccaggagctgcaggaggagtatgcctgcctgctgaaggtgaaggatgacctggaggacagcaagaacaagcaggagctggagtacaagagcaagctgaaggccctgaatgaggagctgcacctgcagaggatcaaccccaccaccgtgaagatgaagagctctgtgtttgatgaggacaagacctttgtggccgagaccctggagatgggagaggtggtggagaaggacaccacagagctgatggagaagctggaggtgaccaagcgggagaagctggagctgagccagaggctgagtgacctgtctgagcagctgaagcagaagcacggggagatctccttcctgaatgaggaggtgaagagcctgaagcaggagaaggagcaggtgtccctgcgctgccgggagctggagatcatcatcaaccacaacagagcagaaaatgtgcagagctgtgacacccaggtgagcagcctgctggatggagtggtgaccatgaccagcagaggagctgagggctctgtgtccaaggtgaacaagagctttggagaggagagcaagatcatggtggaggacaaggtgtcctttgagaacatgacagtgggggaggagagcaagcaggagcagctgatcctggaccacctgcccagcgtgaccaaggagagcagcctgcgggccacccagcccagtgaaaatgacaagctgcagaaggagctgaatgtgctgaagtctgagcagaatgacctgcggctgcagatggaggcccagaggatctgcctgagcctggtgtacagcacccacgtggaccaggtgcgggagtacatggagaatgagaaggacaaggccctgtgcagcctgaaggaggagctgatctttgcccaggaggagaagatcaaggagctgcagaagatccaccagctggagctgcagaccatgaagacccaggagactggagatgagggcaagcccctgcacctgctgattggcaagctgcagaaggctgtgtctgaggagtgcagctacttcctgcagaccctgtgcagcgtgctgggggagtactacaccccagccctgaagtgtgaggtgaatgctgaggacaaggagaacagcggggactacatcagtgaaaatgaagatcctgagctgcaggactaccgctatgaggtgcaggacttccaggagaacatgcacaccctgctgaacaaggtgacagaggagtacaacaagctgctggtgctgcagacccggctgagcaagatctggggccagcagacagatggcatgaagctggagtttggagaggagaacctgcccaaggaggagacagagttcctgagcatccacagccagatgaccaacctggaggacattgatgtgaaccacaagagcaagctgagcagcctgcaggacctggagaagaccaagctggaggagcaggtgcaggagctggagagcctcatcagcagcctgcagcagcagctgaaggagacagagcagaactatgaagctgagatccactgcctgcagaagaggctgcaggccgtgtctgagagcacagtgccccccagcctgcctgtggacagcgtggtgatcacagaaagtgatgcccagaggaccatgtacccaggcagctgtgtgaagaagaacattgatggcaccatcgagttctctggagaatttggagtgaaggaggagaccaacatcgtgaagctgctggagaagcagtaccaggagcagctggaggaggaggtggccaaggtgattgtgtccatgagcatcgcctttgcccagcagacagagctgagccgcatcagcggcggcaaggaaaatacagccagcagcaagcaggcccatgctgtgtgccagcaggagcagcactacttcaatgagatgaagctgagccaggaccagatcggcttccagacctttgaaacagtggatgtgaagttcaaggaggagttcaagcccctgagcaaggagctgggggagcacggcaaggagatcctgctgagcaacagcgacccccatgacatccctgagagcaaggactgtgtgctgaccatcagcgaggagatgttcagcaaggacaagaccttcatcgtgcggcagagcatccatgatgagatctctgtgtcctccatggatgccagccggcagctgatgctgaatgaggagcagctggaggacatgaggcaggagctggtgcggcagtaccaggagcaccagcaggccacagagctgctgcggcaggcccacatgaggcagatggagcggcagcgggaggaccaggagcagctgcaggaggagatcaagaggctgaaccggcagctggcccagaggagcagcattgacaatgaaaacctggtgtctgagcgggagcgggtgctgctggaggagctggaggccctgaagcagctgagcctggccggccgggagaagctgtgctgtgagctgaggaacagcagcacccagacccagaatggaaatgaaaaccagggcgaggtggaggagcagaccttcaaggagaaggagctggacaggaagccagaagatgtgcccccagagatcctgagcaatgaaagatatgccctgcagaaggccaacaaccggctgctgaagatcctgctggaggtggtgaagaccacagctgctgtggaggagaccatcggccgccacgtgctgggcatcctggacaggagcagcaagagccagagcagcgccagcctcatctggaggtctgaggccgaggcctctgtgaagagctgtgtgcatgaggagcacaccagggtgacagatgagagcatccccagctacagcggcagtgacatgcccagaaatgacatcaacatgtggagcaaggtgacagaggagggcacagagctgagccagaggctggtgcgcagcggctttgctggaacagaaattgatcctgaaaatgaggagctgatgctgaacatcagcagccggctgcaggccgctgtggagaagctgctggaggccatcagcgagaccagcagccagctggagcacgccaaggtgacccagacagagctgatgagggagagcttccggcagaagcaggaggccacagagagcctgaagtgccaggaggagctgcgggagcggctgcacgaggagagccgggcccgggagcagctggccgtggagctgagcaaggccgagggcgtgattgatggctatgcagatgagaagaccctgtttgagcggcagatccaggagaagacagacatcatcgaccggctggagcaggagctgctgtgtgccagcaaccggctgcaggagctggaggccgagcagcagcagatccaggaggagcgggagctgctgagccggcagaaggaggccatgaaggccgaggccggccctgtggagcagcagctgctgcaggagacagagaagctgatgaaggagaagctggaggtgcagtgccaggccgagaaggtgagagatgacctgcagaagcaggtgaaggccctggagattgatgtggaggagcaggtgagccgcttcatcgagctggagcaggagaagaacacagagctgatggacctgcggcagcagaaccaggccctggagaagcagctggagaagatgaggaagttcctggatgagcaggccatcgaccgggagcacgagagagatgtgttccagcaggagatccagaagctggagcagcagctgaaggtggtgccccgcttccagcccatcagcgagcaccagacccgggaggtggagcagctggccaaccacctgaaggagaagacagacaagtgcagcgagctgctgctgagcaaggagcagctgcagagggacatccaggagagaaatgaggagattgagaagctggagttccgggtgcgggagctggagcaggccctgctggtgtctgctgacaccttccagaaggtggaggacaggaagcactttggagctgtggaggccaagccagagctgagcctggaggtgcagctgcaggccgagagagatgccatcgacaggaaggagaaggagatcaccaacctggaggagcagctggagcagttccgggaggagctggagaacaagaatgaggaggtgcagcagctgcacatgcagctggagatccagaagaaggagagcaccacccggctgcaggagctggagcaggagaacaagctgttcaaggatgacatggagaagctgggcctggccatcaaggagagtgatgccatgagcacccaggaccagcacgtgctgtttgggaagtttgcccagatcatccaggagaaggaggtggagattgaccagctgaatgagcaggtgaccaagctgcagcagcagctgaagatcaccacagacaacaaggtgattgaggagaagaatgaactcatccgggacctggagacccagatcgagtgcctgatgtctgaccaggagtgtgtgaagaggaaccgggaggaggagattgagcagctgaatgaagtcatcgagaagctgcagcaggagctggccaacatcggccagaagacctccatgaatgcccacagcctgtctgaggaggccgacagcctgaagcaccagctggatgtggtgattgctgagaagctggccctggagcagcaggtggagacagccaatgaggagatgaccttcatgaagaatgtgctgaaggagaccaacttcaagatgaaccagctgacccaggagctgttcagcctgaagcgggagcgggagagcgtggagaagatccagagcatccctgagaacagcgtgaatgtggccatcgaccacctgagcaaggacaagccagagctggaggtggtgctgacagaagatgccctgaagagcctggagaaccagacctacttcaagagctttgaggagaatggcaagggcagcatcatcaacctggagacccggctgctgcagctggagagcacagtgtctgccaaggacctggagctgacccagtgctacaagcagatcaaggacatgcaggagcagggccagtttgaaacagagatgctgcagaagaagatcgtgaacctgcagaagatcgtggaggagaaggtggccgccgccctggtgtcccagatccagctggaggccgtgcaggagtatgccaagttctgccaggacaaccagaccatcagcagcgagcctgagaggaccaacatccagaacctgaaccagctgcgggaggatgagctgggcagtgacatcagcgccctgaccctgcgcatcagcgagctggagagccaggtggtggagatgcacaccagcctcatcctggagaaggagcaggtggagattgctgagaagaatgtgctggagaaggagaagaagctgctggagctgcagaagctgctggagggcaatgagaagaagcagcgggagaaggagaagaagaggagcccccaggatgtggaggtgctgaagaccaccacagagctgttccacagcaatgaggagagcggcttcttcaatgagctggaggccctgcgggcagagagcgtggccaccaaggccgagctggccagctacaaggagaaggccgagaagctgcaggaggagctgctggtgaaggagaccaacatgaccagcctgcagaaggacctgagccaggtgcgggaccacctggccgaggccaaggagaagctgagcatcctggagaaggaggatgaaacagaggtgcaggagagcaagaaggcctgcatgtttgagcccctgcccatcaagctgagcaagagcatcgccagccagacagatggcaccctgaagatcagcagcagcaaccagaccccccagatcctggtgaagaatgccggcatccagatcaacctgcagagtgaatgtagcagcgaggaggtgacagagatcatcagccagttcacagagaagattgagaagatgcaggagctgcacgccgctgagatcctggacatggagagccgccacatcagcgagacagagaccctgaagcgggagcactacgtggccgtgcagctgctgaaggaggagtgtggcaccctgaaggctgtgatccagtgcctgcggagcaaggagggcctgctgcgggctgtgcacaatgaaggcatgcaggtgctgagcctgacagagagcccctacagtgatggagaggaccacagcatccagcaggtgtctgagccctggctggaggagaggaaggcctacatcaacaccatcagcagcctgaaggacctgatcaccaagatgcagctgcagcgggaggccgaggtgtatgacagcagccagagccatgagagcttcagtgactggagaggagagctgctgctggccctgcagcaggtgttcctggaggagaggtctgtgctgctggccgccttcagaacagagctgacagccctgggcaccacagatgctgtgggcctgctgaactgcctggagcagaggatccaggagcagggcgtggagtaccaggccgccatggagtgcctgcagaaggctgacagaagaagcctgctgtctgagatccaggccctgcacgcccagatgaatggaaggaagatcaccctgaagcgggagcaggagagcgagaagcccagccaggagctgctggagtacaacatccagcagaagcagagccagatgctggagatgcaggtggagctgagctccatgaaggaccgggccacagagctgcaggagcagctgagcagcgagaagatggtggtggccgagctgaagtctgagctggcccagaccaagctggagctggagaccaccctgaaggcccagcacaagcacctgaaggagctggaggccttccggctggaggtgaaggacaagacagatgaggtgcacctgctgaatgacaccctggccagcgagcagaagaagagccgggagctgcagtgggccctggagaaggagaaggccaagctgggccgctctgaggagcgggacaaggaggagctggaggacctgaagttcagcctggagagccagaagcagaggaacctgcagctgaacctgctgctggagcagcagaagcagctgctgaatgaaagccagcagaagattgagagccagaggatgctgtatgatgcccagctgtctgaggagcagggcaggaacctggagctgcaggtgctgctggagagcgagaaggtgcgcatccgggagatgagcagcaccctggaccgggagcgggagctgcacgcccagctgcagagcagtgatggcaccggccagagcaggcctcccctgcccagcgaggacctgctgaaggagctgcagaagcagctggaggagaagcacagcagaattgtggagctgctgaatgaaacagagaagtacaagctggacagcctgcagacccggcagcagatggagaaggaccggcaggtgcacaggaagaccctgcagacagagcaggaggccaacacagagggccagaagaagatgcatgagctgcagagcaaggtggaggacctgcagaggcagctggaggagaagaggcagcaggtgtacaagctggacctggagggccagaggctgcagggcatcatgcaggagttccagaagcaggagctggagcgggaggagaagcgggagagccgccgcatcctgtaccagaacctgaatgagcccaccacctggagcctgaccagtgacaggaccaggaactgggtgctgcagcagaagattgaaggagagaccaaggagagcaactatgccaagctgattgagatgaatggaggcggcaccggctgcaaccacgagctggagatgatccggcagaagctgcagtgtgtggccagcaagctgcaggtgctgccccagaaggccagcgagcggctgcagtttgaaacagcagatgatgaggacttcatctgggtgcaggagaacattgatgagatcatcctgcagctgcagaagctgaccggccagcagggcgaggagcccagcctggtgagccccagcaccagctgtggcagcctgacagagcggctgctgcggcagaatgctgagctgaccggccacatcagccagctgacagaggagaagaatgacctgaggaacatggtgatgaagctggaggagcagatccgctggtaccggcagacaggagctggccgggacaacagcagccgcttcagcctgaatggaggagccaacatcgaggccatcatcgccagcgagaaggaggtgtggaaccgggagaagctgaccctgcagaagagcctgaagagagctgaggccgaggtgtacaagctgaaggccgagctgagaaatgacagcctgctgcagaccctgagcccagattctgaacatgtgaccctgaagaggatctacggcaagtacctgcgggcagagagcttcaggaaggccctgatctaccagaagaagtacctgctgctgctgctgggcggcttccaggagtgtgaagatgccaccctggccctgctggccaggatgggcggccagcctgccttcacagacctggaggtgatcaccaaccggcccaagggcttcacccgcttccgctctgctgtgcgggtgtccatcgccatcagcaggatgaagttcctggtgcggcgctggcaccgggtgactggatctgtgtccatcaacatcaacagagatggcttcggcctgaaccagggcgctgagaagacagacagcttctaccacagcagcggcggcctggagctgtatggagagcccaggcacaccacctaccgcagcagaagtgacctggactacatccgcagccccctgcccttccagaaccgctacccaggcaccccagctgacttcaaccctggcagcctggcctgcagccagctgcagaactatgaccctgaccgggccctgacagactacatcacccggctggaggccctgcagaggcggctgggcaccatccagagcggcagcaccacccagttccacgccggcatgagaagatag

SEQ ID NO: 142059 - DNA, 11736 bp, Artificial Sequence
  Description of Artificial Sequence: Synthetic coding sequence
atggaggatgaggagcggcagaagaagctggaggccggcaaggccaagattgaggagctgagcctggccttcctggtgcggcagctggcccagttccggcagaggaaggcccagagtgatggccagagccccagcaagaagcagaagaagaagaggaagaccagcagcagcaagcatgatgtgtctgcccaccacgacctgaacatcgaccagagccagtgcaatgagatgtacatcaacagcagccagagggtggagagcaccgtcatccctgagagcaccatcatgaggaccctgcacagcggggagatcaccagccatgagcagggcttctctgtggagctggagagcgagatcagcaccacagcagatgactgcagcagcgaggtgaatggctgcagctttgtgatgaggacaggcaagcccaccaacctgctgcgggaggaggagtttggagtggatgacagctacagcgagcagggcgcccaggacagccccacccacctggagatgatggagagcgagctggccggcaagcagcatgaaattgaggagctgaaccgggagctggaggagatgagggtgacctatggaacagagggcctgcagcagctgcaggagtttgaggccgccatcaagcagagagatggcatcatcacccagctgacagccaacctgcagcaggcccggcgggagaaggatgagaccatgagggagttcctggagctgacagagcagagccagaagctgcagatccagttccagcagctgcaggccagcgagaccctgaggaacagcacccacagcagcacagctgctgacctgctgcaggccaagcagcagatcctgacccaccagcagcagctggaggagcaggaccacctgctggaggactaccagaagaagaaggaggacttcaccatgcagatctccttcctgcaggagaagatcaaggtgtatgagatggagcaggacaagaaggtggagaacagcaacaaggaggagatccaggagaaggagaccatcatcgaggagctgaacaccaagatcatcgaggaggagaagaagaccctggagctgaaggacaagctgaccacagctgacaagctgctgggggagctgcaggagcagatcgtgcagaagaaccaggagatcaagaacatgaagctggagctgaccaacagcaagcagaaggagcggcagagcagcgaggagatcaagcagctgatgggcaccgtggaggagctgcagaagaggaaccacaaggacagccagtttgaaacagacatcgtgcagaggatggagcaggagacccagaggaagctggagcagctgcgggcagagctggatgagatgtatggccagcagatcgtgcagatgaagcaggagctgatccggcagcacatggcccagatggaggagatgaagaccaggcacaagggggagatggagaatgccctgcggagctacagcaacatcaccgtgaatgaagaccagatcaagctgatgaatgtggccatcaatgagctgaacatcaagctgcaggacaccaacagccagaaggagaagctgaaggaggagctgggcctcatcctggaggagaagtgtgccctgcagaggcagctggaggacctggtggaggagctgtccttcagccgggagcagatccagagggcccggcagaccatcgccgagcaggagagcaagctgaatgaggcccacaagagcctgagcacagtggaggacctgaaggccgagatcgtgtctgccagcgagagcaggaaggagctggagctgaagcatgaagctgaggtgaccaactacaagatcaagctggagatgctggagaaggagaagaatgctgtgctggacaggatggccgagagccaggaggccgagctggagcggctgcggacccagctgctcttcagccatgaggaggagctgagcaagctgaaggaggacctggagattgagcaccgcatcaacatcgagaagctgaaggacaacctgggcatccactacaagcagcagattgatggcctgcagaatgagatgagccagaagattgagaccatgcagtttgagaaggacaacctgatcaccaagcagaaccagctgatcctggagatcagcaagctgaaggacctgcagcagagcctggtgaacagcaagtctgaggagatgaccctgcagatcaatgagctgcagaaggagattgagatcctgcggcaggaggagaaggagaagggcaccctggagcaggaggtgcaggagctgcagctgaagacagagctgctggagaagcagatgaaggagaaggaaaatgacctgcaggagaagtttgcccagctggaggccgagaacagcatcctgaaggatgagaagaagaccctggaggacatgctgaagatccacacccctgtgtcccaggaggagcggctcatcttcctggacagcatcaagagcaagagcaaggacagcgtgtgggagaaggagattgagatcctgattgaggagaatgaagacctgaagcagcagtgcatccagctgaatgaggagattgagaagcagaggaacaccttctcctttgctgagaagaactttgaggtgaactaccaggagctgcaggaggagtatgcctgcctgctgaaggtgaaggatgacctggaggacagcaagaacaagcaggagctggagtacaagagcaagctgaaggccctgaatgaggagctgcacctgcagaggatcaaccccaccaccgtgaagatgaagagctctgtgtttgatgaggacaagacctttgtggccgagaccctggagatgggagaggtggtggagaaggacaccacagagctgatggagaagctggaggtgaccaagcgggagaagctggagctgagccagaggctgagtgacctgtctgagcagctgaagcagaagcacggggagatctccttcctgaatgaggaggtgaagagcctgaagcaggagaaggagcaggtgtccctgcgctgccgggagctggagatcatcatcaaccacaacagagcagaaaatgtgcagagctgtgacacccaggtgagcagcctgctggatggagtggtgaccatgaccagcagaggagctgagggctctgtgtccaaggtgaacaagagctttggagaggagagcaagatcatggtggaggacaaggtgtcctttgagaacatgacagtgggggaggagagcaagcaggagcagctgatcctggaccacctgcccagcgtgaccaaggagagcagcctgcgggccacccagcccagtgaaaatgacaagctgcagaaggagctgaatgtgctgaagtctgagcagaatgacctgcggctgcagatggaggcccagaggatctgcctgagcctggtgtacagcacccacgtggaccaggtgcgggagtacatggagaatgagaaggacaaggccctgtgcagcctgaaggaggagctgatctttgcccaggaggagaagatcaaggagctgcagaagatccaccagctggagctgcagaccatgaagacccaggagactggagatgagggcaagcccctgcacctgctgattggcaagctgcagaaggctgtgtctgaggagtgcagctacttcctgcagaccctgtgcagcgtgctgggggagtactacaccccagccctgaagtgtgaggtgaatgctgaggacaaggagaacagcggggactacatcagtgaaaatgaagatcctgagctgcaggactaccgctatgaggtgcaggacttccaggagaacatgcacaccctgctgaacaaggtgacagaggagtacaacaagctgctggtgctgcagacccggctgagcaagatctggggccagcagacagatggcatgaagctggagtttggagaggagaacctgcccaaggaggagacagagttcctgagcatccacagccagatgaccaacctggaggacattgatgtgaaccacaagagcaagctgagcagcctgcaggacctggagaagaccaagctggaggagcaggtgcaggagctggagagcctcatcagcagcctgcagcagcagctgaaggagacagagcagaactatgaagctgagatccactgcctgcagaagaggctgcaggccgtgtctgagagcacagtgccccccagcctgcctgtggacagcgtggtgatcacagaaagtgatgcccagaggaccatgtacccaggcagctgtgtgaagaagaacattgatggcaccatcgagttctctggagaatttggagtgaaggaggagaccaacatcgtgaagctgctggagaagcagtaccaggagcagctggaggaggaggtggccaaggtgattgtgtccatgagcatcgcctttgcccagcagacagagctgagccgcatcagcggcggcaaggaaaatacagccagcagcaagcaggcccatgctgtgtgccagcaggagcagcactacttcaatgagatgaagctgagccaggaccagatcggcttccagacctttgaaacagtggatgtgaagttcaaggaggagttcaagcccctgagcaaggagctgggggagcacggcaaggagatcctgctgagcaacagcgacccccatgacatccctgagagcaaggactgtgtgctgaccatcagcgaggagatgttcagcaaggacaagaccttcatcgtgcggcagagcatccatgatgagatctctgtgtcctccatggatgccagccggcagctgatgctgaatgaggagcagctggaggacatgaggcaggagctggtgcggcagtaccaggagcaccagcaggccacagagctgctgcggcaggcccacatgaggcagatggagcggcagcgggaggaccaggagcagctgcaggaggagatcaagaggctgaaccggcagctggcccagaggagcagcattgacaatgaaaacctggtgtctgagcgggagcgggtgctgctggaggagctggaggccctgaagcagctgagcctggccggccgggagaagctgtgctgtgagctgaggaacagcagcacccagacccagaatggaaatgaaaaccagggcgaggtggaggagcagaccttcaaggagaaggagctggacaggaagccagaagatgtgcccccagagatcctgagcaatgaaagatatgccctgcagaaggccaacaaccggctgctgaagatcctgctggaggtggtgaagaccacagctgctgtggaggagaccatcggccgccacgtgctgggcatcctggacaggagcagcaagagccagagcagcgccagcctcatctggaggtctgaggccgaggcctctgtgaagagctgtgtgcatgaggagcacaccagggtgacagatgagagcatccccagctacagcggcagtgacatgcccagaaatgacatcaacatgtggagcaaggtgacagaggagggcacagagctgagccagaggctggtgcgcagcggctttgctggaacagaaattgatcctgaaaatgaggagctgatgctgaacatcagcagccggctgcaggccgctgtggagaagctgctggaggccatcagcgagaccagcagccagctggagcacgccaaggtgacccagacagagctgatgagggagagcttccggcagaagcaggaggccacagagagcctgaagtgccaggaggagctgcgggagcggctgcacgaggagagccgggcccgggagcagctggccgtggagctgagcaaggccgagggcgtgattgatggctatgcagatgagaagaccctgtttgagcggcagatccaggagaagacagacatcatcgaccggctggagcaggagctgctgtgtgccagcaaccggctgcaggagctggaggccgagcagcagcagatccaggaggagcgggagctgctgagccggcagaaggaggccatgaaggccgaggccggccctgtggagcagcagctgctgcaggagacagagaagctgatgaaggagaagctggaggtgcagtgccaggccgagaaggtgagagatgacctgcagaagcaggtgaaggccctggagattgatgtggaggagcaggtgagccgcttcatcgagctggagcaggagaagaacacagagctgatggacctgcggcagcagaaccaggccctggagaagcagctggagaagatgaggaagttcctggatgagcaggccatcgaccgggagcacgagagagatgtgttccagcaggagatccagaagctggagcagcagctgaaggtggtgccccgcttccagcccatcagcgagcaccagacccgggaggtggagcagctggccaaccacctgaaggagaagacagacaagtgcagcgagctgctgctgagcaaggagcagctgcagagggacatccaggagagaaatgaggagattgagaagctggagttccgggtgcgggagctggagcaggccctgctggtgtctgctgacaccttccagaaggtggaggacaggaagcactttggagctgtggaggccaagccagagctgagcctggaggtgcagctgcaggccgagagagatgccatcgacaggaaggagaaggagatcaccaacctggaggagcagctggagcagttccgggaggagctggagaacaagaatgaggaggtgcagcagctgcacatgcagctggagatccagaagaaggagagcaccacccggctgcaggagctggagcaggagaacaagctgttcaaggatgacatggagaagctgggcctggccatcaaggagagtgatgccatgagcacccaggaccagcacgtgctgtttgggaagtttgcccagatcatccaggagaaggaggtggagattgaccagctgaatgagcaggtgaccaagctgcagcagcagctgaagatcaccacagacaacaaggtgattgaggagaagaatgaactcatccgggacctggagacccagatcgagtgcctgatgtctgaccaggagtgtgtgaagaggaaccgggaggaggagattgagcagctgaatgaagtcatcgagaagctgcagcaggagctggccaacatcggccagaagacctccatgaatgcccacagcctgtctgaggaggccgacagcctgaagcaccagctggatgtggtgattgctgagaagctggccctggagcagcaggtggagacagccaatgaggagatgaccttcatgaagaatgtgctgaaggagaccaacttcaagatgaaccagctgacccaggagctgttcagcctgaagcgggagcgggagagcgtggagaagatccagagcatccctgagaacagcgtgaatgtggccatcgaccacctgagcaaggacaagccagagctggaggtggtgctgacagaagatgccctgaagagcctggagaaccagacctacttcaagagctttgaggagaatggcaagggcagcatcatcaacctggagacccggctgctgcagctggagagcacagtgtctgccaaggacctggagctgacccagtgctacaagcagatcaaggacatgcaggagcagggccagtttgaaacagagatgctgcagaagaagatcgtgaacctgcagaagatcgtggaggagaaggtggccgccgccctggtgtcccagatccagctggaggccgtgcaggagtatgccaagttctgccaggacaaccagaccatcagcagcgagcctgagaggaccaacatccagaacctgaaccagctgcgggaggatgagctgggcagtgacatcagcgccctgaccctgcgcatcagcgagctggagagccaggtggtggagatgcacaccagcctcatcctggagaaggagcaggtggagattgctgagaagaatgtgctggagaaggagaagaagctgctggagctgcagaagctgctggagggcaatgagaagaagcagcgggagaaggagaagaagaggagcccccaggatgtggaggtgctgaagaccaccacagagctgttccacagcaatgaggagagcggcttcttcaatgagctggaggccctgcgggcagagagcgtggccaccaaggccgagctggccagctacaaggagaaggccgagaagctgcaggaggagctgctggtgaaggagaccaacatgaccagcctgcagaaggacctgagccaggtgcgggaccacctggccgaggccaaggagaagctgagcatcctggagaaggaggatgaaacagaggtgcaggagagcaagaaggcctgcatgtttgagcccctgcccatcaagctgagcaagagcatcgccagccagacagatggcaccctgaagatcagcagcagcaaccagaccccccagatcctggtgaagaatgccggcatccagatcaacctgcagagtgaatgtagcagcgaggaggtgacagagatcatcagccagttcacagagaagattgagaagatgcaggagctgcacgccgctgagatcctggacatggagagccgccacatcagcgagacagagaccctgaagcgggagcactacgtggccgtgcagctgctgaaggaggagtgtggcaccctgaaggctgtgatccagtgcctgcggagcaaggaggtgtttggcttctacaacatgtgcttcagcaccctgtgtgacagcggcagtgactggggccagggcatctacctgacccacagccagggctttgatattgccagcgagggccgcggggaggagagcgagagcgccacagacagcttccccaagaagatcaagggcctgctgcgggctgtgcacaatgaaggcatgcaggtgctgagcctgacagagagcccctacagtgatggagaggaccacagcatccagcaggtgtctgagccctggctggaggagaggaaggcctacatcaacaccatcagcagcctgaaggacctgatcaccaagatgcagctgcagcgggaggccgaggtgtatgacagcagccagagccatgagagcttcagtgactggagaggagagctgctgctggccctgcagcaggtgttcctggaggagaggtctgtgctgctggccgccttcagaacagagctgacagccctgggcaccacagatgctgtgggcctgctgaactgcctggagcagaggatccaggagcagggcgtggagtaccaggccgccatggagtgcctgcagaaggctgacagaagaagcctgctgtctgagatccaggccctgcacgcccagatgaatggaaggaagatcaccctgaagcgggagcaggagagcgagaagcccagccaggagctgctggagtacaacatccagcagaagcagagccagatgctggagatgcaggtggagctgagctccatgaaggaccgggccacagagctgcaggagcagctgagcagcgagaagatggtggtggccgagctgaagtctgagctggcccagaccaagctggagctggagaccaccctgaaggcccagcacaagcacctgaaggagctggaggccttccggctggaggtgaaggacaagacagatgaggtgcacctgctgaatgacaccctggccagcgagcagaagaagagccgggagctgcagtgggccctggagaaggagaaggccaagctgggccgctctgaggagcgggacaaggaggagctggaggacctgaagttcagcctggagagccagaagcagaggaacctgcagctgaacctgctgctggagcagcagaagcagctgctgaatgaaagccagcagaagattgagagccagaggatgctgtatgatgcccagctgtctgaggagcagggcaggaacctggagctgcaggtgctgctggagagcgagaaggtgcgcatccgggagatgagcagcaccctggaccgggagcgggagctgcacgcccagctgcagagcagtgatggcaccggccagagcaggcctcccctgcccagcgaggacctgctgaaggagctgcagaagcagctggaggagaagcacagcagaattgtggagctgctgaatgaaacagagaagtacaagctggacagcctgcagacccggcagcagatggagaaggaccggcaggtgcacaggaagaccctgcagacagagcaggaggccaacacagagggccagaagaagatgcatgagctgcagagcaaggtggaggacctgcagaggcagctggaggagaagaggcagcaggtgtacaagctggacctggagggccagaggctgcagggcatcatgcaggagttccagaagcaggagctggagcgggaggagaagcgggagagccgccgcatcctgtaccagaacctgaatgagcccaccacctggagcctgaccagtgacaggaccaggaactgggtgctgcagcagaagattgaaggagagaccaaggagagcaactatgccaagctgattgagatgaatggaggcggcaccggctgcaaccacgagctggagatgatccggcagaagctgcagtgtgtggccagcaagctgcaggtgctgccccagaaggccagcgagcggctgcagtttgaaacagcagatgatgaggacttcatctgggtgcaggagaacattgatgagatcatcctgcagctgcagaagctgaccggccagcagggcgaggagcccagcctggtgagccccagcaccagctgtggcagcctgacagagcggctgctgcggcagaatgctgagctgaccggccacatcagccagctgacagaggagaagaatgacctgaggaacatggtgatgaagctggaggagcagatccgctggtaccggcagacaggagctggccgggacaacagcagccgcttcagcctgaatggaggagccaacatcgaggccatcatcgccagcgagaaggaggtgtggaaccgggagaagctgaccctgcagaagagcctgaagagagctgaggccgaggtgtacaagctgaaggccgagctgagaaatgacagcctgctgcagaccctgagcccagattctgaacatgtgaccctgaagaggatctacggcaagtacctgcgggcagagagcttcaggaaggccctgatctaccagaagaagtacctgctgctgctgctgggcggcttccaggagtgtgaagatgccaccctggccctgctggccaggatgggcggccagcctgccttcacagacctggaggtgatcaccaaccggcccaagggcttcacccgcttccgctctgctgtgcgggtgtccatcgccatcagcaggatgaagttcctggtgcggcgctggcaccgggtgactggatctgtgtccatcaacatcaacagagatggcttcggcctgaaccagggcgctgagaagacagacagcttctaccacagcagcggcggcctggagctgtatggagagcccaggcacaccacctaccgcagcagaagtgacctggactacatccgcagccccctgcccttccagaaccgctacccaggcaccccagctgacttcaaccctggcagcctggcctgcagccagctgcagaactatgaccctgaccgggccctgacagactacatcacccggctggaggccctgcagaggcggctgggcaccatccagagcggcagcaccacccagttccacgccggcatgagaagatag

SEQ ID NO: 142060 - DNA, 4932 bp, Artificial Sequence
  Description of Artificial Sequence: Synthetic coding sequence
atggaggatgaggagcggcagaagaagctggaggccggcaaggccaagattgaggagctgagcctggccttcctggtgcggcagctggcccagttccggcagaggaaggcccagagtgatggccagagccccagcaagaagcagaagaagaagaggaagaccagcagcagcaagcatgatgtgtctgcccaccacgacctgaacatcgaccagagccagtgcaatgagatgtacatcaacagcagccagagggtggagagcaccgtcatccctgagagcaccatcatgaggaccctgcacagcggggagatcaccagccatgagcagggcttctctgtggagctggagagcgagatcagcaccacagcagatgactgcagcagcgaggtgaatggctgcagctttgtgatgaggacaggcaagcccaccaacctgctgcgggaggaggagtttggagtggatgacagctacagcgagcagggcgcccaggacagccccacccacctggagatgatggagagcgagctggccggcaagcagcatgaaattgaggagctgaaccgggagctggaggagatgagggtgacctatggaacagagggcctgcagcagctgcaggagtttgaggccgccatcaagcagagagatggcatcatcacccagctgacagccaacctgcagcaggcccggcgggagaaggatgagaccatgagggagttcctggagctgacagagcagagccagaagctgcagatccagttccagcagctgcaggccagcgagaccctgaggaacagcacccacagcagcacagctgctgacctgctgcaggccaagcagcagatcctgacccaccagcagcagctggaggagcaggaccacctgctggaggactaccagaagaagaaggaggacttcaccatgcagatctccttcctgcaggagaagatcaaggtgtatgagatggagcaggacaagaaggtggagaacagcaacaaggaggagatccaggagaaggagaccatcatcgaggagctgaacaccaagatcatcgaggaggagaagaagaccctggagctgaaggacaagctgaccacagctgacaagctgctgggggagctgcaggagcagatcgtgcagaagaaccaggagatcaagaacatgaagctggagctgaccaacagcaagcagaaggagcggcagagcagcgaggagatcaagcagctgatgggcaccgtggaggagctgcagaagaggaaccacaaggacagccagtttgaaacagacatcgtgcagaggatggagcaggagacccagaggaagctggagcagctgcgggcagagctggatgagatgtatggccagcagatcgtgcagatgaagcaggagctgatccggcagcacatggcccagatggaggagatgaagaccaggcacaagggggagatggagaatgccctgcggagctacagcaacatcaccgtgaatgaagaccagatcaagctgatgaatgtggccatcaatgagctgaacatcaagctgcaggacaccaacagccagaaggagaagctgaaggaggagctgggcctcatcctggaggagaagtgtgccctgcagaggcagctggaggacctggtggaggagctgtccttcagccgggagcagatccagagggcccggcagaccatcgccgagcaggagagcaagctgaatgaggcccacaagagcctgagcacagtggaggacctgaaggccgagatcgtgtctgccagcgagagcaggaaggagctggagctgaagcatgaagctgaggtgaccaactacaagatcaagctggagatgctggagaaggagaagaatgctgtgctggacaggatggccgagagccaggaggccgagctggagcggctgcggacccagctgctcttcagccatgaggaggagctgagcaagctgaaggaggacctggagattgagcaccgcatcaacatcgagaagctgaaggacaacctgggcatccactacaagcagcagattgatggcctgcagaatgagatgagccagaagattgagaccatgcagtttgagaaggacaacctgatcaccaagcagaaccagctgatcctggagatcagcaagctgaaggacctgcagcagagcctggtgaacagcaagtctgaggagatgaccctgcagatcaatgagctgcagaaggagattgagatcctgcggcaggaggagaaggagaagggcaccctggagcaggaggtgcaggagctgcagctgaagacagagctgctggagaagcagatgaaggagaaggaaaatgacctgcaggagaagtttgcccagctggaggccgagaacagcatcctgaaggatgagaagaagaccctggaggacatgctgaagatccacacccctgtgtcccaggaggagcggctcatcttcctggacagcatcaagagcaagagcaaggacagcgtgtgggagaaggagattgagatcctgattgaggagaatgaagacctgaagcagcagtgcatccagctgaatgaggagattgagaagcagaggaacaccttctcctttgctgagaagaactttgaggtgaactaccaggagctgcaggaggagtatgcctgcctgctgaaggtgaaggatgacctggaggacagcaagaacaagcaggagctggagtacaagagcaagctgaaggccctgaatgaggagctgcacctgcagaggatcaaccccaccaccgtgaagatgaagagctctgtgtttgatgaggacaagacctttgtggccgagaccctggagatgggagaggtggtggagaaggacaccacagagctgatggagaagctggaggtgaccaagcgggagaagctggagctgagccagaggctgagtgacctgtctgagcagctgaagcagaagcacggggagatctccttcctgaatgaggaggtgaagagcctgaagcaggagaaggagcaggtgtccctgcgctgccgggagctggagatcatcatcaaccacaacagagcagaaaatgtgcagagctgtgacacccaggtgagcagcctgctggatggagtggtgaccatgaccagcagaggagctgagggctctgtgtccaaggtgaacaagagctttggagaggagagcaagatcatggtggaggacaaggtgtcctttgagaacatgacagtgggggaggagagcaagcaggagcagctgatcctggaccacctgcccagcgtgaccaaggagagcagcctgcgggccacccagcccagtgaaaatgacaagctgcagaaggagctgaatgtgctgaagtctgagcagaatgacctgcggctgcagatggaggcccagaggatctgcctgagcctggtgtacagcacccacgtggaccaggtgcgggagtacatggagaatgagaaggacaaggccctgtgcagcctgaaggaggagctgatctttgcccaggaggagaagatcaaggagctgcagaagatccaccagctggagctgcagaccatgaagacccaggagactggagatgagggcaagcccctgcacctgctgattggcaagctgcagaaggctgtgtctgaggagtgcagctacttcctgcagaccctgtgcagcgtgctgggggagtactacaccccagccctgaagtgtgaggtgaatgctgaggacaaggagaacagcggggactacatcagtgaaaatgaagatcctgagctgcaggactaccgctatgaggtgcaggacttccaggagaacatgcacaccctgctgaacaaggtgacagaggagtacaacaagctgctggtgctgcagacccggctgagcaagatctggggccagcagacagatggcatgaagctggagtttggagaggagaacctgcccaaggaggagacagagttcctgagcatccacagccagatgaccaacctggaggacattgatgtgaaccacaagagcaagctgagcagcctgcaggacctggagaagaccaagctggaggagcaggtgcaggagctggagagcctcatcagcagcctgcagcagcagctgaaggagacagagcagaactatgaagctgagatccactgcctgcagaagaggctgcaggccgtgtctgagagcacagtgccccccagcctgcctgtggacagcgtggtgatcacagaaagtgatgcccagaggaccatgtacccaggcagctgtgtgaagaagaacattgatggcaccatcgagttctctggagaatttggagtgaaggaggagaccaacatcgtgaagctgctggagaagcagtaccaggagcagctggaggaggaggtggccaaggtgattgtgtccatgagcatcgcctttgcccagcagacagagctgagccgcatcagcggcggcaaggaaaatacagccagcagcaagcaggcccatgctgtgtgccagcaggagcagcactacttcaatgagatgaagctgagccaggaccagatcggcttccagacctttgaaacagtggatgtgaagttcaaggaggagttcaagcccctgagcaaggagctgggggagcacggcaaggagatcctgctgagcaacagcgacccccatgacatccctgagagcaaggactgtgtgctgaccatcagcgaggagatgttcagcaaggacaagaccttcatcgtgcggcagagcatccatgatgagatctctgtgtcctccatggatgccagccggcagctgatgctgaatgaggagcagctggaggacatgaggcaggagctggtgcggcagtaccaggagcaccagcaggccacagagctgctgcggcaggcccacatgaggcagatggagcggcagcgggaggaccaggagcagctgcaggtgcgggtgctgtag

SEQ ID NO: 142061 - DNA, 11631 bp, Artificial Sequence
  Description of Artificial Sequence: Synthetic coding sequence
atggaggatgaggagcggcagaagaagctggaggccggcaaggccaagattgaggagctgagcctggccttcctggtgcggcagctggcccagttccggcagaggaaggcccagagtgatggccagagccccagcaagaagcagaagaagaagaggaagaccagcagcagcaagcatgatgtgtctgcccaccacgacctgaacatcgaccagagccagtgcaatgagatgtacatcaacagcagccagagggtggagagcaccgtcatccctgagagcaccatcatgaggaccctgcacagcggggagatcaccagccatgagcagggcttctctgtggagctggagagcgagatcagcaccacagcagatgactgcagcagcgaggtgaatggctgcagctttgtgatgaggacaggcaagcccaccaacctgctgcgggaggaggagtttggagtggatgacagctacagcgagcagggcgcccaggacagccccacccacctggagatgatggagagcgagctggccggcaagcagcatgaaattgaggagctgaaccgggagctggaggagatgagggtgacctatggaacagagggcctgcagcagctgcaggagtttgaggccgccatcaagcagagagatggcatcatcacccagctgacagccaacctgcagcaggcccggcgggagaaggatgagaccatgagggagttcctggagctgacagagcagagccagaagctgcagatccagttccagcagctgcaggccagcgagaccctgaggaacagcacccacagcagcacagctgctgacctgctgcaggccaagcagcagatcctgacccaccagcagcagctggaggagcaggaccacctgctggaggactaccagaagaagaaggaggacttcaccatgcagatctccttcctgcaggagaagatcaaggtgtatgagatggagcaggacaagaaggtggagaacagcaacaaggaggagatccaggagaaggagaccatcatcgaggagctgaacaccaagatcatcgaggaggagaagaagaccctggagctgaaggacaagctgaccacagctgacaagctgctgggggagctgcaggagcagatcgtgcagaagaaccaggagatcaagaacatgaagctggagctgaccaacagcaagcagaaggagcggcagagcagcgaggagatcaagcagctgatgggcaccgtggaggagctgcagaagaggaaccacaaggacagccagtttgaaacagacatcgtgcagaggatggagcaggagacccagaggaagctggagcagctgcgggcagagctggatgagatgtatggccagcagatcgtgcagatgaagcaggagctgatccggcagcacatggcccagatggaggagatgaagaccaggcacaagggggagatggagaatgccctgcggagctacagcaacatcaccgtgaatgaagaccagatcaagctgatgaatgtggccatcaatgagctgaacatcaagctgcaggacaccaacagccagaaggagaagctgaaggaggagctgggcctcatcctggaggagaagtgtgccctgcagaggcagctggaggacctggtggaggagctgtccttcagccgggagcagatccagagggcccggcagaccatcgccgagcaggagagcaagctgaatgaggcccacaagagcctgagcacagtggaggacctgaaggccgagatcgtgtctgccagcgagagcaggaaggagctggagctgaagcatgaagctgaggtgaccaactacaagatcaagctggagatgctggagaaggagaagaatgctgtgctggacaggatggccgagagccaggaggccgagctggagcggctgcggacccagctgctcttcagccatgaggaggagctgagcaagctgaaggaggacctggagattgagcaccgcatcaacatcgagaagctgaaggacaacctgggcatccactacaagcagcagattgatggcctgcagaatgagatgagccagaagattgagaccatgcagtttgagaaggacaacctgatcaccaagcagaaccagctgatcctggagatcagcaagctgaaggacctgcagcagagcctggtgaacagcaagtctgaggagatgaccctgcagatcaatgagctgcagaaggagattgagatcctgcggcaggaggagaaggagaagggcaccctggagcaggaggtgcaggagctgcagctgaagacagagctgctggagaagcagatgaaggagaaggaaaatgacctgcaggagaagtttgcccagctggaggccgagaacagcatcctgaaggatgagaagaagaccctggaggacatgctgaagatccacacccctgtgtcccaggaggagcggctcatcttcctggacagcatcaagagcaagagcaaggacagcgtgtgggagaaggagattgagatcctgattgaggagaatgaagacctgaagcagcagtgcatccagctgaatgaggagattgagaagcagaggaacaccttctcctttgctgagaagaactttgaggtgaactaccaggagctgcaggaggagtatgcctgcctgctgaaggtgaaggatgacctggaggacagcaagaacaagcaggagctggagtacaagagcaagctgaaggccctgaatgaggagctgcacctgcagaggatcaaccccaccaccgtgaagatgaagagctctgtgtttgatgaggacaagacctttgtggccgagaccctggagatgggagaggtggtggagaaggacaccacagagctgatggagaagctggaggtgaccaagcgggagaagctggagctgagccagaggctgagtgacctgtctgagcagctgaagcagaagcacggggagatctccttcctgaatgaggaggtgaagagcctgaagcaggagaaggagcaggtgtccctgcgctgccgggagctggagatcatcatcaaccacaacagagcagaaaatgtgcagagctgtgacacccaggtgagcagcctgctggatggagtggtgaccatgaccagcagaggagctgagggctctgtgtccaaggtgaacaagagctttggagaggagagcaagatcatggtggaggacaaggtgtcctttgagaacatgacagtgggggaggagagcaagcaggagcagctgatcctggaccacctgcccagcgtgaccaaggagagcagcctgcgggccacccagcccagtgaaaatgacaagctgcagaaggagctgaatgtgctgaagtctgagcagaatgacctgcggctgcagatggaggcccagaggatctgcctgagcctggtgtacagcacccacgtggaccaggtgcgggagtacatggagaatgagaaggacaaggccctgtgcagcctgaaggaggagctgatctttgcccaggaggagaagatcaaggagctgcagaagatccaccagctggagctgcagaccatgaagacccaggagactggagatgagggcaagcccctgcacctgctgattggcaagctgcagaaggctgtgtctgaggagtgcagctacttcctgcagaccctgtgcagcgtgctgggggagtactacaccccagccctgaagtgtgaggtgaatgctgaggacaaggagaacagcggggactacatcagtgaaaatgaagatcctgagctgcaggactaccgctatgaggtgcaggacttccaggagaacatgcacaccctgctgaacaaggtgacagaggagtacaacaagctgctggtgctgcagacccggctgagcaagatctggggccagcagacagatggcatgaagctggagtttggagaggagaacctgcccaaggaggagacagagttcctgagcatccacagccagatgaccaacctggaggacattgatgtgaaccacaagagcaagctgagcagcctgcaggacctggagaagaccaagctggaggagcaggtgcaggagctggagagcctcatcagcagcctgcagcagcagctgaaggagacagagcagaactatgaagctgagatccactgcctgcagaagaggctgcaggccgtgtctgagagcacagtgccccccagcctgcctgtggacagcgtggtgatcacagaaagtgatgcccagaggaccatgtacccaggcagctgtgtgaagaagaacattgatggcaccatcgagttctctggagaatttggagtgaaggaggagaccaacatcgtgaagctgctggagaagcagtaccaggagcagctggaggaggaggtggccaaggtgattgtgtccatgagcatcgcctttgcccagcagacagagctgagccgcatcagcggcggcaaggaaaatacagccagcagcaagcaggcccatgctgtgtgccagcaggagcagcactacttcaatgagatgaagctgagccaggaccagatcggcttccagacctttgaaacagtggatgtgaagttcaaggaggagttcaagcccctgagcaaggagctgggggagcacggcaaggagatcctgctgagcaacagcgacccccatgacatccctgagagcaaggactgtgtgctgaccatcagcgaggagatgttcagcaaggacaagaccttcatcgtgcggcagagcatccatgatgagatctctgtgtcctccatggatgccagccggcagctgatgctgaatgaggagcagctggaggacatgaggcaggagctggtgcggcagtaccaggagcaccagcaggccacagagctgctgcggcaggcccacatgaggcagatggagcggcagcgggaggaccaggagcagctgcaggaggagatcaagaggctgaaccggcagctggcccagaggagcagcattgacaatgaaaacctggtgtctgagcgggagcgggtgctgctggaggagctggaggccctgaagcagctgagcctggccggccgggagaagctgtgctgtgagctgaggaacagcagcacccagacccagaatggaaatgaaaaccagggcgaggtggaggagcagaccttcaaggagaaggagctggacaggaagccagaagatgtgcccccagagatcctgagcaatgaaagatatgccctgcagaaggccaacaaccggctgctgaagatcctgctggaggtggtgaagaccacagctgctgtggaggagaccatcggccgccacgtgctgggcatcctggacaggagcagcaagagccagagcagcgccagcctcatctggaggtctgaggccgaggcctctgtgaagagctgtgtgcatgaggagcacaccagggtgacagatgagagcatccccagctacagcggcagtgacatgcccagaaatgacatcaacatgtggagcaaggtgacagaggagggcacagagctgagccagaggctggtgcgcagcggctttgctggaacagaaattgatcctgaaaatgaggagctgatgctgaacatcagcagccggctgcaggccgctgtggagaagctgctggaggccatcagcgagaccagcagccagctggagcacgccaaggtgacccagacagagctgatgagggagagcttccggcagaagcaggaggccacagagagcctgaagtgccaggaggagctgcgggagcggctgcacgaggagagccgggcccgggagcagctggccgtggagctgagcaaggccgagggcgtgattgatggctatgcagatgagaagaccctgtttgagcggcagatccaggagaagacagacatcatcgaccggctggagcaggagctgctgtgtgccagcaaccggctgcaggagctggaggccgagcagcagcagatccaggaggagcgggagctgctgagccggcagaaggaggccatgaaggccgaggccggccctgtggagcagcagctgctgcaggagacagagaagctgatgaaggagaagctggaggtgcagtgccaggccgagaaggtgagagatgacctgcagaagcaggtgaaggccctggagattgatgtggaggagcaggtgagccgcttcatcgagctggagcaggagaagaacacagagctgatggacctgcggcagcagaaccaggccctggagaagcagctggagaagatgaggaagttcctggatgagcaggccatcgaccgggagcacgagagagatgtgttccagcaggagatccagaagctggagcagcagctgaaggtggtgccccgcttccagcccatcagcgagcaccagacccgggaggtggagcagctggccaaccacctgaaggagaagacagacaagtgcagcgagctgctgctgagcaaggagcagctgcagagggacatccaggagagaaatgaggagattgagaagctggagttccgggtgcgggagctggagcaggccctgctggtggaggacaggaagcactttggagctgtggaggccaagccagagctgagcctggaggtgcagctgcaggccgagagagatgccatcgacaggaaggagaaggagatcaccaacctggaggagcagctggagcagttccgggaggagctggagaacaagaatgaggaggtgcagcagctgcacatgcagctggagatccagaagaaggagagcaccacccggctgcaggagctggagcaggagaacaagctgttcaaggatgacatggagaagctgggcctggccatcaaggagagtgatgccatgagcacccaggaccagcacgtgctgtttgggaagtttgcccagatcatccaggagaaggaggtggagattgaccagctgaatgagcaggtgaccaagctgcagcagcagctgaagatcaccacagacaacaaggtgattgaggagaagaatgaactcatccgggacctggagacccagatcgagtgcctgatgtctgaccaggagtgtgtgaagaggaaccgggaggaggagattgagcagctgaatgaagtcatcgagaagctgcagcaggagctggccaacatcggccagaagacctccatgaatgcccacagcctgtctgaggaggccgacagcctgaagcaccagctggatgtggtgattgctgagaagctggccctggagcagcaggtggagacagccaatgaggagatgaccttcatgaagaatgtgctgaaggagaccaacttcaagatgaaccagctgacccaggagctgttcagcctgaagcgggagcgggagagcgtggagaagatccagagcatccctgagaacagcgtgaatgtggccatcgaccacctgagcaaggacaagccagagctggaggtggtgctgacagaagatgccctgaagagcctggagaaccagacctacttcaagagctttgaggagaatggcaagggcagcatcatcaacctggagacccggctgctgcagctggagagcacagtgtctgccaaggacctggagctgacccagtgctacaagcagatcaaggacatgcaggagcagggccagtttgaaacagagatgctgcagaagaagatcgtgaacctgcagaagatcgtggaggagaaggtggccgccgccctggtgtcccagatccagctggaggccgtgcaggagtatgccaagttctgccaggacaaccagaccatcagcagcgagcctgagaggaccaacatccagaacctgaaccagctgcgggaggatgagctgggcagtgacatcagcgccctgaccctgcgcatcagcgagctggagagccaggtggtggagatgcacaccagcctcatcctggagaaggagcaggtggagattgctgagaagaatgtgctggagaaggagaagaagctgctggagctgcagaagctgctggagggcaatgagaagaagcagcgggagaaggagaagaagaggagcccccaggatgtggaggtgctgaagaccaccacagagctgttccacagcaatgaggagagcggcttcttcaatgagctggaggccctgcgggcagagagcgtggccaccaaggccgagctggccagctacaaggagaaggccgagaagctgcaggaggagctgctggtgaaggagaccaacatgaccagcctgcagaaggacctgagccaggtgcgggaccacctggccgaggccaaggagaagctgagcatcctggagaaggaggatgaaacagaggtgcaggagagcaagaaggcctgcatgtttgagcccctgcccatcaagctgagcaagagcatcgccagccagacagatggcaccctgaagatcagcagcagcaaccagaccccccagatcctggtgaagaatgccggcatccagatcaacctgcagagtgaatgtagcagcgaggaggtgacagagatcatcagccagttcacagagaagattgagaagatgcaggagctgcacgccgctgagatcctggacatggagagccgccacatcagcgagacagagaccctgaagcgggagcactacgtggccgtgcagctgctgaaggaggagtgtggcaccctgaaggctgtgatccagtgcctgcggagcaaggagggcagcagcatccctgagctggcccacagtgatgcctaccagacccgggagatctgcagcagtgacagcggcagtgactggggccagggcatctacctgacccacagccagggctttgatattgccagcgagggccgcggggaggagagcgagagcgccacagacagcttccccaagaagatcaagggcctgctgcgggctgtgcacaatgaaggcatgcaggtgctgagcctgacagagagcccctacagtgatggagaggaccacagcatccagcaggtgtctgagccctggctggaggagaggaaggcctacatcaacaccatcagcagcctgaaggacctgatcaccaagatgcagctgcagcgggaggccgaggtgtatgacagcagccagagccatgagagcttcagtgactggagaggagagctgctgctggccctgcagcaggtgttcctggaggagaggtctgtgctgctggccgccttcagaacagagctgacagccctgggcaccacagatgctgtgggcctgctgaactgcctggagcagaggatccaggagcagggcgtggagtaccaggccgccatggagtgcctgcagaaggctgacagaagaagcctgctgtctgagatccaggccctgcacgcccagatgaatggaaggaagatcaccctgaagcgggagcaggagagcgagaagcccagccaggagctgctggagtacaacatccagcagaagcagagccagatgctggagatgcaggtggagctgagctccatgaaggaccgggccacagagctgcaggagcagctgagcagcgagaagatggtggtggccgagctgaagtctgagctggcccagaccaagctggagctggagaccaccctgaaggcccagcacaagcacctgaaggagctggaggccttccggctggaggtgaaggacaagacagatgaggtgcacctgctgaatgacaccctggccagcgagcagaagaagagccgggagctgcagtgggccctggagaaggagaaggccaagctgggccgctctgaggagcgggacaaggaggagctggaggacctgaagttcagcctggagagccagaagcagaggaacctgcagctgaacctgctgctggagcagcagaagcagctgctgaatgaaagccagcagaagattgagagccagaggatgctgtatgatgcccagctgtctgaggagcagggcaggaacctggagctgcaggtgctgctggagagcgagaaggtgcgcatccgggagatgagcagcaccctggaccgggagcgggagctgcacgcccagctgcagagcagtgatggcaccggccagagcaggcctcccctgcccagcgaggacctgctgaaggagctgcagaagcagctggaggagaagcacagcagaattgtggagctgctgaatgaaacagagaagtacaagctggacagcctgcagacccggcagcagatggagaaggaccggcaggtgcacaggaagaccctgcagacagagcaggaggccaacacagagggccagaagaagatgcatgagctgcagagcaaggtggaggacctgcagaggcagctggaggagaagaggcagcaggtgtacaagctggacctggagggccagaggctgcagggcatcatgcaggagttccagaagcaggagctggagcgggaggagaagcgggagagccgccgcatcctgtaccagaacctgaatgagcccaccacctggagcctgaccagtgacaggaccaggaactgggtgctgcagcagaagattgaaggagagaccaaggagagcaactatgccaagctgattgagatgaatggaggcggcaccggctgcaaccacgagctggagatgatccggcagaagctgcagtgtgtggccagcaagctgcaggtgctgccccagaaggccagcgagcggctgcagtttgaaacagcagatgatgaggacttcatctgggtgcaggagaacattgatgagatcatcctgcagctgcagaagctgaccggccagcagggcgaggagcccagcctggtgagccccagcaccagctgtggcagcctgacagagcggctgctgcggcagaatgctgagctgaccggccacatcagccagctgacagaggagaagaatgacctgaggaacatggtgatgaagctggaggagcagatccgctggtaccggcagacaggagctggccgggacaacagcagccgcttcagcctgaatggaggagccaacatcgaggccatcatcgccagcgagaaggaggtgtggaaccgggagaagctgaccctgcagaagagcctgaagagagctgaggccgaggtgtacaagctgaaggccgagctgagaaatgacagcctgctgcagaccctgagcccagattctgaacatgtgaccctgaagaggatctacggcaagtacctgcgggcagagagcttcaggaaggccctgatctaccagaagaagtacctgctgctgctgctgggcggcttccaggagtgtgaagatgccaccctggccctgctggccaggatgggcggccagcctgccttcacagacctggaggtgatcaccaaccggcccaagggcttcacccgcttccgctctgctgtgcgggtgtccatcgccatcagcaggatgaagttcctggtgcggcgctggcaccgggtgactggatctgtgtccatcaacatcaacagagatggcttcggcctgaaccagggcgctgagaagacagacagcttctaccacagcagcggcggcctggagctgtatggagagcccaggcacaccacctaccgcagcagaagtgacctggactacatccgcagccccctgcccttccagaaccgctacccaggcaccccagctgacttcaaccctggcagcctggcctgcagccagctgcagaactatgacccctag

SEQ ID NO: 142062 - DNA, 1782 bp, Artificial Sequence
  Description of Artificial Sequence: Synthetic coding sequence
atggccatccagttccgcagcctcttccccctggccctgcccggcatgctggccctgctgggctggtggtggttcttcagcaggaagaagggccacgtgagcagccatgatgagcagcaggtggaggccggggctgtgcagctgcgggctgaccctgccatcaaggagcccctgcctgtggaggatgtgtgccccaaggtggtgtccaccccaccttctgtgacagagcccccagagaaggagctgagcacagtgtccaagctgcctgctgagcccccagccctgctgcagacccaccccccctgcagaagaagtgagagcagcggcatcctgcccaacaccacagacatgaggctgcggcccggcaccaggagagatgacagcaccaagctggagctggccctgaccggcggggaggccaagagcatccccctggagtgccccctgagcagccccaagggcgtgctcttcagcagcaagtctgctgaggtgtgcaagcaggacagccccttcagccgggtgcccaggaaggtgcagcccggctaccctgtggtgcctgctgagaagaggagcagcggggagcgggcccgggagactggaggagctgagggcactggagatgctgtgctgggggagaaggtgctggaggaggccctgctgagccgggagcacgtgctggagctggagaacagcaagggccccagcctggccagcctggagggggaggaggacaagggcaagagcagcagcagccaggtggtgggccctgtgcaggaggaggagtatgtggccgagaagctgcccagccgcttcatcgagagcgcccacacagagctggccaaggatgatgctgccccagcccctcctgtggctgatgccaaggcccaggacagaggagtggagggggagctgggcaatgaggagagcctggacagaaatgaggagggcctggacagaaatgaggagggcctggacagaaatgaggagagcctggacagaaatgaggagggcctggacagaaatgaggagatcaagagagctgccttccagatcatcagccaggtgatcagcgaggccacagagcaggtgctggccaccaccgtgggcaaggtggccggccgggtgtgccaggccagccagctgcagggccagaaggaggagagctgtgtgcctgtgcaccagaagacagtgctgggccctgacacagctgagcccgccacagctgaggccgctgtggcccccccagatgctggcctgcccctgcccggcctgcctgctgagggcagccccccacccaagacctacgtgtcctgcctgaagagcctgctgagcagccccaccaaggacagcaagcccaacatcagcgcccaccacatcagcctggccagctgcctggccctgaccaccccatctgaggagctgcctgaccgggccggcatcctggtggaggatgccacctgtgtgacctgcatgtctgacagcagccagagcgtgcccctggtggccagccctggccactgcagcgacagcttcagcaccagcggcctggaggacagctgcacagagaccagcagcagcccccgggacaaggccatcaccccacccctgcctgagagcacagtgcccttcagcaatggagtgctgaagggggagctgagtgacctgggcgcagaagatggctggaccatggatgctgaggccgaccacagcggcgtggccgcccctcctcctgggaagaggggcaccctcatcacccgctgccccggcttctttgagtgctag

SEQ ID NO: 142063 - DNA, 2712 bp, Artificial Sequence
  Description of Artificial Sequence: Synthetic coding sequence
atggccatccagttccgcagcctcttccccctggccctgcccggcatgctggccctgctgggctggtggtggttcttcagcaggaagaagggccacgtgagcagccatgatgagcagcaggtggaggccggggctgtgcagctgcgggctgaccctgccatcaaggagcccctgcctgtggaggatgtgtgccccaaggtggtgtccaccccaccttctgtgacagagcccccagagaaggagctgagcacagtgtccaagctgcctgctgagcccccagccctgctgcagacccaccccccctgcagaagaagtgagagcagcggcatcctgcccaacaccacagacatgaggctgcggcccggcaccaggagagatgacagcaccaagctggagctggccctgaccggcggggaggccaagagcatccccctggagtgccccctgagcagccccaagggcgtgctcttcagcagcaagtctgctgaggtgtgcaagcaggacagccccttcagccgggtgcccaggaaggtgcagcccggctaccctgtggtgcctgctgagaagaggagcagcggggagcgggcccgggagactggaggagctgagggcactggagatgctgtgctgggggagaaggtgctggaggaggccctgctgagccgggagcacgtgctggagctggagaacagcaagggccccagcctggccagcctggagggggaggaggacaagggcaagagcagcagcagccaggtggtgggccctgtgcaggaggaggagtatgtggccgagaagctgcccagccgcttcatcgagagcgcccacacagagctggccaaggatgatgctgccccagcccctcctgtggctgatgccaaggcccaggacagaggagtggagggggagctgggcaatgaggagagcctggacagaaatgaggagggcctggacagaaatgaggagggcctggacagaaatgaggagagcctggacagaaatgaggagggcctggacagaaatgaggagatcaagagagctgccttccagatcatcagccaggtgatcagcgaggccacagagcaggtgctggccaccaccgtgggcaaggtggccggccgggtgtgccaggccagccagctgcagggccagaaggaggagagctgtgtgcctgtgcaccagaagacagtgctgggccctgacacagctgagcccgccacagctgaggccgctgtggcccccccagatgctggcctgcccctgcccggcctgcctgctgagggcagccccccacccaagacctacgtgtcctgcctgaagagcctgctgagcagccccaccaaggacagcaagcccaacatcagcgcccaccacatcagcctggccagctgcctggccctgaccaccccatctgaggagctgcctgaccgggccggcatcctggtggaggatgccacctgtgtgacctgcatgtctgacagcagccagagcgtgcccctggtggccagccctggccactgcagcgacagcttcagcaccagcggcctggaggacagctgcacagagaccagcagcagcccccgggacaaggccatcaccccacccctgcctgagagcacagtgcccttcagcaatggagtgctgaagggggagctgagtgacctgggcgcagaagatggctggaccatggatgctgaggccgaccacagcggcggcagtgacagaaattccatggacagcgtggacagctgctgcagcctgaagaagacagagagcttccagaatgcccaggccggcagcaaccccaagaaggtggacctgatcatctgggagattgaggtgcccaagcacctggtgggccgcctgattggcaagcagggccgctacgtgtccttcctgaagcagaccagcggggccaagatctacatcagcaccctgccctacacccagagcgtgcagatctgccacatcgagggcagccagcaccacgtggacaaggccctgaacctgattggcaagaagttcaaggagctgaacctgaccaacatctatgccccacccctgcccagcctggccctgcccagcctgcccatgacctcctggctgatgctgcctgatggcatcaccgtggaggtgattgtggtgaaccaggtgaatgccggccacctgtttgtgcagcagcacacccaccccaccttccacgccctgcggagcctggaccagcagatgtacctgtgctacagccagcccggcatccccaccctgcccacccctgtggagatcaccgtcatctgtgccgcccctggagcagatggagcctggtggagggcccaggtggtggccagctatgaggagaccaatgaggtggagatccgctacgtggactatggaggctacaagagggtgaaggtggatgtgctgcggcagatccgcagtgactttgtgaccctgcccttccagggcgctgaggtgctgctggacagcgtgatgcccctgagtgatgatgaccagttcagccctgaggctgatgctgccatgtctgagatgacaggcaacacagccctgctggcccaggtgaccagctacagccccaccggcctgcccctcatccagctgtggagcgtggtgggagatgaggtggtgctgatcaacagaagcctggtggagcggggcctggcccagtgggtggacagctactacaccagcctgtag

SEQ ID NO: 142064 - DNA, 2838 bp, Artificial Sequence
  Description of Artificial Sequence: Synthetic coding sequence
atgggcgccctgggcgtgtctggcagcagcagccctgggggctgccccggctggaggcggctgcctgctgctgtgaacaccaaccctgtggactttgcccctggggtcatcacccaggccagcaggatggccatccagttccgcagcctcttccccctggccctgcccggcatgctggccctgctgggctggtggtggttcttcagcaggaagaagggccacgtgagcagccatgatgagcagcaggtggaggccggggctgtgcagctgcgggctgaccctgccatcaaggagcccctgcctgtggaggatgtgtgccccaaggtggtgtccaccccaccttctgtgacagagcccccagagaaggagctgagcacagtgtccaagctgcctgctgagcccccagccctgctgcagacccaccccccctgcagaagaagtgagagcagcggcatcctgcccaacaccacagacatgaggctgcggcccggcaccaggagagatgacagcaccaagctggagctggccctgaccggcggggaggccaagagcatccccctggagtgccccctgagcagccccaagggcgtgctcttcagcagcaagtctgctgaggtgtgcaagcaggacagccccttcagccgggtgcccaggaaggtgcagcccggctaccctgtggtgcctgctgagaagaggagcagcggggagcgggcccgggagactggaggagctgagggcactggagatgctgtgctgggggagaaggtgctggaggaggccctgctgagccgggagcacgtgctggagctggagaacagcaagggccccagcctggccagcctggagggggaggaggacaagggcaagagcagcagcagccaggtggtgggccctgtgcaggaggaggagtatgtggccgagaagctgcccagccgcttcatcgagagcgcccacacagagctggccaaggatgatgctgccccagcccctcctgtggctgatgccaaggcccaggacagaggagtggagggggagctgggcaatgaggagagcctggacagaaatgaggagggcctggacagaaatgaggagggcctggacagaaatgaggagagcctggacagaaatgaggagggcctggacagaaatgaggagatcaagagagctgccttccagatcatcagccaggtgatcagcgaggccacagagcaggtgctggccaccaccgtgggcaaggtggccggccgggtgtgccaggccagccagctgcagggccagaaggaggagagctgtgtgcctgtgcaccagaagacagtgctgggccctgacacagctgagcccgccacagctgaggccgctgtggcccccccagatgctggcctgcccctgcccggcctgcctgctgagggcagccccccacccaagacctacgtgtcctgcctgaagagcctgctgagcagccccaccaaggacagcaagcccaacatcagcgcccaccacatcagcctggccagctgcctggccctgaccaccccatctgaggagctgcctgaccgggccggcatcctggtggaggatgccacctgtgtgacctgcatgtctgacagcagccagagcgtgcccctggtggccagccctggccactgcagcgacagcttcagcaccagcggcctggaggacagctgcacagagaccagcagcagcccccgggacaaggccatcaccccacccctgcctgagagcacagtgcccttcagcaatggagtgctgaagggggagctgagtgacctgggcgcagaagatggctggaccatggatgctgaggccgaccacagcggcggcagtgacagaaattccatggacagcgtggacagctgctgcagcctgaagaagacagagagcttccagaatgcccaggccggcagcaaccccaagaaggtggacctgatcatctgggagattgaggtgcccaagcacctggtgggccgcctgattggcaagcagggccgctacgtgtccttcctgaagcagaccagcggggccaagatctacatcagcaccctgccctacacccagagcgtgcagatctgccacatcgagggcagccagcaccacgtggacaaggccctgaacctgattggcaagaagttcaaggagctgaacctgaccaacatctatgccccacccctgcccagcctggccctgcccagcctgcccatgacctcctggctgatgctgcctgatggcatcaccgtggaggtgattgtggtgaaccaggtgaatgccggccacctgtttgtgcagcagcacacccaccccaccttccacgccctgcggagcctggaccagcagatgtacctgtgctacagccagcccggcatccccaccctgcccacccctgtggagatcaccgtcatctgtgccgcccctggagcagatggagcctggtggagggcccaggtggtggccagctatgaggagaccaatgaggtggagatccgctacgtggactatggaggctacaagagggtgaaggtggatgtgctgcggcagatccgcagtgactttgtgaccctgcccttccagggcgctgaggtgctgctggacagcgtgatgcccctgagtgatgatgaccagttcagccctgaggctgatgctgccatgtctgagatgacaggcaacacagccctgctggcccaggtgaccagctacagccccaccggcctgcccctcatccagctgtggagcgtggtgggagatgaggtggtgctgatcaacagaagcctggtggagcggggcctggcccagtgggtggacagctactacaccagcctgtag

SEQ ID NO: 142065 - DNA, 2712 bp, Artificial Sequence; identical to SEQ ID NO: 142063
  Description of Artificial Sequence: Synthetic coding sequence

SEQ ID NO: 142066 - DNA, 1095 bp, Artificial Sequence
  Description of Artificial Sequence: Synthetic coding sequence
atgggcatcctggagaagatcagcgagattgagaaggagatcgcccggacccagaagaacaaggccacagagtaccacctgggcctgctgaaggccaagctggccaagtaccgggcccagctgctggagcccagcaagagcgccagcagcaaaggagagggctttgatgtgatgaagtctggagatgcccgggtggccctgattggcttccccagcgtgggcaagagcaccttcctgagcctgatgaccagcacagccagcgaggccgccagctatgagttcaccaccctgacctgcatccctggggtcatcgagtacaagggggccaacatccagctgctggacctgcccggcatcatcgagggcgccgcccagggcaagggccggggccggcaggtgattgctgtggccaggacagcagatgtgatcatcatgatgctggatgccaccaagggggaggtgcagaggagcctgctggagaaggagctggagagcgtgggcatccggctgaacaagcacaagcccaacatctacttcaagcccaagaagggcggcggcatctccttcaacagcacagtgaccctgacccagtgcagcgagaagctggtgcagctgatcctgcacgagtacaagatcttcaatgctgaggtgctcttccgggaggactgcagcccagatgagttcattgatgtgattgtgggcaacagagtgtacatgccctgcctgtatgtgtacaacaagattgaccagatctccatggaggaggtggaccggctggccaggaagcccaacagcgtggtgatcagctgtggcatgaagctgaacctggactacctgctggagatgctgtgggagtacctggccctgacctgcatctacaccaagaagaggggccagaggccagacttcacagatgccatcatcctgaggaaaggagcctctgtggagcacgtgtgccaccgcatccacaggagcctggccagccagttcaagtatgccctggtgtggggcaccagcaccaagtacagcccccagagggtgggcctgacccacaccatggagcatgaagatgtgatccagatcgtgaagaagtag

SEQ ID NO: 142067 - DNA, 1815 bp, Artificial Sequence
  Description of Artificial Sequence: Synthetic coding sequence
atgagaggagctggccccagcccccggcagagccccaggaccctgcggccagaccccggccctgccatgtccttcttccggaggaaggtgaagggcaaggagcaggagaagaccagtgatgtgaagagcatcaaggccagcatctctgtgcacagcccccagaagagcaccaagaaccacgccctgctggaggccgccggccccagccacgtggccatcaatgccatcagcgccaacatggacagcttcagcagcagcaggacagccaccctgaagaagcagcccagccacatggaggccgcccactttggagacctgggccgcagctgcctggactaccagacccaggagaccaagagcagcctgagcaagaccctggagcaggtgctgcatgacaccatcgtgctgccctacttcatccagttcatggagctgcggaggatggagcacctggtgaagttctggctggaggccgagagcttccacagcaccacctggagccgcatccgggcccacagcctgaacacagtgaagcagagcagcctggccgagcctgtgagccccagcaagaagcatgagaccacagccagcttcctgacagacagcctggacaagaggctggaggacagcggcagcgcccagctgttcatgacccacagcgagggcatcgacctgaacaacagaaccaacagcacccagaaccacctgctgctgagccaggagtgtgacagcgcccacagcctgcggctggagatggcccgggccggcacccaccaggtgtccatggagacccaggagagcagcagcaccctgactgtggccagcaggaacagccctgccagccccctgaaggagctgagcggcaagctgatgaagagcattgagcaggatgctgtgaacaccttcaccaagtacatcagcccagatgctgccaagcccatccccatcacagaggccatgagaaatgacatcatcgcccgcatctgtggagaagatggccaggtggaccccaactgctttgtgctggcccagagcatcgtgttttctgccatggagcaggagcacttcagcgagttcctgcggagccaccacttctgcaagtaccagatcgaggtgctgaccagcggcaccgtgtacctggccgacatcctcttctgtgagagcgccctcttctacttcagcgagtacatggagaaggaggatgctgtgaacatcctgcagttctggctggccgctgacaacttccagagccagctggccgccaagaagggccagtatgatggccaggaggcccagaatgatgccatgatcctgtatgacaagtacttcagcctgcaggccacccaccccctgggctttgatgatgtggtgcggctggagattgagagcaacatctgccgggagggcggccccctgcccaactgcttcaccacccccctgcggcaggcctggaccaccatggagaagagctctgtgaagaaggccagcatcaagatcctgaagaactttgatgaggccatcatcgtggatgctgccagcctggaccctgagagcctgtaccagaggacctacgccggcaagatgaccttcggccgggtgtctgacctgggccagttcatccgggagagcgagcctgagccagatgtgaggaagagcaagggctccatgttcagccaggccatgaagaagtgggtgcagggcaacacagatgaggcccaggaggagctggcctggaagatcgccaagatgattgtgtctgacatcatgcagcaggcccagtatgaccagcccctggagaagagcaccaaggtgtag

SEQ ID NO: 142068 - DNA, 8454 bp, Artificial Sequence
  Description of Artificial Sequence: Synthetic coding sequence
atgaagctgaacccccagcaggcccccctgtatggagactgtgtggtgacagtgctgctggccgaggaggacaaggcagaagatgatgtggtgttctacctggtgttcctgggcagcaccctgcggcactgcaccagcaccaggaaggtgtccagtgacaccctggagaccatcgcccctggccatgactgctgtgaaacagtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggcccccccagcggagatgtgaacagcctggacaagaagctggtgctggccttccgccacctgaagctgcccacagagtggaatgtgctgggcacagaccagagcctgcatgatgctggcccccgggagaccctgatgcactttgctgtgcggctgggcctgctgcggctgacctggttcctgctgcagaagccaggcggccgcggggccctgagcatccacaaccaggagggcgccacccctgtgtccctggccctggagcggggctaccacaagctgcaccagctgctgacagaggagaatgctggggagccagacagctggagcagcctgtcctatgagatcccctatggagactgcagcgtgcgccaccaccgggagctggacatctacaccctgaccagcgagagtgacagccaccacgagcaccccttccctggagatggctgcaccggccccatcttcaagctgatgaacatccagcagcagctgatgaagaccaacctgaagcagatggacagcctgatgcccctgatgatgacagcccaggaccccagcagcgcccctgagacagatggccagttcctgccctgtgcccctgagcccacagacccccagaggctgagcagcagcgaggagacagagagcacccagtgctgccccggcagccctgtggcccagacagagagcccctgtgacctgagcagcatcgtggaggaggagaacacagacaggagctgcaggaagaagaacaagggcgtggagaggaaaggagaggaggtggagcccgcccccatcgtggacagcggcaccgtgtctgaccaggacagctgcctgcagagcctgcctgactgtggggtgaagggcacagagggcctgagcagctgtggcaacagaaatgaggagaccggcaccaagagcagcggcatgcccacagaccaggagagcctgagcagtggagatgctgtgctgcagagggacctggtgatggagcccggcacagcccagtacagcagtggaggagagctgggcggcatcagcaccaccaacgtgtccaccccagacacagctggggagatggagcacggcctgatgaacccagatgccaccgtgtggaagaatgtgctgcagggcggggagagcaccaaggagagatttgagaacagcaacattggaacagctggggccagtgatgtgcacgtgaccagcaagcctgtggacaagatctctgtgcccaactgtgccccagctgccagcagcctggatggcaacaagccagctgagagcagcctggccttcagcaatgaggagaccagcacagagaagacagctgagacagagaccagccgcagccgggaggagagcgcagatgcccctgtggaccagaacagcgtggtgatcccagctgctgccaaggacaagatcagtgatggcctggagccctacaccctgctggccgccggcattggagaggccatgagccccagcgacctggccctgctgggcctggaggaggatgtgatgccccaccagaacagcgagaccaacagcagccacgcccagagccagaagggcaagagcagccccatctgcagcaccactggagatgacaagctgtgtgccgacagcgcctgccagcagaacacagtgaccagcagcggggacctggtggccaagctgtgtgacaacatcgtgtctgagagcgagagcaccacagcccggcagcccagcagccaggaccccccagatgccagccactgtgaggacccccaggcccacacagtgaccagtgaccctgtgcgggacacccaggagagagctgacttctgccccttcaaggtggtggacaacaagggccagaggaaggatgtgaagctggacaagcccctgaccaacatgctggaggtggtgagccacccccaccctgtggtgcccaagatggagaaggagctggtgcctgaccaggccgtcatcagtgacagcaccttcagcctggccaacagccctggcagcgagagcgtgaccaaggatgatgccctgagctttgtgcccagccagaaggagaagggcacagccaccccagagctgcacacagccacagactacagagatggcccagatggcaacagcaatgaaccagacacccggcccctggaggacagagctgtgggcctgagcaccagcagcacagctgctgagctgcagcacggcatgggcaacaccagcctgaccggcctgggcggggagcacgagggccctgcccccccagccatccctgaggccctgaacatcaagggcaacacagacagcagcctgcagagcgtgggcaaggccaccctggccctggacagcgtgctgacagaggagggcaagctgctggtggtgtctgagagcagcgctgcccaggagcaggacaaggacaaggctgtgacctgcagcagcatcaaggaaaatgccctgagcagcggcaccctgcaggaggagcagaggaccccacctcctggccaggacacccagcagttccacgagaagagcatctctgctgactgtgccaaggacaaggccctgcagctgagcaacagccctggggccagcagcgccttcctgaaggccgagacagagcacaacaaggaggtggccccccaggtgtccctgctgacccagggcggggccgcccagagcctggtgcccccaggggccagcctggccacagagagccggcaggaggccctgggcgctgagcacaacagcagcgccctgctgccctgcctgctgcctgatggcagtgatggcagtgatgccctgaactgcagccagcccagccccctggatgtgggcgtgaagaacacccagagccagggcaagaccagcgcctgtgaggtgtctggagatgtgacagtggatgtgactggagtgaatgccctgcagggcatggccgagccccggcgggagaacatcagccacaacacccaggacatcctgatccccaacgtgctgctgagccaggagaagaatgctgtgctgggcctgcctgtggccctgcaggacaaggctgtgacagacccccagggcgtgggcaccccagagatgatccccctggactgggagaagggcaagctggagggcgctgaccacagctgcaccatgggagatgctgaggaggcccagattgatgatgaggcccaccctgtgctgctgcagcctgtggccaaggagctgcccacagacatggagctgagcgcccatgatgatggagccccagctggggtgcgggaggtgatgagggcccctccttctggccgggagaggagcacccccagcctgccctgcatggtgtctgcccaggatgcccccctgcccaagggagctgacctgattgaggaggccgccagcagaattgtggatgctgtgattgagcaggtgaaggccgccggggccctgctgacagaaggagaggcctgccacatgagcctgagcagccctgagctgggccccctgaccaagggcctggagagcgccttcacagagaaggtgtccaccttccccccaggagagagcctgcccatgggcagcaccccagaggaggccaccggcagcctggccggctgctttgctggccgggaggagcctgagaagatcatcctgcctgtgcagggccctgagcctgctgctgagatgccagatgtgaaggccgaggatgaggtggacttccgggccagcagcatcagcgaggaggtggccgtgggcagcattgctgccaccctgaagatgaagcagggccccatgacccaggccatcaaccgggagaactggtgcaccatcgagccctgcccagatgctgccagcctgctggccagcaagcagagcccagaatgtgagaacttcctggatgtgggcctgggcagagaatgtaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttccgccgccacagctggggccctgggaagaatgctgccagtgatgctgagatgaaccaccgctccatgtcctggtgccccagcggcgtgcagtacagcgctggcctgtctgctgacttcaactaccgctccttcagcctggagggcctgactggaggagctggggtgggcaacaagcccagcagcagcctggaggtgagcagcgccaatgctgaggagctgcggcaccccttctctggagaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaaggagaaggagaaggagaaggacaagatcaaggagaaggagaaggacagcaaggacaaggagaaggacaagaagacagtgaatggccacaccttcagcagcatccctgtggtgggccccatcagctgcagccagtgcatgaagcccttcaccaacaaggatgcctacacctgtgccaactgcagcgcctttgtgcacaagggctgccgggagagcctggccagctgtgccaaggtgaagatgaagcagcccaagggcagcctgcaggcccatgacaccagcagcctgcccaccgtcatcatgaggaacaagcccagccagcccaaggagcggcccaggtctgctgtgctgctggtggatgaaacagccaccacccccatctttgccaacagaagaagccagcagagcgtgtccctgagcaagtctgtgtccatccagaacatcactggagtgggcaatgatgagaacatgagcaacacctggaagttcctgagccacagcacagacagcctgaacaagatcagcaaggtgaatgaaagcacagagagcctgacagatgagggcgtgggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttcagcggggagaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggctctgtgttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagagaaattcctggatccagatcatccaggacaccatcaacaccctgaacagagatgaagatgagggcatccccagtgaaaatgaggaggagaagaagatgctggacacccgggcccgggagctgaaggagcagctgcaccagaaggaccagaagatcctgctgctgctggaggagaaggagatgatcttccgggacatggccgagtgcagcacccccctgcctgaggactgcagccccacccacagcccccgggtgctcttccgcagcaacacagaggaggccctgaagggcggccccctgatgaagagcgccatcaatgaggtggagatcctgcagggcctggtgtctggcaacctgggcggcaccctgggccccaccgtgagcagccccatcgagcaggatgtggtgggccctgtgtccctgcccaggagagctgagaccttcggcggctttgacagccaccagatgaatgccagcaagggcggggagaaggaggagggagatgatggccaggacctgcggaggacagaaagtgacagcggcctgaagaagggcggcaatgccaacctggtgttcatgctgaagaggaacagcgagcaggtggtgcagagcgtggtgcacctgtatgagctgctgagcgccctgcagggcgtggtgctgcagcaggacagctacatcgaggaccagaagctggtgctgtctgagcgggccctgaccaggagcctgagccggcccagcagcctgattgagcaggagaagcagaggagcctggagaagcagaggcaggacctggccaacctgcagaagcagcaggcccagtacctggaggagaagagaagaagagagcgggagtgggaggcccgggagcgggagctgcgggagcgggaggccctgctggcccagcgggaggaggaggtgcagcagggccagcaggacctggagaaggagcgggaggagctgcagcagaagaagggcacctaccagtatgacctggagcggctgcgggccgcccagaagcagctggagcgggagcaggagcagctgcggcgggaggccgagcggctgagccagaggcagacagagcgggacctgtgccaggtgagccacccccacaccaagctgatgaggatccccagcttcttccccagccctgaggagccccccagccccagcgcccccagcatcgccaagagcggcagcctggacagcgagctgtctgtgagccccaagagaaattccatcagcaggacccacaaggacaagggccccttccacatcctgagcagcaccagccagaccaacaagggccctgagggccagagccaggccccagccagcaccagcgccagcacccggctgtttggcctgaccaagcccaaggagaagaaggagaagaagaagaagaacaagaccagccgcagccagcctggagatggccctgccagcgaggtgtctgctgagggggaggagatcttctgctag

SEQ ID NO: 142069 - DNA, 3177 bp, Artificial Sequence
  Description of Artificial Sequence: Synthetic coding sequence
atgagcagcagcaagaagagcaaggagaaggagaaggagaaggacaagatcaaggagaaggagaaggacagcaaggacaaggagaaggacaagaagacagtgaatggccacaccttcagcagcatccctgtggtgggccccatcagctgcagccagtgcatgaagcccttcaccaacaaggatgcctacacctgtgccaactgcagcgcctttgtgcacaagggctgccgggagagcctggccagctgtgccaaggtgaagatgaagcagcccaagggcagcctgcaggcccatgacaccagcagcctgcccaccgtcatcatgaggaacaagcccagccagcccaaggagcggcccaggtctgctgtgctgctggtggatgaaacagccaccacccccatctttgccaacagaagaagccagcagagcgtgtccctgagcaagtctgtgtccatccagaacatcaccggggtgggcaatgatgagaacatgagcaacacctggaagttcctgagccacagcacagacagcctgaacaagatcagcaaggtgaatgaaagcacagagagcctgacagatgaaggagtgggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttctctggagaaaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggcagcgtcttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagaggaacagctggatccagatcatccaggacaccatcaacaccctgaacagagatgaagatgagggcatccccagtgaaaatgaggaggagaagaagatgctggacacccgggcccgggagctgaaggagcagctgcaccagaaggaccagaagatcctgctgctgctggaggagaaggagatgatcttccgggacatggctgaatgttccacccccctgcctgaggactgcagccccacccacagcccccgggtgctcttccgcagcaacacagaggaggccctgaagggcggccccctgatgaagagcgccatcaatgaggtggagatcctgcagggcctggtgtctggcaacctgggcggcaccctgggccccaccgtgagcagccccatcgagcaggatgtggtgggccctgtgtccctgccccggcgggcagagacctttggaggctttgacagccaccagatgaatgccagcaaaggaggagagaaggaggagggagatgatggccaggacctgcggaggacagaaagtgacagcggcctgaagaagggcggcaatgccaacctggtgttcatgctgaagagaaattctgagcaggtggtgcagagcgtggtgcacctgtatgagctgctgagcgccctgcagggcgtggtgctgcagcaggacagctacatcgaggaccagaagctggtgctgtctgagcgggccctgaccaggagcctgagccggcccagcagcctcatcgagcaggagaagcagaggagcctggagaagcagaggcaggacctggccaacctgcagaagcagcaggcccagtacctggaggagaagagaagaagagagcgggagtgggaggcccgggagcgggagctgcgggagcgggaggccctgctggcccagcgggaggaggaggtgcagcagggccagcaggacctggagaaggagcgggaggagctgcagcagaagaagggcacctaccagtatgacctggagcggctgcgggccgcccagaagcagctggagcgggagcaggagcagctgcggcgggaggccgagcggctgagccagaggcagacagagcgggacctgtgccaggtgagccacccccacaccaagctgatgaggatccccagcttcttccccagccctgaggagccccccagccccagcgcccccagcatcgccaagagcggcagcctggacagcgagctgtctgtgagccccaagaggaacagcatcagcaggacccacaaggacaagggccccttccacatcctgagcagcaccagccagaccaacaagggccctgagggccagagccaggccccagccagcaccagcgccagcacccggctgtttggcctgaccaagcccaaggagaagaaggagaagaagaagaagaacaagaccagccgcagccagcctggagatggccctgccagcgaggtgtctgctgagggggaggagatcttctgctag

SEQ ID NO: 142070 - DNA, 8451 bp, Artificial Sequence
  Description of Artificial Sequence: Synthetic coding sequence
aagctgctggagaagcagccccccattgaaggagactgtgtggtgacagtgctgctggccgaggaggacaaggccgaggatgatgtggtgttctacctggtgttcctgggcagcaccctgcggcactgcaccagcaccaggaaggtgtccagtgacaccctggagaccatcgcccctggccatgactgctgtgagaccgtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggccccccatctggagatgtgaacagcctggacaagaagctggtgctggccttccgccacctgaagctgcccacagagtggaatgtgctgggcacagaccagagcctgcatgatgctggcccccgggagaccctgatgcactttgctgtgcggctgggcctgctgcggctgacctggttcctgctgcagaagccaggcggccgcggggccctgagcatccacaaccaggagggcgccacccctgtgtccctggccctggagcggggctaccacaagctgcaccagctgctgacagaagaaaatgctggggagccagacagctggagcagcctgtcctatgagatcccctacggggactgcagcgtgcgccaccaccgggagctggacatctacaccctgaccagcgagagtgacagccaccacgagcaccccttccctggagatggctgcaccggccccatcttcaagctgatgaacatccagcagcagctgatgaagaccaacctgaagcagatggacagcctgatgcccctgatgatgacagcccaggaccccagcagcgcccctgagacagatggccagttcctgccctgtgcccctgagcccacagacccccagaggctgagcagcagcgaggagacagagagcacccagtgctgccccggcagccctgtggcccagacagagagcccctgtgacctgagcagcatcgtggaggaggagaacacagacaggagctgcaggaagaagaacaagggcgtggagaggaagggggaggaggtggagcccgcccccatcgtggacagcggcaccgtgtctgaccaggacagctgcctgcagagcctgcctgactgtggggtgaagggcacagagggcctgagcagctgtggcaacagaaatgaggagaccggcaccaagagcagcggcatgcccacagaccaggagagcctgagcagtggagatgctgtgctgcagagggacctggtgatggagcctggaacagcccagtacagcagcggcggggagctgggcggcatcagcaccaccaacgtgtccaccccagacacagctggggagatggagcacggcctgatgaacccagatgccaccgtgtggaagaatgtgctgcagggcggggagagcaccaaggagagatttgagaacagcaacatcggcacagctggggccagtgatgtgcacgtgaccagcaagcctgtggacaagatctctgtgcccaactgtgccccagctgccagcagcctggatggcaacaagccagctgagagcagcctggccttcagcaatgaggagaccagcacagagaagacagctgagacagagaccagccgcagccgggaggagagcgcagatgcccctgtggaccagaacagcgtggtgatcccagctgctgccaaggacaagatcagtgatggcctggagccctacaccctgctggccgccggcatcggggaggccatgagccccagcgacctggccctgctgggcctggaggaggatgtgatgccccaccagaacagcgagaccaacagcagccacgcccagagccagaagggcaagagcagccccatctgcagcaccactggagatgacaagctgtgtgccgacagcgcctgccagcagaacacagtgaccagcagcggggacctggtggccaagctgtgtgacaacatcgtgtctgagagcgagagcaccacagcccggcagcccagcagccaggaccccccagatgccagccactgtgaggacccccaggcccacacagtgaccagtgaccctgtgcgggacacccaggagagagctgacttctgccccttcaaggtggtggacaacaagggccagaggaaggatgtgaagctggacaagcccctgaccaacatgctggaggtggtgagccacccccaccctgtggtgcccaagatggagaaggagctggtgcctgaccaggccgtcatcagtgacagcaccttcagcctggccaacagccctggcagcgagagcgtgaccaaggatgatgccctgagctttgtgcccagccagaaggagaagggcacagccaccccagagctgcacacagccacagactacagagatggcccagatggcaacagcaatgaaccagacacccggcccctggaggacagagctgtgggcctgagcaccagcagcacagctgctgagctgcagcacggcatgggcaacaccagcctgaccggcctgggcggggagcacgagggccctgcccccccagccatccctgaggccctgaacatcaagggcaacacagacagcagcctgcagagcgtgggcaaggccaccctggccctggacagcgtgctgacagaggagggcaagctgctggtggtgtctgagagcagcgctgcccaggagcaggacaaggacaaggctgtgacctgcagcagcatcaaggaaaatgccctgagcagcggcaccctgcaggaggagcagaggaccccacctcctggccaggacacccagcagttccacgagaagagcatctctgctgactgtgccaaggacaaggccctgcagctgagcaacagccctggggccagcagcgccttcctgaaggccgagacagagcacaacaaggaggtggccccccaggtgtccctgctgacccagggcggggccgcccagagcctggtgcccccaggggccagcctggccacagagagccggcaggaggccctgggcgctgagcacaacagcagcgccctgctgccctgcctgctgcctgatggcagtgatggcagtgatgccctgaactgcagccagcccagccccctggatgtgggcgtgaagaacacccagagccagggcaagaccagcgcctgtgaggtgtctggagatgtgacagtggatgtgactggagtgaatgccctgcagggcatggccgagccccggcgggagaacatcagccacaacacccaggacatcctgatccccaacgtgctgctgagccaggagaagaatgctgtgctgggcctgcctgtggccctgcaggacaaggctgtgacagacccccagggcgtgggcaccccagagatgatccccctggactgggagaagggcaagctggagggcgctgaccacagctgcaccatgggagatgctgaggaggcccagattgatgatgaggcccaccctgtgctgctgcagcctgtggccaaggagctgcccacagacatggagctgagcgcccatgatgatggagccccagctggggtgcgggaggtgatgagggccccacccagcggccgggagaggagcacccccagcctgccctgcatggtgtctgcccaggatgcccccctgcccaagggagctgacctgattgaggaggccgccagccgcatcgtggatgctgtgattgagcaggtgaaggctgctggggccctgctgacagaaggagaggcctgccacatgagcctgagcagccctgagctgggccccctgaccaagggcctggagagcgccttcacagagaaggtgtccaccttccccccaggagagagcctgcccatgggcagcaccccagaggaggccaccggcagcctggccggctgctttgctggccgggaggagcctgagaagatcatcctgcctgtgcagggccctgagcctgctgctgagatgccagatgtgaaggcagaagatgaggtggacttccgggccagcagcatcagcgaggaggtggccgtgggcagcattgctgccaccctgaagatgaagcagggccccatgacccaggccatcaaccgggagaactggtgcaccatcgagccctgcccagatgctgccagcctgctggccagcaagcagagcccagaatgtgagaacttcctggatgtgggcctgggccgggagtgcaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttcagaagacacagctggggccctgggaagaatgctgccagtgatgctgagatgaaccaccgctccatgtcctggtgccccagcggcgtgcagtacagcgctggcctgtctgctgacttcaactaccgctccttcagcctggagggcctgaccggcggggccggcgtgggcaacaagcccagcagcagcctggaggtgtcctctgccaatgctgaggagctgcggcaccccttcagcggggaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaaggagaaggagaaggagaaggacaagatcaaggagaaggagaaggacagcaaggacaaggagaaggacaagaagacagtgaatggccacaccttcagcagcatccctgtggtgggccccatcagctgcagccagtgcatgaagcccttcaccaacaaggatgcctacacctgtgccaactgcagcgcctttgtgcacaagggctgccgggagagcctggccagctgtgccaaggtgaagatgaagcagcccaagggcagcctgcaggcccatgacaccagcagcctgcccaccgtcatcatgaggaacaagcccagccagcccaaggagcggcccaggtctgctgtgctgctggtggatgaaacagccaccacccccatctttgccaacagaagaagccagcagagcgtgtccctgagcaagtctgtgtccatccagaacatcaccggggtgggcaatgatgagaacatgagcaacacctggaagttcctgagccacagcacagacagcctgaacaagatcagcaaggtgaatgaaagcacagagagcctgacagatgaaggagtgggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttctctggagaaaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggcagcgtcttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagaggaacagctggatccagatcatccaggacaccatcaacaccctgaacagagatgaagatgagggcatccccagtgaaaatgaggaggagaagaagatgctggacacccgggcccgggagctgaaggagcagctgcaccagaaggaccagaagatcctgctgctgctggaggagaaggagatgatcttccgggacatggctgaatgttccacccccctgcctgaggactgcagccccacccacagcccccgggtgctcttccgcagcaacacagaggaggccctgaagggcggccccctgatgaagagcgccatcaatgaggtggagatcctgcagggcctggtgtctggcaacctgggcggcaccctgggccccaccgtgagcagccccatcgagcaggatgtggtgggccctgtgtccctgccccggcgggcagagacctttggaggctttgacagccaccagatgaatgccagcaaaggaggagagaaggaggagggagatgatggccaggacctgcggaggacagaaagtgacagcggcctgaagaagggcggcaatgccaacctggtgttcatgctgaagagaaattctgagcaggtggtgcagagcgtggtgcacctgtatgagctgctgagcgccctgcagggcgtggtgctgcagcaggacagctacatcgaggaccagaagctggtgctgtctgagcgggccctgaccaggagcctgagccggcccagcagcctcatcgagcaggagaagcagaggagcctggagaagcagaggcaggacctggccaacctgcagaagcagcaggcccagtacctggaggagaagagaagaagagagcgggagtgggaggcccgggagcgggagctgcgggagcgggaggccctgctggcccagcgggaggaggaggtgcagcagggccagcaggacctggagaaggagcgggaggagctgcagcagaagaagggcacctaccagtatgacctggagcggctgcgggccgcccagaagcagctggagcgggagcaggagcagctgcggcgggaggccgagcggctgagccagaggcagacagagcgggacctgtgccaggtgagccacccccacaccaagctgatgaggatccccagcttcttccccagccctgaggagccccccagccccagcgcccccagcatcgccaagagcggcagcctggacagcgagctgtctgtgagccccaagaggaacagcatcagcaggacccacaaggacaagggccccttccacatcctgagcagcaccagccagaccaacaagggccctgagggccagagccaggccccagccagcaccagcgccagcacccggctgtttggcctgaccaagcccaaggagaagaaggagaagaagaagaagaacaagaccagccgcagccagcctggagatggccctgccagcgaggtgtctgctgagggggaggagatcttctgctag

SEQ ID NO: 142071 - DNA, 8442 bp, Artificial Sequence
  Description of Artificial Sequence: Synthetic coding sequence
atgaagctgaacccccagcaggcccccctgtatggagactgtgtggtgacagtgctgctggccgaggaggacaaggcagaagatgatgtggtgttctacctggtgttcctgggcagcaccctgcggcactgcaccagcaccaggaaggtgtccagtgacaccctggagaccatcgcccctggccatgactgctgtgaaacagtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggcccccccagcggagatgtgaacagcctggacaagaagctggtgctggccttccgccacctgaagctgcccacagagtggaatgtgctgggcacagaccagagcctgcatgatgctggcccccgggagaccctgatgcactttgctgtgcggctgggcctgctgcggctgacctggttcctgctgcagaagccaggcggccgcggggccctgagcatccacaaccaggagggcgccacccctgtgtccctggccctggagcggggctaccacaagctgcaccagctgctgacagaggagaatgctggggagccagacagctggagcagcctgtcctatgagatcccctatggagactgcagcgtgcgccaccaccgggagctggacatctacaccctgaccagcgagagtgacagccaccacgagcaccccttccctggagatggctgcaccggccccatcttcaagctgatgaacatccagcagcagctgatgaagaccaacctgaagcagatggacagcctgatgcccctgatgatgacagcccaggaccccagcagcgcccctgagacagatggccagttcctgccctgtgcccctgagcccacagacccccagaggctgagcagcagcgaggagacagagagcacccagtgctgccccggcagccctgtggcccagacagagagcccctgtgacctgagcagcatcgtggaggaggagaacacagacaggagctgcaggaagaagaacaagggcgtggagaggaaaggagaggaggtggagcccgcccccatcgtggacagcggcaccgtgtctgaccaggacagctgcctgcagagcctgcctgactgtggggtgaagggcacagagggcctgagcagctgtggcaacagaaatgaggagaccggcaccaagagcagcggcatgcccacagaccaggagagcctgagcagtggagatgctgtgctgcagagggacctggtgatggagcccggcacagcccagtacagcagtggaggagagctgggcggcatcagcaccaccaacgtgtccaccccagacacagctggggagatggagcacggcctgatgaacccagatgccaccgtgtggaagaatgtgctgcagggcggggagagcaccaaggagagatttgagaacagcaacattggaacagctggggccagtgatgtgcacgtgaccagcaagcctgtggacaagatctctgtgcccaactgtgccccagctgccagcagcctggatggcaacaagccagctgagagcagcctggccttcagcaatgaggagaccagcacagagaagacagctgagacagagaccagccgcagccgggaggagagcgcagatgcccctgtggaccagaacagcgtggtgatcccagctgctgccaaggacaagatcagtgatggcctggagccctacaccctgctggccgccggcattggagaggccatgagccccagcgacctggccctgctgggcctggaggaggatgtgatgccccaccagaacagcgagaccaacagcagccacgcccagagccagaagggcaagagcagccccatctgcagcaccactggagatgacaagctgtgtgccgacagcgcctgccagcagaacacagtgaccagcagcggggacctggtggccaagctgtgtgacaacatcgtgtctgagagcgagagcaccacagcccggcagcccagcagccaggaccccccagatgccagccactgtgaggacccccaggcccacacagtgaccagtgaccctgtgcgggacacccaggagagagctgacttctgccccttcaaggtggtggacaacaagggccagaggaaggatgtgaagctggacaagcccctgaccaacatgctggaggtggtgagccacccccaccctgtggtgcccaagatggagaaggagctggtgcctgaccaggccgtcatcagtgacagcaccttcagcctggccaacagccctggcagcgagagcgtgaccaaggatgatgccctgagctttgtgcccagccagaaggagaagggcacagccaccccagagctgcacacagccacagactacagagatggcccagatggcaacagcaatgaaccagacacccggcccctggaggacagagctgtgggcctgagcaccagcagcacagctgctgagctgcagcacggcatgggcaacaccagcctgaccggcctgggcggggagcacgagggccctgcccccccagccatccctgaggccctgaacatcaagggcaacacagacagcagcctgcagagcgtgggcaaggccaccctggccctggacagcgtgctgacagaggagggcaagctgctggtggtgtctgagagcagcgctgcccaggagcaggacaaggacaaggctgtgacctgcagcagcatcaaggaaaatgccctgagcagcggcaccctgcaggaggagcagaggaccccacctcctggccaggacacccagcagttccacgagaagagcatctctgctgactgtgccaaggacaaggccctgcagctgagcaacagccctggggccagcagcgccttcctgaaggccgagacagagcacaacaaggaggtggccccccaggtgtccctgctgacccagggcggggccgcccagagcctggtgcccccaggggccagcctggccacagagagccggcaggaggccctgggcgctgagcacaacagcagcgccctgctgccctgcctgctgcctgatggcagtgatggcagtgatgccctgaactgcagccagcccagccccctggatgtgggcgtgaagaacacccagagccagggcaagaccagcgcctgtgaggtgtctggagatgtgacagtggatgtgactggagtgaatgccctgcagggcatggccgagccccggcgggagaacatcagccacaacacccaggacatcctgatccccaacgtgctgctgagccaggagaagaatgctgtgctgggcctgcctgtggccctgcaggacaaggctgtgacagacccccagggcgtgggcaccccagagatgatccccctggactgggagaagggcaagctggagggcgctgaccacagctgcaccatgggagatgctgaggaggcccagattgatgatgaggcccaccctgtgctgctgcagcctgtggccaaggagctgcccacagacatggagctgagcgcccatgatgatggagccccagctggggtgcgggaggtgatgagggcccctccttctggccgggagaggagcacccccagcctgccctgcatggtgtctgcccaggatgcccccctgcccaagggagctgacctgattgaggaggccgccagcagaattgtggatgctgtgattgagcaggtgaaggccgccggggccctgctgacagaaggagaggcctgccacatgagcctgagcagccctgagctgggccccctgaccaagggcctggagagcgccttcacagagaaggtgtccaccttccccccaggagagagcctgcccatgggcagcaccccagaggaggccaccggcagcctggccggctgctttgctggccgggaggagcctgagaagatcatcctgcctgtgcagggccctgagcctgctgctgagatgccagatgtgaaggccgaggatgaggtggacttccgggccagcagcatcagcgaggaggtggccgtgggcagcattgctgccaccctgaagatgaagcagggccccatgacccaggccatcaaccgggagaactggtgcaccatcgagccctgcccagatgctgccagcctgctggccagcaagcagagcccagaatgtgagaacttcctggatgtgggcctgggcagagaatgtaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttccgccgccacagctggggccctgggaagaatgctgccagtgatgctgagatgaaccacaggagctccatgagggtgctgggagatgtggtgcggcggccccccatccaccggcgctccttcagcctggagggcctgactggaggagctggggtgggcaacaagcccagcagcagcctggaggtgagcagcgccaatgctgaggagctgcggcaccccttctctggagaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaaggagaaggagaaggagaaggacaagatcaaggagaaggagaaggacagcaaggacaaggagaaggacaagaagacagtgaatggccacaccttcagcagcatccctgtggtgggccccatcagctgcagccagtgcatgaagcccttcaccaacaaggatgcctacacctgtgccaactgcagcgcctttgtgcacaagggctgccgggagagcctggccagctgtgccaaggtgaagatgaagcagcccaagggcagcctgcaggcccatgacaccagcagcctgcccaccgtcatcatgaggaacaagcccagccagcccaaggagcggcccaggtctgctgtgctgctggtggatgaaacagccaccacccccatctttgccaacagaagaagccagcagagcgtgtccctgagcaagtctgtgtccatccagaacatcactggagtgggcaatgatgagaacatgagcaacacctggaagttcctgagccacagcacagacagcctgaacaagatcagcaaggtgaatgaaagcacagagagcctgacagatgagggcgtgggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttcagcggggagaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggctctgtgttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagagaaattcctggatccagatcatccaggacaccatcaacaccctgaacagagatgaagatgagggcatccccagtgaaaatgaggaggagaagaagatgctggacacccgggcccgggagctgaaggagcagctgcaccagaaggaccagaagatcctgctgctgctggaggagaaggagatgatcttccgggacatggccgagtgcagcacccccctgcctgaggactgcagccccacccacagcccccgggtgctcttccgcagcaacacagaggaggccctgaagggcggccccctgatgaagagcgccatcaatgaggtggagatcctgcagggcctggtgtctggcaacctgggcggcaccctgggccccaccgtgagcagccccatcgagcaggatgtggtgggccctgtgtccctgcccaggagagctgagaccttcggcggctttgacagccaccagatgaatgccagcaagggcggggagaaggaggagggagatgatggccaggacctgcggaggacagaaagtgacagcggcctgaagaagggcggcaatgccaacctggtgttcatgctgaagaggaacagcgagcaggtggtgcagagcgtggtgcacctgtatgagctgctgagcgccctgcagggcgtggtgctgcagcaggacagctacatcgaggaccagaagctggtgctgtctgagcgggccctgaccaggagcctgagccggcccagcagcctgattgagcaggagaagcagaggagcctggagaagcagaggcaggacctggccaacctgcagaagcagcaggcccagtacctggaggagaagagaagaagagagcgggagtgggaggcccgggagcgggagctgcgggagcgggaggccctgctggcccagcgggaggaggaggtgcagcagggccagcaggacctggagaaggagcgggaggagctgcagcagaagaagggcacctaccagtatgacctggagcggctgcgggccgcccagaagcagctggagcgggagcaggagcagctgcggcgggaggccgagcggctgagccagaggcagacagagcgggacctgtgccaggtgagccacccccacaccaagctgatgaggatccccagcttcttccccagccctgaggagccccccagccccagcgcccccagcatcgccaagagcggcagcctggacagcgagctgtctgtgagccccaagagaaattccatcagcaggacccacaaggacaagggccccttccacatcctgagcagcaccagccagaccaacaagggccctgagggccagagccaggccccagccagcaccagcgccagcacccggctgtttggcctgaccaagcccaaggagaagaaggagaagaagaagaagaacaagaccagccgcagccagcctggagatggccctgccagcgaggtgtctgctgagggggaggagatcttctgctag

SEQ ID NO: 142072 - DNA, 1245 bp, Artificial Sequence
  Description of Artificial Sequence: Synthetic coding sequence
atgagcaacacctggaagttcctgagccacagcacagacagcctgaacaagatcagcaaggtgaatgaaagcacagagagcctgacagatgagggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttcagcggggagaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggctctgtgttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagagaaattcctggatccagatcatccaggacaccatcaacacctag

SEQ ID NO: 142073 - DNA, 1158 bp, Artificial Sequence
  Description of Artificial Sequence: Synthetic coding sequence
atgtatgaaagacacaagaggcgctacagcctgtgtgacatcagcaaggtggacagaacagtggatgtggtgctgctgaagatcaaccgggagaactggtgcaccatcgagccctgcccagatgctgccagcctgctggccagcaagcagagcccagaatgtgagaacttcctggatgtgggcctgggcagagaatgtaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttccgccgccacagctggggccctgggaagaatgctgccagtgatgctgagatgaaccacaggagcttcagcctggagggcctgactggaggagctggggtgggcaacaagcccagcagcagcctggaggtgagcagcgccaatgctgaggagctgcggcaccccttctctggagaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaagtag

SEQ ID NO: 142074 - DNA, 8379 bp, Artificial Sequence
  Description of Artificial Sequence: Synthetic coding sequence
aagctgctggagaagcagccccccattgaaggagactgtgtggtgacagtgctgctggccgaggaggacaaggccgaggatgatgtggtgttctacctggtgttcctgggcagcaccctgcggcactgcaccagcaccaggaaggtgtccagtgacaccctggagaccatcgcccctggccatgactgctgtgagaccgtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggccccccatctggagatgtgaacagcctggacaagaagctggtgctggccttccgccacctgaagctgcccacagagtggaatgtgctgggcacagaccagagcctgcatgatgctggcccccgggagaccctgatgcactttgctgtgcggctgggcctgctgcggctgacctggttcctgctgcagaagccaggcggccgcggggccctgagcatccacaaccaggagggcgccacccctgtgtccctggccctggagcggggctaccacaagctgcaccagctgctgacagaagaaaatgctggggagccagacagctggagcagcctgtcctatgagatcccctacggggactgcagcgtgcgccaccaccgggagctggacatctacaccctgaccagcgagagtgacagccaccacgagcaccccttccctggagatggctgcaccggccccatcttcaagctgatgaacatccagcagcagctgatgaagaccaacctgaagcagatggacagcctgatgcccctgatgatgacagcccaggaccccagcagcgcccctgagacagatggccagttcctgccctgtgcccctgagcccacagacccccagaggctgagcagcagcgaggagacagagagcacccagtgctgccccggcagccctgtggcccagacagagagcccctgtgacctgagcagcatcgtggaggaggagaacacagacaggagctgcaggaagaagaacaagggcgtggagaggaagggggaggaggtggagcccgcccccatcgtggacagcggcaccgtgtctgaccaggacagctgcctgcagagcctgcctgactgtggggtgaagggcacagagggcctgagcagctgtggcaacagaaatgaggagaccggcaccaagagcagcggcatgcccacagaccaggagagcctgagcagtggagatgctgtgctgcagagggacctggtgatggagcctggaacagcccagtacagcagcggcggggagctgggcggcatcagcaccaccaacgtgtccaccccagacacagctggggagatggagcacggcctgatgaacccagatgccaccgtgtggaagaatgtgctgcagggcggggagagcaccaaggagagatttgagaacagcaacatcggcacagctggggccagtgatgtgcacgtgaccagcaagcctgtggacaagatctctgtgcccaactgtgccccagctgccagcagcctggatggcaacaagccagctgagagcagcctggccttcagcaatgaggagaccagcacagagaagacagctgagacagagaccagccgcagccgggaggagagcgcagatgcccctgtggaccagaacagcgtggtgatcccagctgctgccaaggacaagatcagtgatggcctggagccctacaccctgctggccgccggcatcggggaggccatgagccccagcgacctggccctgctgggcctggaggaggatgtgatgccccaccagaacagcgagaccaacagcagccacgcccagagccagaagggcaagagcagccccatctgcagcaccactggagatgacaagctgtgtgccgacagcgcctgccagcagaacacagtgaccagcagcggggacctggtggccaagctgtgtgacaacatcgtgtctgagagcgagagcaccacagcccggcagcccagcagccaggaccccccagatgccagccactgtgaggacccccaggcccacacagtgaccagtgaccctgtgcgggacacccaggagagagctgacttctgccccttcaaggtggtggacaacaagggccagaggaaggatgtgaagctggacaagcccctgaccaacatgctggaggtggtgagccacccccaccctgtggtgcccaagatggagaaggagctggtgcctgaccaggccgtcatcagtgacagcaccttcagcctggccaacagccctggcagcgagagcgtgaccaaggatgatgccctgagctttgtgcccagccagaaggagaagggcacagccaccccagagctgcacacagccacagactacagagatggcccagatggcaacagcaatgaaccagacacccggcccctggaggacagagctgtgggcctgagcaccagcagcacagctgctgagctgcagcacggcatgggcaacaccagcctgaccggcctgggcggggagcacgagggccctgcccccccagccatccctgaggccctgaacatcaagggcaacacagacagcagcctgcagagcgtgggcaaggccaccctggccctggacagcgtgctgacagaggagggcaagctgctggtggtgtctgagagcagcgctgcccaggagcaggacaaggacaaggctgtgacctgcagcagcatcaaggaaaatgccctgagcagcggcaccctgcaggaggagcagaggaccccacctcctggccaggacacccagcagttccacgagaagagcatctctgctgactgtgccaaggacaaggccctgcagctgagcaacagccctggggccagcagcgccttcctgaaggccgagacagagcacaacaaggaggtggccccccaggtgtccctgctgacccagggcggggccgcccagagcctggtgcccccaggggccagcctggccacagagagccggcaggaggccctgggcgctgagcacaacagcagcgccctgctgccctgcctgctgcctgatggcagtgatggcagtgatgccctgaactgcagccagcccagccccctggatgtgggcgtgaagaacacccagagccagggcaagaccagcgcctgtgaggtgtctggagatgtgacagtggatgtgactggagtgaatgccctgcagggcatggccgagccccggcgggagaacatcagccacaacacccaggacatcctgatccccaacgtgctgctgagccaggagaagaatgctgtgctgggcctgcctgtggccctgcaggacaaggctgtgacagacccccagggcgtgggcaccccagagatgatccccctggactgggagaagggcaagctggagggcgctgaccacagctgcaccatgggagatgctgaggaggcccagattgatgatgaggcccaccctgtgctgctgcagcctgtggccaaggagctgcccacagacatggagctgagcgcccatgatgatggagccccagctggggtgcgggaggtgatgagggccccacccagcggccgggagaggagcacccccagcctgccctgcatggtgtctgcccaggatgcccccctgcccaagggagctgacctgattgaggaggccgccagccgcatcgtggatgctgtgattgagcaggtgaaggctgctggggccctgctgacagaaggagaggcctgccacatgagcctgagcagccctgagctgggccccctgaccaagggcctggagagcgccttcacagagaaggtgtccaccttccccccaggagagagcctgcccatgggcagcaccccagaggaggccaccggcagcctggccggctgctttgctggccgggaggagcctgagaagatcatcctgcctgtgcagggccctgagcctgctgctgagatgccagatgtgaaggcagaagatgaggtggacttccgggccagcagcatcagcgaggaggtggccgtgggcagcattgctgccaccctgaagatgaagcagggccccatgacccaggccatcaaccgggagaactggtgcaccatcgagccctgcccagatgctgccagcctgctggccagcaagcagagcccagaatgtgagaacttcctggatgtgggcctgggccgggagtgcaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttcagaagacacagctggggccctgggaagaatgctgccagtgatgctgagatgaaccaccgctccttcagcctggagggcctgaccggcggggccggcgtgggcaacaagcccagcagcagcctggaggtgtcctctgccaatgctgaggagctgcggcaccccttcagcggggaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaaggagaaggagaaggagaaggacaagatcaaggagaaggagaaggacagcaaggacaaggagaaggacaagaagacagtgaatggccacaccttcagcagcatccctgtggtgggccccatcagctgcagccagtgcatgaagcccttcaccaacaaggatgcctacacctgtgccaactgcagcgcctttgtgcacaagggctgccgggagagcctggccagctgtgccaaggtgaagatgaagcagcccaagggcagcctgcaggcccatgacaccagcagcctgcccaccgtcatcatgaggaacaagcccagccagcccaaggagcggcccaggtctgctgtgctgctggtggatgaaacagccaccacccccatctttgccaacagaagaagccagcagagcgtgtccctgagcaagtctgtgtccatccagaacatcaccggggtgggcaatgatgagaacatgagcaacacctggaagttcctgagccacagcacagacagcctgaacaagatcagcaaggtgaatgaaagcacagagagcctgacagatgagggcacagacatgaatgaaggccagctgctgggggactttgaaattgagagcaagcagctggaggccgagagctggagccgcatcatcgacagcaagttcctgaagcagcagaagaaggatgtggtgaagaggcaggaggtgatctatgagctgatgcagacagagttccaccacgtgaggaccctgaagatcatgtctggagtgtacagccagggcatgatggctgacctgctgtttgagcagcagatggtggagaagctgttcccctgcctggatgagctgatcagcatccacagccagttcttccagaggatcctggagaggaagaaggagagcctggtggacaagtctgagaagaacttcctgatcaagagaattggagatgtgctggtgaaccagttctctggagaaaatgctgagcggctgaagaagacctacggcaagttctgtggccagcacaaccagagcgtgaactacttcaaggacctgtatgccaaggacaagcgcttccaggcctttgtgaagaagaagatgagcagctctgtggtgcggcggctgggcatccctgagtgcatcctgctggtgacccagaggatcaccaagtaccctgtgctcttccagaggatcctgcagtgcaccaaggacaatgaggtggagcaggaggacctggcccagagcctgagcctggtgaaggatgtgattggagctgtggacagcaaggtggccagctatgagaagaaggtgcggctgaatgagatctacaccaagacagacagcaagagcatcatgaggatgaagagcggccagatgtttgccaaggaggacctgaagaggaagaagctggtgagagatggcagcgtcttcctgaagaatgctgctggccgcctgaaggaggtgcaggccgtgctgctgacagacatcctggtgttcctgcaggagaaggaccagaagtacatctttgccagcctggaccagaagagcaccgtcatcagcctgaagaagctgattgtgcgggaggtggcccacgaggagaagggcctcttcctgatctccatgggcatgacagatcctgagatggtggaggtgcacgccagcagcaaggaggagaggaacagctggatccagatcatccaggacaccatcaacaccctgaacagagatgaagatgagggcatccccagtgaaaatgaggaggagaagaagatgctggacacccgggcccgggagctgaaggagcagctgcaccagaaggaccagaagatcctgctgctgctggaggagaaggagatgatcttccgggacatggctgaatgttccacccccctgcctgaggactgcagccccacccacagcccccgggtgctcttccgcagcaacacagaggaggccctgaagggcggccccctgatgaagagcgccatcaatgaggtggagatcctgcagggcctggtgtctggcaacctgggcggcaccctgggccccaccgtgagcagccccatcgagcaggatgtggtgggccctgtgtccctgccccggcgggcagagacctttggaggctttgacagccaccagatgaatgccagcaaaggaggagagaaggaggagggagatgatggccaggacctgcggaggacagaaagtgacagcggcctgaagaagggcggcaatgccaacctggtgttcatgctgaagagaaattctgagcaggtggtgcagagcgtggtgcacctgtatgagctgctgagcgccctgcagggcgtggtgctgcagcaggacagctacatcgaggaccagaagctggtgctgtctgagcgggccctgaccaggagcctgagccggcccagcagcctcatcgagcaggagaagcagaggagcctggagaagcagaggcaggacctggccaacctgcagaagcagcaggcccagtacctggaggagaagagaagaagagagcgggagtgggaggcccgggagcgggagctgcgggagcgggaggccctgctggcccagcgggaggaggaggtgcagcagggccagcaggacctggagaaggagcgggaggagctgcagcagaagaagggcacctaccagtatgacctggagcggctgcgggccgcccagaagcagctggagcgggagcaggagcagctgcggcgggaggccgagcggctgagccagaggcagacagagcgggacctgtgccaggtgagccacccccacaccaagctgatgaggatccccagcttcttccccagccctgaggagccccccagccccagcgcccccagcatcgccaagagcggcagcctggacagcgagctgtctgtgagccccaagaggaacagcatcagcaggacccacaaggacaagggccccttccacatcctgagcagcaccagccagaccaacaagggccctgagggccagagccaggccccagccagcaccagcgccagcacccggctgtttggcctgaccaagcccaaggagaagaaggagaagaagaagaagaacaagaccagccgcagccagcctggagatggccctgccagcgaggtgtctgctgagggggaggagatcttctgctag

SEQ ID NO: 142075 - DNA, 5238 bp, Artificial Sequence
  Description of Artificial Sequence: Synthetic coding sequence
atgaagctgaacccccagcaggcccccctgtatggagactgtgtggtgacagtgctgctggccgaggaggacaaggcagaagatgatgtggtgttctacctggtgttcctgggcagcaccctgcggcactgcaccagcaccaggaaggtgtccagtgacaccctggagaccatcgcccctggccatgactgctgtgaaacagtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggcccccccagcggagatgtgaacagcctggacaagaagctggtgctggccttccgccacctgaagctgcccacagagtggaatgtgctgggcacagaccagagcctgcatgatgctggcccccgggagaccctgatgcactttgctgtgcggctgggcctgctgcggctgacctggttcctgctgcagaagccaggcggccgcggggccctgagcatccacaaccaggagggcgccacccctgtgtccctggccctggagcggggctaccacaagctgcaccagctgctgacagaggagaatgctggggagccagacagctggagcagcctgtcctatgagatcccctatggagactgcagcgtgcgccaccaccgggagctggacatctacaccctgaccagcgagagtgacagccaccacgagcaccccttccctggagatggctgcaccggccccatcttcaagctgatgaacatccagcagcagctgatgaagaccaacctgaagcagatggacagcctgatgcccctgatgatgacagcccaggaccccagcagcgcccctgagacagatggccagttcctgccctgtgcccctgagcccacagacccccagaggctgagcagcagcgaggagacagagagcacccagtgctgccccggcagccctgtggcccagacagagagcccctgtgacctgagcagcatcgtggaggaggagaacacagacaggagctgcaggaagaagaacaagggcgtggagaggaaaggagaggaggtggagcccgcccccatcgtggacagcggcaccgtgtctgaccaggacagctgcctgcagagcctgcctgactgtggggtgaagggcacagagggcctgagcagctgtggcaacagaaatgaggagaccggcaccaagagcagcggcatgcccacagaccaggagagcctgagcagtggagatgctgtgctgcagagggacctggtgatggagcccggcacagcccagtacagcagtggaggagagctgggcggcatcagcaccaccaacgtgtccaccccagacacagctggggagatggagcacggcctgatgaacccagatgccaccgtgtggaagaatgtgctgcagggcggggagagcaccaaggagagatttgagaacagcaacattggaacagctggggccagtgatgtgcacgtgaccagcaagcctgtggacaagatctctgtgcccaactgtgccccagctgccagcagcctggatggcaacaagccagctgagagcagcctggccttcagcaatgaggagaccagcacagagaagacagctgagacagagaccagccgcagccgggaggagagcgcagatgcccctgtggaccagaacagcgtggtgatcccagctgctgccaaggacaagatcagtgatggcctggagccctacaccctgctggccgccggcattggagaggccatgagccccagcgacctggccctgctgggcctggaggaggatgtgatgccccaccagaacagcgagaccaacagcagccacgcccagagccagaagggcaagagcagccccatctgcagcaccactggagatgacaagctgtgtgccgacagcgcctgccagcagaacacagtgaccagcagcggggacctggtggccaagctgtgtgacaacatcgtgtctgagagcgagagcaccacagcccggcagcccagcagccaggaccccccagatgccagccactgtgaggacccccaggcccacacagtgaccagtgaccctgtgcgggacacccaggagagagctgacttctgccccttcaaggtggtggacaacaagggccagaggaaggatgtgaagctggacaagcccctgaccaacatgctggaggtggtgagccacccccaccctgtggtgcccaagatggagaaggagctggtgcctgaccaggccgtcatcagtgacagcaccttcagcctggccaacagccctggcagcgagagcgtgaccaaggatgatgccctgagctttgtgcccagccagaaggagaagggcacagccaccccagagctgcacacagccacagactacagagatggcccagatggcaacagcaatgaaccagacacccggcccctggaggacagagctgtgggcctgagcaccagcagcacagctgctgagctgcagcacggcatgggcaacaccagcctgaccggcctgggcggggagcacgagggccctgcccccccagccatccctgaggccctgaacatcaagggcaacacagacagcagcctgcagagcgtgggcaaggccaccctggccctggacagcgtgctgacagaggagggcaagctgctggtggtgtctgagagcagcgctgcccaggagcaggacaaggacaaggctgtgacctgcagcagcatcaaggaaaatgccctgagcagcggcaccctgcaggaggagcagaggaccccacctcctggccaggacacccagcagttccacgagaagagcatctctgctgactgtgccaaggacaaggccctgcagctgagcaacagccctggggccagcagcgccttcctgaaggccgagacagagcacaacaaggaggtggccccccaggtgtccctgctgacccagggcggggccgcccagagcctggtgcccccaggggccagcctggccacagagagccggcaggaggccctgggcgctgagcacaacagcagcgccctgctgccctgcctgctgcctgatggcagtgatggcagtgatgccctgaactgcagccagcccagccccctggatgtgggcgtgaagaacacccagagccagggcaagaccagcgcctgtgaggtgtctggagatgtgacagtggatgtgactggagtgaatgccctgcagggcatggccgagccccggcgggagaacatcagccacaacacccaggacatcctgatccccaacgtgctgctgagccaggagaagaatgctgtgctgggcctgcctgtggccctgcaggacaaggctgtgacagacccccagggcgtgggcaccccagagatgatccccctggactgggagaagggcaagctggagggcgctgaccacagctgcaccatgggagatgctgaggaggcccagattgatgatgaggcccaccctgtgctgctgcagcctgtggccaaggagctgcccacagacatggagctgagcgcccatgatgatggagccccagctggggtgcgggaggtgatgagggcccctccttctggccgggagaggagcacccccagcctgccctgcatggtgtctgcccaggatgcccccctgcccaagggagctgacctgattgaggaggccgccagcagaattgtggatgctgtgattgagcaggtgaaggccgccggggccctgctgacagaaggagaggcctgccacatgagcctgagcagccctgagctgggccccctgaccaagggcctggagagcgccttcacagagaaggtgtccaccttccccccaggagagagcctgcccatgggcagcaccccagaggaggccaccggcagcctggccggctgctttgctggccgggaggagcctgagaagatcatcctgcctgtgcagggccctgagcctgctgctgagatgccagatgtgaaggccgaggatgaggtggacttccgggccagcagcatcagcgaggaggtggccgtgggcagcattgctgccaccctgaagatgaagcagggccccatgacccaggccatcaaccgggagaactggtgcaccatcgagccctgcccagatgctgccagcctgctggccagcaagcagagcccagaatgtgagaacttcctggatgtgggcctgggcagagaatgtaccagcaagcagggcgtgctgaagcgggagagcggcagtgacagcgacctcttccacagccccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttccgccgccacagctggggccctgggaagaatgctgccagtgatgctgagatgaaccacaggagcttcagcctggagggcctgactggaggagctggggtgggcaacaagcccagcagcagcctggaggtgagcagcgccaatgctgaggagctgcggcaccccttctctggagaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctggacaacagccggcccttccacagcaccttccacaacaccagcgccaacctgacagagagcatcacagaggagaactacaacttcctgccccacagccccagcaagaaggacagcgagtggaagagcggcaccaaggtgtccaggaccttctcctacatcaagaacaagatgagcagcagcaagaagagcaagtag

SEQ ID NO: 142076 - DNA, 828 bp, Artificial Sequence
  Description of Artificial Sequence: Synthetic coding sequence
cccagtgatgacatggacagcatcatcttccccaagccagaggaggagcacctggcctgtgacatcaccggcagcagcagcagcacagatgacacagccagcctggacagacacagcagccacggcagtgatgtgtccctgagccagatcctgaagcccaacagaagccgggaccggcagagcctggatggcttctacagccacggcatgggcgctgagggccgggagagcgagagcgagcctgctgaccctggagatgtggaggaggaggagatggacagcatcacagaggtgcctgccaactgcagcgtgctgcggagctccatgaggagcctgagccccttccgccgccacagctggggccctgggaagaatgctgccagtgatgctgagatgaaccacaggagctccatgagggtgctgggagatgtggtgcggcggccccccatccaccggcgctccatgtcctggtgccccagcggcgtgcagtacagcgctggcctgtctgctgacttcaactaccgctccttcagcctggagggcctgactggaggagctggggtgggcaacaagcccagcagcagcctggaggtgagcagcgccaatgctgaggagctgcggcaccccttctctggagaggagcgggtggacagcctggtgtccctgtctgaggaggacctggagagtgaccagcgggagcacaggatgtttgaccagcagatctgccacaggagcaagcagcagggcttcaactactgcaccagcgccatcagcagccccctgaccaagagcatcagcctgatgaccatcagccaccctggcctgtag

SEQ ID NO: 142077 - DNA, 117 bp, Artificial Sequence
  Description of Artificial Sequence: Synthetic coding sequence
atgaagctgaacccccagcaggcccccctgtatggagactgtgtggtgacagtgctgctggccgaggaggacaaggcagaagatgatgtggtgttctacctggtgttcctgggctag

SEQ ID NO: 142078 - DNA, 540 bp, Artificial Sequence
  Description of Artificial Sequence: Synthetic coding sequence
atgaagctgaacccccagcaggcccccctgtatggagactgtgtggtgacagtgctgctggccgaggaggacaaggcagaagatgatgtggtgttctacctggtgttcctgggcagcaccctgcggcactgcaccagcaccaggaaggtgtccagtgacaccctggagaccatcgcccctggccatgactgctgtgaaacagtgaaggtgcagctgtgtgccagcaaggagggcctgcctgtgtttgtggtggccgaggaggacttccactttgtgcaggatgaggcctatgatgctgcccagttcctggccaccagcgctggcaaccagcaggccctgaacttcacccgcttcctggaccagagcggcccccccagcggagatgtgaacagcctggacaagaagctggtgctggccttccgccacctgaagctgcccacagagtggaatgtgctgggcacagaccagagcctgcatggagagaacctgtatgacctgcagacccacttcaagtttgtgatcttcctgctcttcttctag

SEQ ID NO: 142079 - DNA, 414 bp, Artificial Sequence
  Description of Artificial Sequence: Synthetic coding sequence
atgtctgagacccagaacagcaccagccagaaggccatggatgaggacaacaaggccgccagccagaccatgcccaacacccaggacaagaactatgaagatgagctgacccaggtggccctggccctggtggaggatgtgatcaactatgctgtgaagatcgtggaggaggagaggaaccccctgaagaacatcaagtggatgacccacggggagttcaccgtggagaagggcctgaagcagattgatgagtacttcagtgatgcccccatcgtggtgtcctatgtgggggaccaccaggccctggtgcaccggcccggcatggtgcgcttccgggagaactggcagaagaacctgacagatgccaagtacagcttcatggagagcttccccttcctgttcaacagagtgtag

SEQ ID NO: 142080 - DNA, 270 bp, Artificial Sequence
  Description of Artificial Sequence: Synthetic coding sequence
atgtctgagacccagaacagcaccagccagaaggccatggatgaggacaacaaggccgccagccagaccatgcccaacacccaggacaagaactatgaagatgagctgacccaggtggccctggccctggtggaggatgtgatcaactatgctgtgaagatcgtggaggaggagaggaaccccctgaagaacatcaagtggatgacccacggggagttcaccgtggagaagggcctgaagcagattgatgagtacttctctgtgtcctag

SEQ ID NO: 142081 - DNA, 417 bp, Artificial Sequence
  Description of Artificial Sequence: Synthetic coding sequence
atgtctgagacccagaacagcaccagccagaaggccatggatgaggacaacaaggccgccagccagaccatgcccaacacccaggacaagaactatgaagatgagctgacccaggtggccctggccctggtggaggatgtgatcaactatgctgtgaagatcgtggaggaggagaggaaccccctgaagaacatcaagtggatgacccacggggagttcaccgtggagaagggcctgaagcagattgatgagtacttctccccagatgcccccatcgtggtgtcctatgtgggggaccaccaggccctggtgcacaggcctggcatggtgcgcttccgggagaactggcagaagaacctgacagatgccaagtacagcttcatggagagcttccccttcctgttcaacagagtgtag

SEQ ID NO: 142082 - DNA, 414 bp, Artificial Sequence; identical to SEQ ID NO: 142079
  Description of Artificial Sequence: Synthetic coding sequence

SEQ ID NO: 142083 - DNA, 594 bp, Artificial Sequence
  Description of Artificial Sequence: Synthetic coding sequence
atgtctgagacccagaacagcaccagccagaaggccatggatgaggacaacaaggccgccagccagaccatgcccaacacccaggacaagaactatgaagatgagctgacccaggtggccctggccctggtggaggatgtgatcaactatgctgtgaagatcgtggaggaggagaggaaccccctgaagaacatcaagtggatgacccacggggagttcaccgtggagaagggcctgaagcagattgatgagtacttcagcaaatgtgtgtccaagaagtgctgggcccatggagtggagtttgtggagaggaaggacctgatccacagcttcctgtacatctactacgtgcactggagcatcagcacagctgacctgcctgtggcccgcatctctgctggcacctacttcaccatgaaggtgtccaagaccaagcccccagatgcccccatcgtggtgtcctatgtgggggaccaccaggccctggtgcaccggcccggcatggtgcgcttccgggagaactggcagaagaacctgacagatgccaagtacagcttcatggagagcttccccttcctgttcaacagagtgtag

SEQ ID NO: 142084 - DNA, 270 bp, Artificial Sequence; identical to SEQ ID NO: 142080
  Description of Artificial Sequence: Synthetic coding sequence

SEQ ID NO: 142085 - DNA, 2088 bp, Artificial Sequence
  Description of Artificial Sequence: Synthetic coding sequence
atggctgctgccaccatcgtgcatgacaccagcgaggccgtggagctgtgcccagcctacggcctgtacctgaagcccatcaccaagatgaccatctctgtggccctgccccagctgaagcagcccgggaagagcatcagcaactgggaggtgatggagcggctgaagggcatggtgcagaaccaccagttcagcaccctgcgcatcagcaagagcaccatggacttcatccgctttgaaggagaggtggagaacaagagcctggtgaagagcttcctggcctgcctggatggcaagaccatcaagctgagcggcttcagtgacatcctgaaggtgcgggctgctgagttcaagattgacttccccaccaggcatgactgggacagcttcttcagagatgccaaggacatgaatgagaccctgcccggggagaggccagacaccatccacctggagggcctgccctgcaagtggtttgccctgaaggagagcggcagcgagaagcccagtgaagatgtgctggtgaaggtgtttgagaagtttggagagatcagaaatgtggacatccccatgctggacccctaccgggaggagatgacaggcaggaacttccacaccttctcctttggaggccacctgaactttgaggcctacgtgcagtaccgggagtacatgggcttcatccaggccatgtctgccctgcggggcatgaagctgatgtacaagggggaggatggcaaggctgtggcctgcaacatcaaggtgtcctttgacagcaccaagcacctgagtgatgccagcatcaagaagaggcagctggagcggcagaagctgcaggagctggagcagcagcgggaggagcagaagaggcgggagaaggaggccgaggagcggcagagagctgaggagaggaagcagaaggagctggaggagctggagcgggagaggaagcgggaggagaagctgaggaagcgggagcagaagcagagggaccgggagctgcggaggaaccagaagaagctggagaagctgcaggccgaggagcagaagcagctgcaggagaagatcaagctggaggagaggaagctgctgctggcccagaggaacctgcagagcatccggctgattgctgagctgctgagccgggccaaggctgtgaagctgcgggagcaggagcagaaggaggagaagctgcggctgcagcagcaggaggagcggcggcggctgcaggaggccgagctgcggcgggtggaggaggagaaggagcgggccctgggcctgcagaggaaggagcgggagctgcgggagcggctgctgagcatcctgctgagcaagaagccagatgacagccacacccatgatgagctgggcgtggcccatgctgacctgctgcagcctgtgctggacatcctgcagacagtgagcagcggctgtgtgtctgccaccaccctgcaccccctgggcggccagcccccagctggggcccccaaggagagccctgcccaccctgaggctgatggagcccccaagtctgtgaatggatctgtggccgaggaggccccctgcaaggaggtgcagagcagctgccgggtggtgcctgaagatggcagccctgagaagcgctgccctggaggagtgctgagctgcatcccagacaacaaccagcagcccaagggcatcccagcctgtgagcagaatgtgtccaggaaggacaccaggtctgagcaggacaagtgcaaccgggagcccagcaagggccggggccgggccactggagatggcctggccgacagacacaagcgggagaggagccgggcccggcgggccagcagcagagaagatggccggcccaggaaggagcggcggccccacaagaagcacgcctacaaggatgacagcccccggcggcgcagcaccagcccagaccacaccaggagcagaagaagccacagcaaggacagacaccggcgggagaggagccgggagcggcggggcagcgccagcaggaagcacagccgccacagaagaagaagtgagaggagccgcagccgcagccccagccgccacaggagcacctggaacagatag

SEQ ID NO: 142086 - DNA, 1341 bp, Artificial Sequence
  Description of Artificial Sequence: Synthetic coding sequence
atggctgctgccaccatcgtgcatgacaccagcgaggccgtggagctgtgcccagcctacggcctgtacctgaagcccatcaccaagatgaccatctctgtggccctgccccagctgaagcagcccgggaagagcatcagcaactgggaggtgatggagcggctgaagggcatggtgcagaaccaccagttcagcaccctgcgcatcagcaagagcaccatggacttcatccgctttgaaggagaggtggagaacaagagcctggtgaagagcttcctggcctgcctggatggcaagaccatcaagctgagcggcttcagtgacatcctgaaggtgcgggctgctgagttcaagattgacttccccaccaggcatgactgggacagcttcttcagagatgccaaggacatgaatgagaccctgcccggggagaggccagacaccatccacctggagggcctgccctgcaagtggtttgccctgaaggagagcggcagcgagaagcccagtgaagatgtgctggtgaaggtgtttgagaagtttggagagatcagaaatgtggacatccccatgctggacccctaccgggaggagatgacaggcaggaacttccacaccttctcctttggaggccacctgaactttgaggcctacgtgcagtaccgggagtacatgggcttcatccaggccatgtctgccctgcggggcatgaagctgatgtacaagggggaggatggcaaggctgtggcctgcaacatcaaggtgtcctttgacagcaccaagcacctgagtgatgccagcatcaagaagaggcagctggagcggcagaagctgcaggagctggagcagcagcgggaggagcagaagaggcgggagaaggaggccgaggagcggcagagagctgaggagaggaagcagaaggagctggaggagctggagcgggagaggaagcgggaggagaagctgaggaagcgggagcagaagcagagggaccgggagctgcggaggaaccagaagaagctggagaagctgcaggccgaggagcagaagcagctgcaggagaagatcaagctggaggagaggaagctgctgctggcccagaggaacctgcagagcatccggctgattgctgagctgctgagccgggccaaggtgcctgggggcagcctgtgcagccggcagcccaggcctggctgcccccagtgcccccccctgaagtgtggcagaagacatggagctgtgagccccccagctgctgctgtggccaccaagccagccctgatgcccaggatgacagcccccagccgggagggcgtggccctggtgtgccgcagcaggtag

SEQ ID NO: 142087 - DNA, 2580 bp, Artificial Sequence
  Description of Artificial Sequence: Synthetic coding sequence
atggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcctggagctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgaacatgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaaccccaggcctccttctgtgggcggccccccagaagattctggggccagcgctgccaagggccagaagagccctggggccctggagaccccatctgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgcctttggaagtgagaagccccagagcatgtttgagcccccccaggtgagcagccctgtgcaggagaagagagatgtgctgcccaagatcctgcctgcagaagatcgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagagaagagagaggatggatgacagctctgtgctggaggccaccagggtgaacagaaggaagagcgccctggccctgcgctgggaggccggcatctatgccaaccaggaggaggaggacaatgaatag

SEQ ID NO: 142088 - DNA, 2847 bp, Artificial Sequence
  Description of Artificial Sequence: Synthetic coding sequence
atgcgctggccccagcccggggctgctgcccggctgcccccagagagccctggccccccagagagccctggccccccagagcgggaggccgccgccgcccggcgctggacaggagctgagccccaggactgtgcccctggcagcggccggcctgagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagctctgtgctggaggccaccagggtgaacagaaggaagagcgccctggccctgcgctgggaggccggcatctatgccaaccaggaggaggaggacaatgaatag

SEQ ID NO: 142089 - DNA, 3273 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctggggtgggctgggagaatgtgctgctgaaggagggggagagcgccagcaatgccacagagaccagcggccctgacatgaccatcaagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagctctgtgctggaggccaccagggtgaacagaaggaagagcgccctggccctgcgctgggaggccggcatctatgccaaccaggaggaggaggacaatgaatag

SEQ ID NO: 142090 - DNA, 3312 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctggggtgggctgggagaatgtgctgctgaaggagggggagagcgccagcaatgccacagagaccagcggccctgacatgaccatcaagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagcagctacaccagcaagctgctgagctgcaaggtgaccagcgaggtgctggaggccaccagggtgaacagaaggaagagcgccctggccctgcgctgggaggccggcatctatgccaaccaggaggaggaggacaatgaatag

SEQ ID NO: 142091 - DNA, 2886 bp, Artificial Sequence
  Description of Artificial Sequence: Synthetic coding sequence
atgcgctggccccagcccggggctgctgcccggctgcccccagagagccctggccccccagagagccctggccccccagagcgggaggccgccgccgcccggcgctggacaggagctgagccccaggactgtgcccctggcagcggccggcctgagaagccaccccagctgtctgaagatgacatctggctgaagtctgagggggacaactacagcgccaccctgctggagcctgctgccagcagcctgagcccagaccacaagaacatggagattgaggtgtctgtggccgagtgcaagtctgtgcccggcatcaccagcaccccccaccccatggaccaccccagcgccttctacagccccccccacaacggcctgctgacagaccaccacgagagcctggacaatgatgtggcccgggagatccgctacctggatgaggtgctggaggccaactgctgtgacagcgctgtggatggcacctacaacggcaccagcagccctgagcccggggctgtggtgctggtgggcggcctgagcccccctgtgcatgaggccacccagcctgagcccacagagaggacagccagccggcaggccccaccccacatcgagctgagcaacagcagcccagaccccatggccgaggccgagaggaccaacggccacagccccagccagcccagagatgccctgggggacagcctgcaggtgcctgtgagccccagcagcaccaccagcagccgctgcagcagcagagatggagagttcaccctgaccaccctgaagaaggaggccaagtttgagctgcgggccttccacgaggacaagaagcccagcaagctgtttgaagatgatgagcacgagaaggagcagtactgcatcaggaaggtgcggcccagcgaggagatgctggagctggagaaggagcggcgggagctgatccgcagccaggccgtgaagaagaaccctggcattgctgccaagtggtggaaccccccccaggagaagaccatcgaggagcagctggatgaggagcacctggagagccacaagaagtacaaggagaggaaggagcggcgggcccagcaggagcagctgctgctgcagaagcagctgcagcagcagcagcagcagccccccagccagctgtgcacagccccagccagcagccatgagcgggcctccatgattgacaaggccaaggaggacatcgtgacagagcagattgacttctctgctgccaggaagcagttccagctgatggagaacagccggcaggccgtggccaagggccagagcacccccaggctcttcagcatcaagcccttctaccggcccctgggctctgtgaacagcgacaagcccctgaccaacccccggccccccagcgtgggcggccccccagaggacagcggggccagcgctgccaagggccagaagagccctggggccctggagacccccagcgctgctggcagccagggcaacacagccagccagggcaaggagggcccctacagcgagcccagcaagaggggccccctgagcaagctgtgggccgaggatggagagttcaccagcgcccgggctgtgctgactgtggtgaaggatgatgaccacggcatcctggaccagttcagccgctctgtgaatgtgtccctgacccaggaggagctggacagcggcctggatgagctgtctgtgcgcagccaggacaccaccgtgctggagaccctgagcaatgacttctccatggacaacatcagtgacagcggggccagcaatgagaccaccaatgccctgcaggagaacagcctggccgacttcagcctgccccagaccccccagacagacaaccccagcgagggccgcggggagggcgtgtccaagagcttcagtgaccacggcttctacagccccagcagcaccctgggggacagccccctggtggatgaccccctggagtaccaggccggcctgctggtgcagaatgccatccagcaggccatcgccgagcaggtggacaaggctgtgtccaagaccagcagagatggagctgagcagcagggccctgaggccaccgtggaggaggccgaggccgccgccttcggcagcgagaagccccagagcatgtttgagcccccccaggtgagcagccctgtgcaggagaagagagatgtgctgcccaagatcctgcctgctgaggaccgggccctgcgggagcggggccccccccagcccctgcctgctgtgcagcccagcggccccatcaacatggaggagaccaggcctgagggcagctacttcagcaagtacagcgaggccgctgagctgcggagcacagccagcctgctggccacccaggagagtgatgtgatggtgggccccttcaagctgcggagcaggaagcagaggaccctgtccatgattgaggaggagatccgggccgcccaggagcgggaggaggagctgaagaggcagaggcaggtgctgcagagcacccagagccccaggaccaagaatgcccccagcctgcccagcaggacctgctacaagacagcccctgggaagattgagaaggtgaagcccccacccagccccaccacagagggccccagcctgcagcctgacctggcccctgaggaggccgccggcacccagaggcccaagaacctgatgcagaccctgatggaggactatgagacccacaagagcaagaggcgggagaggatggatgacagcagctacaccagcaagctgctgagctgcaaggtgaccagcgaggtgctggaggccaccagggtgaacagaaggaagagcgccctggccctgcgctgggaggccggcatctatgccaaccaggaggaggaggacaatgaatag

SEQ ID NO: 142092 - DNA, 2565 bp, Artificial Sequence
  Description of Artificial Sequence: Synthetic coding sequence
atgatggcctacagcgacaccaccatgatgtctgatgacatcgactggctgcggagccaccggggcgtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagagccccagcgcccccccagccaagccacccagcacccagagagctgtgatcagcccagatggagaatgttccattgatgacctgtccttctacgtgaaccggctgagcagcctggtgatccagatggcccacaaggagatcaaggagaagctggagggcaagagcaagtgcctgcaccacagcatctgccccagccctggcaacaaggagcgcatcagccccaggaccccagccagcaagatcgccagcgagatggcctatgaggccgtggagctgacagctgctgagatgaggggcactggagaggagagccgggagggcggccagaagagcttcctgtacagcgagctgagcaacaagagcaagagcggggacaagcagatgagccagcgggagagcaaggagtttgctgacagcatcagcaagggcctgatggtgtatgccaaccaggtggccagtgacatgatggtgtccctgatgaagaccctgaaggtgcacagcagcggcaagcccatcccagcctctgtggtgctgaagagggtgctgctgcggcacaccaaggagatcgtgtctgacctgattgacagctgcatgaagaacctgcacaacatcaccggggtgctgatgacagacagcgactttgtgtctgctgtgaagaggaacctcttcaaccagtggaagcagaatgccacagacatcatggaggccatgctgaagaggctggtgtctgccctgattggagaggagaaggagaccaagagccagagcctgtcctatgccagcctgaaggccggcagccatgaccccaagtgcaggaaccagagcctggagttcagcaccatgaaggccgagatgaaggagcgggacaagggcaagatgaagagtgacccctgcaagagcctgaccagcgctgagaaggtgggggagcacatcctgaaggagggcctgaccatctggaaccagaagcagggcaacagctgcaaggtggccaccaaggcctgcagcaacaaggatgagaagggggagaagatcaatgccagcacagacagcctggccaaggacctgattgtgtctgccctgaagctgatccagtaccacctgacccagcagaccaagggcaaggacacctgtgaggaggactgccccggcagcaccatgggctacatggcccagagcacccagtatgagaagtgtggcggcggccagagcgccaaggccctgtctgtgaagcagctggagagccaccgggcccctggccccagcacctgccagaaggagaaccagcacctggacagccagaagatggacatgagcaacatcgtgctgatgctgatccagaagctgctgaatgaaaaccccttcaagtgtgaggacccctgtgagggggagaacaagtgcagcgagccccgggccagcaaggccgcctccatgagcaacagaagtgacaaggccgaggagcagtgccaggagcaccaggagctggactgcaccagcggcatgaagcaggccaacggccagttcatcgacaagctggtggagagcgtgatgaagctgtgcctgatcatggccaagtacagcaatgatggagctgccctggccgagctggaggagcaggccgccagcgccaacaagcccaacttccggggcacccgctgcatccacagcggggccatgccccagaactaccaggacagcctgggccatgaagtcatcgtgaacaaccagtgcagcaccaacagcctgcagaagcagctgcaggccgtgctgcagtggattgctgccagccagttcaacgtgcccatgctgtacttcatgggagacaaggatggccagctggagaagctgccccaggtgtctgccaaggctgctgagaagggctacagcgtgggcggcctgctgcaggaggtgatgaagtttgccaaggagcggcagccagatgaagctgtgggcaaggtggccaggaagcagctgctggactggctgctggccaacctgtag

SEQ ID NO: 142093 - DNA, 2538 bp, Artificial Sequence
  Description of Artificial Sequence: Synthetic coding sequence
atgtctgatgacatcgactggctgcggagccacagaggagtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagagccccagcgcccccccagccaagccacccagcacccagagagctgtgatcagcccagatggagagtgcagcattgatgacctgtccttctacgtgaaccggctgagcagcctggtgatccagatggcccacaaggagatcaaggagaagctggagggcaagagcaagtgcctgcaccacagcatctgccccagccctggcaacaaggagcgcatcagccccaggaccccagccagcaagatcgccagcgagatggcctatgaagctgtggagctgacagctgctgagatgaggggcaccggggaggagagccgggagggcggccagaagagcttcctgtacagcgagctgagcaacaagagcaagagcggggacaagcagatgagccagcgggagagcaaggagtttgctgacagcatcagcaagggcctgatggtgtatgccaaccaggtggccagtgacatgatggtgtccctgatgaagaccctgaaggtgcacagcagcggcaagcccatcccagcctctgtggtgctgaagagggtgctgctgcggcacaccaaggagatcgtgtctgacctgattgacagctgcatgaagaacctgcacaacatcactggagtgctgatgacagacagcgactttgtgtctgctgtgaagaggaacctcttcaaccagtggaagcagaatgccacagacatcatggaggccatgctgaagaggctggtgtctgccctgattggagaggagaaggagaccaagagccagagcctgtcctatgccagcctgaaggccggcagccatgaccccaagtgcaggaaccagagcctggagttcagcaccatgaaggccgagatgaaggagcgggacaagggcaagatgaagagtgacccctgcaagagcctgaccagcgctgagaaggtgggggagcacatcctgaaggagggcctgaccatctggaaccagaagcagggcaacagctgcaaggtggccaccaaggcctgcagcaacaaggatgagaagggggagaagatcaatgccagcacagacagcctggccaaggacctgattgtgtctgccctgaagctgatccagtaccacctgacccagcagaccaagggcaaggacacctgtgaggaggactgccccggcagcaccatgggctacatggcccagagcacccagtatgaaaaatgtggcggcggccagagcgccaaggccctgtctgtgaagcagctggagagccaccgggcccctggccccagcacctgccagaaggagaaccagcacctggacagccagaagatggacatgagcaacatcgtgctgatgctgatccagaagctgctgaatgaaaaccccttcaagtgtgaggacccctgtgaaggagaaaataaatgttctgagccccgggccagcaaggccgcctccatgagcaacagaagtgacaaggccgaggagcagtgccaggagcaccaggagctggactgcaccagcggcatgaagcaggccaacggccagttcatcgacaagctggtggagagcgtgatgaagctgtgcctgatcatggccaagtacagcaatgatggagctgccctggccgagctggaggagcaggccgccagcgccaacaagcccaacttccggggcacccgctgcatccacagcggggccatgccccagaactaccaggacagcctgggccacgaggtgattgtgaacaaccagtgcagcaccaacagcctgcagaagcagctgcaggccgtgctgcagtggattgctgccagccagttcaacgtgcccatgctgtacttcatgggagacaaggatggccagctggagaagctgccccaggtgtctgccaaggctgctgagaagggctacagcgtgggcggcctgctgcaggaggtgatgaagtttgccaaggagcggcagccagatgaggccgtgggcaaggtggccaggaagcagctgctggactggctgctggccaacctgtag

SEQ ID NO: 142094 - DNA, 1416 bp, Artificial Sequence
  Description of Artificial Sequence: Synthetic coding sequence
atgtctgatgacatcgactggctgcggagccacagaggagtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagaacacctgtgaggaggactgccccggcagcaccatgggctacatggcccagagcacccagtatgaaaaatgtggcggcggccagagcgccaaggccctgtctgtgaagcagctggagagccaccgggcccctggccccagcacctgccagaaggagaaccagcacctggacagccagaagatggacatgagcaacatcgtgctgatgctgatccagaagctgctgaatgaaaaccccttcaagtgtgaggacccctgtgaaggagaaaataaatgttctgagccccgggccagcaaggccgcctccatgagcaacagaagtgacaaggccgaggagcagtgccaggagcaccaggagctggactgcaccagcggcatgaagcaggccaacggccagttcatcgacaagctggtggagagcgtgatgaagctgtgcctgatcatggccaagtacagcaatgatggagctgccctggccgagctggaggagcaggccgccagcgccaacaagcccaacttccggggcacccgctgcatccacagcggggccatgccccagaactaccaggacagcctgggccacgaggtgattgtgaacaaccagtgcagcaccaacagcctgcagaagcagctgcaggccgtgctgcagtggattgctgccagccagttcaacgtgcccatgctgtacttcatgggagacaaggatggccagctggagaagctgccccaggtgtctgccaaggctgctgagaagggctacagcgtgggcggcctgctgcaggaggtgatgaagtttgccaaggagcggcagccagatgaggccgtgggcaaggtggccaggaagcagctgctggactggctgctggccaacctgtag

SEQ ID NO: 142095 - DNA, 2538 bp, Artificial Sequence; identical to SEQ ID NO: 142093
  Description of Artificial Sequence: Synthetic coding sequence

SEQ ID NO: 142096 - DNA, 765 bp, Artificial Sequence
  Description of Artificial Sequence: Synthetic coding sequence
atgtctgatgacatcgactggctgcggagccacagaggagtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagagccccagcgcccccccagccaagccacccagcacccagagagctgtgatcagcccagatggagagtgcagcattgatgacctgtccttctacgtgaaccggctgagcagcctggtgatccagatggcccacaaggagatcaaggagaagctggagggcaagagcaagtgcctgcaccacagcatctgccccagccctggcaacaaggagcgcatcagcccctag

SEQ ID NO: 142097 - DNA, 642 bp, Artificial Sequence
  Description of Artificial Sequence: Synthetic coding sequence
atgtctgatgacatcgactggctgcggagccacagaggagtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagaacacctgtgaggaggactgccccggcagcaccatgggctacatggcccagagcacccagtatgaaaaatgtggcggcggccagagcgccaaggccctgtag

SEQ ID NO: 142098 - DNA, 552 bp, Artificial Sequence
  Description of Artificial Sequence: Synthetic coding sequence
atggacaactgcctggccgccgccgccctgaatggagtggacagaagaagcctgcagaggtctgcccggctggccctggaggtgctggagcgggccaagagaagagctgtggactggcacgccctggagcggcccaagggctgcatgggcgtgctggcccgggaggccccccacctggagaagcagcctgctgctggcccccagagggtgctgcccggggagaagtactacagctctgtgcctgaggagggcggggccacccacgtgtaccgctaccacagaggagagagcaagctgcacatgtgcctggacattggaaatggccagaggaaggacaggaagaagaccagcctgggccctgggggcagctaccagatcagcgagcacgcccctgaggccagccagcctgctgagaacatcagcaaggacctgtacatcgaggtgtacccaggcacctacagcgtgacagtgggcagcaatgacctgaccaagaagacccacgtggtggccgtggacagcggccagagcgtggacctggtgtttcctgtgtag

SEQ ID NO: 142099 - DNA, 552 bp, Artificial Sequence
  Description of Artificial Sequence: Synthetic coding sequence
atggacaactgcctggccgccgccgccctgaatggagtggacagaagaagcctgcagaggtctgcccggctggccctggaggtgctggagcgggccaagagaagagctgtggactggcacgccctggagcggcccaagggctgcatgggcgtgctggcccgggaggccccccacctggagaagcagcctgctgctggcccccagagggtgctgcccggggagcgggaggagaggcctcccaccctgagcgccagcttccgcaccatggccgagttcatggactacaccagcagccagtgtgggaagtactacagctctgtgcctgaggagggcggggccacccacgtgtaccgctaccacagaggagagagcaagctgcacatgtgcctggacattggaaatggccaggccgagaacatcagcaaggacctgtacatcgaggtgtacccaggcacctacagcgtgacagtgggcagcaatgacctgaccaagaagacccacgtggtggccgtggacagcggccagagcgtggacctggtgtttcctgtgtag

SEQ ID NO: 142100 - DNA, 633 bp, Artificial Sequence
  Description of Artificial Sequence: Synthetic coding sequence
atggacaactgcctggccgccgccgccctgaatggagtggacagaagaagcctgcagaggtctgcccggctggccctggaggtgctggagcgggccaagagaagagctgtggactggcacgccctggagcggcccaagggctgcatgggcgtgctggcccgggaggccccccacctggagaagcagcctgctgctggcccccagagggtgctgcccggggagcgggaggagaggcctcccaccctgagcgccagcttccgcaccatggccgagttcatggactacaccagcagccagtgtgggaagtactacagctctgtgcctgaggagggcggggccacccacgtgtaccgctaccacagaggagagagcaagctgcacatgtgcctggacattggaaatggccagaggaaggacaggaagaagaccagcctgggccctgggggcagctaccagatcagcgagcacgcccctgaggccagccagcctgctgagaacatcagcaaggacctgtacatcgaggtgtacccaggcacctacagcgtgacagtgggcagcaatgacctgaccaagaagacccacgtggtggccgtggacagcggccagagcgtggacctggtgtttcctgtgtag

SEQ ID NO: 142101 - DNA, 552 bp, Artificial Sequence; identical to SEQ ID NO: 142098
  Description of Artificial Sequence: Synthetic coding sequence

SEQ ID NO: 142102 - DNA, 633 bp, Artificial Sequence; identical to SEQ ID NO: 142100
  Description of Artificial Sequence: Synthetic coding sequence

SEQ ID NO: 142103 - DNA, 1479 bp, Artificial Sequence
  Description of Artificial Sequence: Synthetic coding sequence
atgggcttccagaggcgcttcttccaccaggaccagagccctgtgggcggcctgacagcagaagatattgagaaggcccggcaggccaaggcccggcctgagaacaagcagcacaagcagaccctgtctgaacatgcccgggagaggaaggtgcctgtgacccgcatcggccgcctggccaactttggaggcctggccgtgggcctgggctttggagccctggccgaggtggccaagaagagcctgcggtctgaggaccccagcggcaagaaggctgtgctgggcagcagccccttcctgtctgaggccaatgctgagcgcatcgtgaggaccctgtgcaaggtgcggggggccgccctgaagctgggccagatgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgacaggagcttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142104 - DNA, 1719 bp, Artificial Sequence
  Description of Artificial Sequence: Synthetic coding sequence
atggccgccatcctgggggacaccatcatggtggccaagggcctggtgaagctgacccaggccgctgtggagacccacctgcagcacctgggcatcggcggggagctgatcatgggccctgccccagcctacgtggccagcggccccttccgggaggccggcttccctggccaggccagcagccccctgggccgggccaacggccgcctgtttgccaacccccgggacagcttcagcgccatgggcttccagaggcgcttcttccaccaggaccagagccctgtgggcggcctgacagcagaagatattgagaaggcccggcaggccaaggcccggcctgagaacaagcagcacaagcagaccctgtctgaacatgcccgggagaggaaggtgcctgtgacccgcatcggccgcctggccaactttggaggcctggccgtgggcctgggctttggagccctggccgaggtggccaagaagagcctgcggtctgaggaccccagcggcaagaaggctgtgctgggcagcagccccttcctgtctgaggccaatgctgagcgcatcgtgaggaccctgtgcaaggtgcggggggccgccctgaagctgggccagatgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgacaggagcttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142105 - DNA, 1944 bp, Artificial Sequence
  Description of Artificial Sequence: Synthetic coding sequence
atggccgccatcctgggggacaccatcatggtggccaagggcctggtgaagctgacccaggccgctgtggagacccacctgcagcacctgggcatcggcggggagctgatcatggccgcccgggccctgcagagcacagctgtggagcagatcggcatgttcctgggcaaggtgcagggccaggacaagcatgaggagtactttgctgagaactttggaggccctgagggggagttccacttctctgtgccccacgccgccggggccagcacagacttcagcagcgccagcgccccagaccagagcgccccacccagcctgggccacgcccacagcgagggccctgccccagcctacgtggccagcggccccttccgggaggccggcttccctggccaggccagcagccccctgggccgggccaacggccgcctgtttgccaacccccgggacagcttcagcgccatgggcttccagaggcgcttcttccaccaggaccagagccctgtgggcggcctgacagctgaggacatcgagaaggcccggcaggccaaggcccggcctgagaacaagcagcacaagcagaccctgtctgagcacgcccgggagaggaaggtgcctgtgaccagaattggccgcctggccaactttggaggcctggccgtgggcctgggctttggagccctggccgaggtggccaagaagagcctgcggtctgaggaccccagcggcaagaaggctgtgctgggcagcagccccttcctgtctgaggccaatgctgagagaattgtgaggaccctgtgcaaggtgagaggagctgccctgaagctgggccagatgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgaccgctccttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142106 - DNA, 1788 bp, Artificial Sequence
  Description of Artificial Sequence: Synthetic coding sequence
atgttcctgggcaaggtgcagggccaggacaagcatgaggagtactttgctgagaactttggaggccctgagggggagttccacttctctgtgccccacgccgccggggccagcacagacttcagcagcgccagcgccccagaccagagcgccccacccagcctgggccacgcccacagcgagggccctgccccagcctacgtggccagcggccccttccgggaggccggcttccctggccaggccagcagccccctgggccgggccaacggccgcctgtttgccaacccccgggacagcttcagcgccatgggcttccagaggcgcttcttccaccaggaccagagccctgtgggcggcctgacagctgaggacatcgagaaggcccggcaggccaaggcccggcctgagaacaagcagcacaagcagaccctgtctgagcacgcccgggagaggaaggtgcctgtgaccagaattggccgcctggccaactttggaggcctggccgtgggcctgggctttggagccctggccgaggtggccaagaagagcctgcggtctgaggaccccagcggcaagaaggctgtgctgggcagcagccccttcctgtctgaggccaatgctgagagaattgtgaggaccctgtgcaaggtgagaggagctgccctgaagctgggccagatgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgaccgctccttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142107 - DNA, 1944 bp, Artificial Sequence; identical to SEQ ID NO: 142105
  Description of Artificial Sequence: Synthetic coding sequence

SEQ ID NO: 142108 - DNA, 1797 bp, Artificial Sequence
  Description of Artificial Sequence: Synthetic coding sequence
atggccgcccgggccctgcagagcacagctgtggagcagatcggcatgttcctgggcaaggtgcagggccaggacaagcatgaggagtactttgctgaaaattttggaggccctgagggggagttccacttcagcagcgccagcgccccagaccagagcgccccacccagcctgggccacgcccacagcgagggccctgccccagcctacgtggccagcggccccttccgggaggccggcttccctggccaggccagcagccccctgggccgggccaacggccgcctgtttgccaacccccgggacagcttcagcgccatgggcttccagaggcgcttcttccaccaggaccagagccctgtgggcggcctgacagcagaagatattgagaaggcccggcaggccaaggcccggcctgagaacaagcagcacaagcagaccctgtctgaacatgcccgggagaggaaggtgcctgtgacccgcatcggccgcctggccaactttggaggcctggccgtgggcctgggctttggagccctggccgaggtggccaagaagagcctgcggtctgaggaccccagcggcaagaaggctgtgctgggcagcagccccttcctgtctgaggccaatgctgagcgcatcgtgaggaccctgtgcaaggtgcggggggccgccctgaagctgggccagatgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgacaggagcttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142109 - DNA, 966 bp, Artificial Sequence
  Description of Artificial Sequence: Synthetic coding sequence
atgctgagcatccaggatgatgccttcatcaacccccacctggccaagatctttgagcgggtgcggcagagcgctgacttcatgcccctgaagcagatgatgtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgaccgctccttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142110 - DNA, 1107 bp, Artificial Sequence
  Description of Artificial Sequence: Synthetic coding sequence
atgctgagcatccaggatgatgccttcatcaacccccacctggccaagatctttgagcgggtgcggcagagcgctgacttcatgcccctgaagcagatgatgaagaccctgaacaatgacctgggccccaactggagggacaagctggagtactttgaggagcggccctttgctgctgccagcatcggccaggtgcacctggccaggatgaagggcggccgggaggtggccatgaagatccagtacccaggagtggcccagagcatcaacagtgatgtgaacaacctgatggctgtgctgaacatgagcaacatgctgcctgagggcctcttccctgagcacctgattgatgtgctgcggcgggagctggccctggagtgtgactaccagcgggaggccgcctgtgccaggaagttccgggacctgctgaagggccaccccttcttctacgtgcctgagatcgtggatgagctgtgcagcccccacgtgctgaccacagagctggtgtctggcttccccctggaccaggccgagggcctgagccaggagatcagaaatgagatctgctacaacatcctggtgctgtgcctgcgggagctgtttgagttccacttcatgcagacagaccccaactggagcaacttcttctatgacccccagcagcacaaggtggccctgctggactttggagccacccgggagtatgacaggagcttcacagacctgtacatccagatcatccgggctgctgctgaccgggaccgggagaccgtgcgggccaagagcattgagatgaagttcctgaccggctatgaggtgaaggtgatggaggatgcccacctggatgccatcctgatcctgggggaggcctttgccagtgatgagccctttgattttggcacccagagcaccacagagaagatccacaacctgatccctgtgatgctgcggcaccggctggtgcccccacctgaggagacctacagcctgcacaggaagatgggcggcagcttcctgatctgcagcaagctgaaggcccgcttcccctgcaaggccatgtttgaggaggcctacagcaactactgcaagaggcaggcccagcagtag

SEQ ID NO: 142111 - DNA, 3591 bp, Artificial Sequence
  Description of Artificial Sequence: Synthetic coding sequence
atgcccacagctgagagcgaggccaaggtgaagaccaaggtgcgctttgaggagctgctgaagacccacagcgacctgatgagggagaagaagaagctgaagaagaagctggtgcgctctgaggagaacatcagcccagacaccatccgcagcaacctgcactacatgaaggagaccaccagtgatgatcctgacaccatccgcagcaacctgccccacatcaaggagaccaccagtgatgatgtgtctgctgccaacaccaacaacctgaagaagagcaccagggtgaccaagaacaagctgaggaacacccagctggccacagagaaccccaatggagatgcctctgtggaggaggacaagcagggcaagcccaacaagaaggtgatcaagacagtgccccagctgaccacccaggacctgaagccagagaccccagagaacaaggtggacagcacccaccagaagacccacaccaagccccagcccggggtggaccaccagaagtctgagaaggccaatgaaggccgggaggagacagacctggaggaggatgaggagctgatgcaggcctaccagtgccacgtgacagaggagatggccaaggagatcaagaggaagatcaggaagaagctgaaggagcagctgacctacttccccagcgacaccctcttccatgatgacaagctgagcagcgagaagaggaagaagaagaaggaggtgcctgtgttcagcaaggccgagaccagcaccctgaccatcagcggggacacagtggagggggagcagaagaaggagagctctgtgcgctctgtgtccagtgacagccaccaggatgatgagatcagctccatggagcagagcacagaggacagcatgcaggatgacaccaagcccaagcccaagaagaccaagaagaagaccaaggctgtggccgacaacaatgaagatgtggatggagatggagtgcatgagatcaccagccgggacagccctgtgtaccccaagtgcctgctggatgatgacctggtgctgggcgtgtacatccacaggacagaccggctgaagagtgacttcatgatcagccaccccatggtgaagatccacgtggtggatgagcacacaggccagtatgtgaagaaggatgacagcggccggcctgtgagcagctactatgagaaggaaaatgtggactacatcctgcccatcatgacccagccctatgacttcaagcagctgaagagccggctgcctgagtgggaggagcagatcgtgttcaatgaaaacttcccctacctgctgcggggcagtgatgagagccccaaggtgatcctcttctttgagatcctggacttcctgtctgtggatgagatcaagaacaacagcgaggtgcagaaccaggagtgtggcttcaggaagatcgcctgggccttcctgaagctgctgggcgccaatggaaatgccaacatcaacagcaagctgcggctgcagctgtactacccacccaccaagcccaggagccccctgtctgtggtggaggcctttgagtggtggagcaagtgccccaggaaccactaccccagcaccctgtatgtgacagtgcggggcctgaaggtgcctgactgcatcaagcccagctaccgctccatgatggccctgcaggaggagaagggcaagcctgtgcactgtgagcggcaccacgagagcagctctgtggacacagagcccggcctggaggagagcaaggaggtgatcaagtggaagaggctgcccggccaggcctgccgcatccccaacaagcacctgttcagcctgaatgctggggagcggggctgcttctgcctggacttcagccacaacggccgcatcctggccgccgcctgtgccagcagagatggctaccccatcatcctgtatgagatccccagcggccgcttcatgagggagctgtgtggccacctgaacatcatctatgacctgtcctggagcaaggatgaccactacatcctgaccagcagcagtgatggaacagcccgcatctggaagaatgagatcaacaacaccaacaccttccgggtgctgccccaccccagctttgtgtacacagccaagttccaccctgctgtgcgggagctggtggtgacaggctgctatgacagcatgatccgcatctggaaggtggagatgagagaagattctgccatcctggtgcggcagtttgatgtgcacaagagcttcatcaacagcctgtgctttgacacagagggccaccacatgtacagcggggactgcacaggagtcatcgtggtgtggaacacctacgtgaagatcaatgacctggagcacagcgtgcaccactggaccatcaacaaggagatcaaggagacagagttcaagggcatccccatctcctacctggagatccaccccaacgggaagaggctgctgatccacaccaaggacagcaccctgcgcatcatggacctgcgcatcctggtggccaggaagtttgtgggcgccgccaactaccgggagaagatccacagcaccctgaccccctgtggcaccttcctgtttgctggctctgaagatggcatcgtgtatgtgtggaaccctgagaccggggagcaggtggccatgtacagcgacctgcccttcaagagccccatccgggacatctcctaccacccctttgagaacatggtggccttctgtgccttcggccagaatgagcccatcctgctgtacatctatgacttccacgtggcccagcaggaggccgagatgttcaagcgctacaacggcaccttccccctgcccggcatccaccagagccaggatgccctgtgcacctgccccaagctgccccaccagggcagcttccagattgatgaatttgtgcacacagagagcagcagcaccaagatgcagctggtgaagcagaggctggagaccgtgacagaggtgatccgcagctgtgccgccaaggtgaacaagaacctgtccttcaccagccccccagctgtgagcagccagcagagcaagctgaagcagagcaacatgctgacagcccaggagatcctgcaccagtttggcttcacccagacaggcatcatcagcattgaaaggaagccctgcaaccaccaggtggacacagcccccaccgtggtggccctgtatgactacacagccaacagaagtgatgagctgaccatccacagaggagacatcatccgggtcttcttcaaggacaatgaagactggtggtacggcagcatcggcaagggccaggagggctacttccctgccaaccacgtggccagcgagaccctgtaccaggagctgcccccagagatcaaggagaggagcccccccctgagccctgaggagaagaccaagattgagaagagccctgccccccagaagcagagcatcaacaagaacaagagccaggacttccggctgggcagcgagagcatgacccacagcgagatgaggaaggagcagagccatgaggaccagggccacatcatggacaccaggatgaggaagaacaagcaggccggcaggaaggtgaccctgattgaatag

SEQ ID NO: 142112 - DNA, 3162 bp, Artificial Sequence
  Description of Artificial Sequence: Synthetic coding sequence
atgcccacagctgagagcgaggccaaggtgaagaccaaggtgcgctttgaggagctgctgaagacccacagcgacctgatgagggagaagaagaagctgaagaagaagctggtgcgctctgaggagaacatcagcccagacaccatccgcagcaacctgcactacatgaaggagaccaccagtgatgatcctgacaccatccgcagcaacctgccccacatcaaggagaccaccagtgatgatgtgtctgctgccaacaccaacaacctgaagaagagcaccagggtgaccaagaacaagctgaggaacacccagctggccacagagaaccccaatggagatgcctctgtggaggaggacaagcagggcaagcccaacaagaaggtgatcaagacagtgccccagctgaccacccaggacctgaagccagagaccccagagaacaaggtggacagcacccaccagaagacccacaccaagccccagcccggggtggaccaccagaagtctgagaaggccaatgaaggccgggaggagacagacctggaggaggatgaggagctgatgcaggcctaccagtgccacgtgacagaggagatggccaaggagatcaagaggaagatcaggaagaagctgaaggagcagctgacctacttccccagcgacaccctcttccatgatgacaagctgagcagcgagaagaggaagaagaagaaggaggtgcctgtgttcagcaaggccgagaccagcaccctgaccatcagcggggacacagtggagggggagcagaagaaggagagctctgtgcgctctgtgtccagtgacagccaccaggatgatgagatcagctccatggagcagagcacagaggacagcatgcaggatgacaccaagcccaagcccaagaagaccaagaagaagaccaaggctgtggccgacaacaatgaagatgtggatggagatggagtgcatgagatcaccagccgggacagccctgtgtaccccaagtgcctgctggatgatgacctggtgctgggcgtgtacatccacaggacagaccggctgaagagtgacttcatgatcagccaccccatggtgaagatccacgtggtggatgagcacacaggccagtatgtgaagaaggatgacagcggccggcctgtgagcagctactatgagaaggaaaatgtggactacatcctgcccatcatgacccagccctatgacttcaagcagctgaagagccggctgcctgagtgggaggagcagatcgtgttcaatgaaaacttcccctacctgctgcggggcagtgatgagagccccaaggtgatcctcttctttgagatcctggacttcctgtctgtggatgagatcaagaacaacagcgaggtgcagaaccaggagtgtggcttcaggaagatcgcctgggccttcctgaagctgctgggcgccaatggaaatgccaacatcaacagcaagctgcggctgcagctgtactacccacccaccaagcccaggagccccctgtctgtggtggaggcctttgagtggtggagcaagtgccccaggaaccactaccccagcaccctgtatgtgacagtgcggggcctgaaggtgcctgactgcatcaagcccagctaccgctccatgatggccctgcaggaggagaagggcaagcctgtgcactgtgagcggcaccacgagagcagctctgtggacacagagcccggcctggaggagagcaaggaggtgatcaagtggaagaggctgcccggccaggcctgccgcatccccaacaagcacctgttcagcctgaatgctggggagcggggctgcttctgcctggacttcagccacaacggccgcatcctggccgccgcctgtgccagcagagatggctaccccatcatcctgtatgagatccccagcggccgcttcatgagggagctgtgtggccacctgaacatcatctatgacctgtcctggagcaaggatgaccactacatcctgaccagcagcagtgatggaacagcccgcatctggaagaatgagatcaacaacaccaacaccttccgggtgctgccccaccccagctttgtgtacacagccaagttccaccctgctgtgcgggagctggtggtgacaggctgctatgacagcatgatccgcatctggaaggtggagatgagagaagattctgccatcctggtgcggcagtttgatgtgcacaagagcttcatcaacagcctgtgctttgacacagagggccaccacatgtacagcggggactgcacaggagtcatcgtggtgtggaacacctacgtgaagatcaatgacctggagcacagcgtgcaccactggaccatcaacaaggagatcaaggagacagagttcaagggcatccccatctcctacctggagatccaccccaacgggaagaggctgctgatccacaccaaggacagcaccctgcgcatcatggacctgcgcatcctggtggccaggaagtttgtgggcgccgccaactaccgggagaagatccacagcaccctgaccccctgtggcaccttcctgtttgctggctctgaagatggcatcgtgtatgtgtggaaccctgagaccggggagcaggtggccatgtacagcgacctgcccttcaagagccccatccgggacatctcctaccacccctttgagaacatggtggccttctgtgccttcggccagaatgagcccatcctgctgtacatctatgacttccacgtggcccagcaggaggccgagatgttcaagcgctacaacggcaccttccccctgcccggcatccaccagagccaggatgccctgtgcacctgccccaagctgccccaccagggcagcttccagattgatgaatttgtgcacacagagagcagcagcaccaagatgcagctggtgaagcagaggctggagaccgtgacagaggtgatccgcagctgtgccgccaaggtgaacaagaacctgtccttcaccagccccccagctgtgagcagccagcagagcaagctgaagcagagcaacatgctgacagcccaggagatcctgcaccagtttggcttcacccagacagacagccactttgctgagttcaacacctgcatcctgtggtggaagaagcactag

SEQ ID NO: 142113 - DNA, 165 bp, Artificial Sequence
  Description of Artificial Sequence: Synthetic coding sequence
atgcccacagctgagagcgaggccaaggtgaagaccaaggtgcgctttgaggagctgctgaagacccacagcgacctgatgagggagaagaagaagctgaagaagaagctggtgcgctctgaggagaacatcagcaaccaggagaagtccatggctgtgtggtag

SEQ ID NO: 142114 - DNA, 3591 bp, Artificial Sequence; identical to SEQ ID NO: 142111
  Description of Artificial Sequence: Synthetic coding sequence

SEQ ID NO: 142115 - DNA, 3162 bp, Artificial Sequence
  Description of Artificial Sequence: Synthetic coding sequence
atgcccaccacagagagcgaggccaaggtgaagaccaaggtgcgctttgaggagctgctgaagacccacagcgacctgatgagggagaagaagaagctgaagaagaagctggtgcgctctgaggagaacatcagcccagacaccatccgcagcaacctgcactacatgaaggagaccaccagtgatgatcctgacaccatccgcagcaacctgccccacatcaaggagaccaccagtgatgatgtgtctgctgccaacaccaacaacctgaagaagagcaccagggtgaccaagaacaagctgaggaacacccagctggccacagagaaccccaatggagatgcctctgtggaggaggacaagcagggcaagcccaacaagaaggtgatcaagacagtgccccagctgaccacccaggacctgaagccagagaccccagagaacaaggtggacagcacccaccagaagacccacaccaagccccagcccggggtggaccaccagaagtctgagaaggccaatgaaggccgggaggagacagacctggaggaggatgaggagctgatgcaggcctaccagtgccacgtgacagaggagatggccaaggagatcaagaggaagatcaggaagaagctgaaggagcagctgacctacttccccagcgacaccctcttccatgatgacaagctgagcagcgagaagaggaagaagaagaaggaggtgcctgtgttcagcaaggccgagaccagcaccctgaccatcagcggggacacagtggagggggagcagaagaaggagagctctgtgcgctctgtgtccagtgacagccaccaggatgatgagatcagctccatggagcagagcacagaggacagcatgcaggatgacaccaagcccaagcccaagaagaccaagaagaagaccaaggctgtggccgacaacaatgaagatgtggatggagatggagtgcatgagatcaccagccgggacagccctgtgtaccccaagtgcctgctggatgatgacctggtgctgggcgtgtacatccacaggacagaccggctgaagagtgacttcatgatcagccaccccatggtgaagatccacgtggtggatgagcacacaggccagtatgtgaagaaggatgacagcggccggcctgtgagcagctactatgagaaggaaaatgtggactacatcctgcccatcatgacccagccctatgacttcaagcagctgaagagccggctgcctgagtgggaggagcagatcgtgttcaatgaaaacttcccctacctgctgcggggcagtgatgagagccccaaggtgatcctcttctttgagatcctggacttcctgtctgtggatgagatcaagaacaacagcgaggtgcagaaccaggagtgtggcttcaggaagatcgcctgggccttcctgaagctgctgggcgccaatggaaatgccaacatcaacagcaagctgcggctgcagctgtactacccacccaccaagcccaggagccccctgtctgtggtggaggcctttgagtggtggagcaagtgccccaggaaccactaccccagcaccctgtatgtgacagtgcggggcctgaaggtgcctgactgcatcaagcccagctaccgctccatgatggccctgcaggaggagaagggcaagcctgtgcactgtgagcggcaccacgagagcagctctgtggacacagagcccggcctggaggagagcaaggaggtgatcaagtggaagaggctgcccggccaggcctgccgcatccccaacaagcacctgttcagcctgaatgctggggagcggggctgcttctgcctggacttcagccacaacggccgcatcctggccgccgcctgtgccagcagagatggctaccccatcatcctgtatgagatccccagcggccgcttcatgagggagctgtgtggccacctgaacatcatctatgacctgtcctggagcaaggatgaccactacatcctgaccagcagcagtgatggaacagcccgcatctggaagaatgagatcaacaacaccaacaccttccgggtgctgccccaccccagctttgtgtacacagccaagttccaccctgctgtgcgggagctggtggtgacaggctgctatgacagcatgatccgcatctggaaggtggagatgagagaagattctgccatcctggtgcggcagtttgatgtgcacaagagcttcatcaacagcctgtgctttgacacagagggccaccacatgtacagcggggactgcacaggagtcatcgtggtgtggaacacctacgtgaagatcaatgacctggagcacagcgtgcaccactggaccatcaacaaggagatcaaggagacagagttcaagggcatccccatctcctacctggagatccaccccaacgggaagaggctgctgatccacaccaaggacagcaccctgcgcatcatggacctgcgcatcctggtggccaggaagtttgtgggcgccgccaactaccgggagaagatccacagcaccctgaccccctgtggcaccttcctgtttgctggctctgaagatggcatcgtgtatgtgtggaaccctgagaccggggagcaggtggccatgtacagcgacctgcccttcaagagccccatccgggacatctcctaccacccctttgagaacatggtggccttctgtgccttcggccagaatgagcccatcctgctgtacatctatgacttccacgtggcccagcaggaggccgagatgttcaagcgctacaacggcaccttccccctgcccggcatccaccagagccaggatgccctgtgcacctgccccaagctgccccaccagggcagcttccagattgatgaatttgtgcacacagagagcagcagcaccaagatgcagctggtgaagcagaggctggagaccgtgacagaggtgatccgcagctgtgccgccaaggtgaacaagaacctgtccttcaccagccccccagctgtgagcagccagcagagcaagctgaagcagagcaacatgctgacagcccaggagatcctgcaccagtttggcttcacccagacagacagccactttgctgagttcaacacctgcatcctgtggtggaagaagcactag

SEQ ID NO: 142116 - DNA, 1497 bp, Artificial Sequence
  Description of Artificial Sequence: Synthetic coding sequence
atgagggagctgtgtggccacctgaacatcatctatgacctgtcctggagcaaggatgaccactacatcctgaccagcagcagtgatggaacagcccgcatctggaagaatgagatcaacaacaccaacaccttccgggtgctgccccaccccagctttgtgtacacagccaagttccaccctgctgtgcgggagctggtggtgacaggctgctatgacagcatgatccgcatctggaaggtggagatgagagaagattctgccatcctggtgcggcagtttgatgtgcacaagagcttcatcaacagcctgtgctttgacacagagggccaccacatgtacagcggggactgcacaggagtcatcgtggtgtggaacacctacgtgaagatcaatgacctggagcacagcgtgcaccactggaccatcaacaaggagatcaaggagacagagttcaagggcatccccatctcctacctggagatccaccccaacgggaagaggctgctgatccacaccaaggacagcaccctgcgcatcatggacctgcgcatcctggtggccaggaagtttgtgggcgccgccaactaccgggagaagatccacagcaccctgaccccctgtggcaccttcctgtttgctggctctgaagatggcatcgtgtatgtgtggaaccctgagaccggggagcaggtggccatgtacagcgacctgcccttcaagagccccatccgggacatctcctaccacccctttgagaacatggtggccttctgtgccttcggccagaatgagcccatcctgctgtacatctatgacttccacgtggcccagcaggaggccgagatgttcaagcgctacaacggcaccttccccctgcccggcatccaccagagccaggatgccctgtgcacctgccccaagctgccccaccagggcagcttccagattgatgaatttgtgcacacagagagcagcagcaccaagatgcagctggtgaagcagaggctggagaccgtgacagaggtgatccgcagctgtgccgccaaggtgaacaagaacctgtccttcaccagccccccagctgtgagcagccagcagagcaagctgaagcagagcaacatgctgacagcccaggagatcctgcaccagtttggcttcacccagacaggcatcatcagcattgaaaggaagccctgcaaccaccaggtggacacagcccccaccgtggtggccctgtatgactacacagccaacagaagtgatgagctgaccatccacagaggagacatcatccgggtcttcttcaaggacaatgaagactggtggtacggcagcatcggcaagggccaggagggctacttccctgccaaccacgtggccagcgagaccctgtaccaggagctgcccccagagatcaaggagaggagcccccccctgagccctgaggagaagaccaagattgagaagagccctgccccccagaaggtgaagtag

SEQ ID NO: 142117 - DNA, 3591 bp, Artificial Sequence; identical to SEQ ID NO: 142111
  Description of Artificial Sequence: Synthetic coding sequence

SEQ ID NO: 142118 - DNA, 1218 bp, Artificial Sequence
  Description of Artificial Sequence: Synthetic coding sequence
atgctgagcagcttcctgagcccccagaatggcacctgggccgacaccttcagcctgctgctggccctggccgtggccctgtacctgggctactactgggcctgtgtgctgcagaggccccggctggtggccggcccccagttcctggccttcctggagccccactgcagcatcaccacagagaccttctaccccaccctgtggtgctttgagggccgcctgcagagcatcttccaggtgctgctgcagagccagcccctggtgctgtaccagagcgacatcctgcagaccccagatggcggccagctgctgctggactgggccaagcagcctgacagcagccaggaccctgaccccaccacccagcccatcgtgctgctgctgcccggcatcaccggcagcagccaggacacctacgtgctgcacctggtgaaccaggccctgagagatggctaccaggccgtggtgttcaacaacagaggctgccgcggggaggagctgcggacccaccgggccttctgtgccagcaacacagaggacctggagaccgtggtgaaccacatcaagcaccgctacccccaggcccccctgctggccgtgggcatcagctttggaggcatcctggtgctgaaccacctggcccaggcccggcaggccgccggcctggtggccgccctgaccctgagcgcctgctgggacagctttgagaccaccaggagcctggagacccccctgaacagcctgctcttcaaccagcccctgacagctggcctgtgccagctggtggagaggaacaggaaggtgattgagaaggtggtggacatcgactttgtgctgcaggcccggaccatccggcagtttgatgagcgctacacctctgtggccttcggctaccaggactgtgtgacctactacaaggccgccagccccaggaccaagattgatgccatccgcatccctgtgctgtacctgtctgctgctgatgaccccttcagccctgtgtgtgccctgcccatccaggccgcccagcacagcccctacgtggccctgctgatcacagcccggggcggccacatcggcttcctggagggcctgctgccctggcagcactggtacatgagccggctgctgcaccagtatgccaaggccatcttccaggaccctgagggcctgcctgacctgcgggccctgctgcccagtgaagatagaaacagctag

SEQ ID NO: 142119 - DNA, 1197 bp, Artificial Sequence
  Description of Artificial Sequence: Synthetic coding sequence
atgaggaagaggacagagcctgtggccctggagcacgagcgctgtgccgccgccggcagcagcagcagcggcagcgctgctgctgccctggatgctgactgccgcctgaagcagaacctgcggctgactggacctgctgctgctgagccccgctgtgccgcagatgctggcatgaagagggccctgggccgcaggaagggcgtgtggctgcggctgaggaagatcctcttctgtgtgctgggcctgtacatcgccatccccttcctgatcaagctgtgccccggcatccaggccaagctgatcttcctgaactttgtgcgggtgccctacttcatcgacctgaagaagccccaggaccagggcctgaaccacacctgcaactactacctgcagcctgaggaggatgtgaccatcggcgtgtggcacacagtgcctgctgtgtggtggaagaatgcccagggcaaggaccagatgtggtatgaagatgccctggccagcagccaccccatcatcctgtacctgcatggaaatgccggcacccggggcggggaccaccgggtggagctgtacaaggtgctgagcagcctgggctaccacgtggtgacctttgactaccggggctggggagacagcgtgggcacccccagcgagcggggcatgacctatgatgccctgcacgtgtttgactggatcaaggcccggagcggggacaaccctgtgtacatctggggccacagcctgggcactggagtggccaccaacctggtgcggcggctgtgtgagcgggagaccccaccagatgccctgatcctggagagccccttcaccaacatccgggaggaggccaagagccaccccttcagcgtcatctaccgctacttccctggctttgactggttcttcctggaccccatcaccagcagcggcatcaagtttgccaatgatgaaaatgtgaagcacatcagctgccccctgctgatcctgcacgcagaagatgatcctgtggtgcccttccagctgggcaggaagctgtacagcattgctgccccagcccgctccttccgggacttcaaggtgcagtttgtgcccttccacagcgacctgggctaccgccacaagtacatctacaagagccctgagctgccccgcatcctgcgggagttcctgggcaagtctgagcctgagcaccagcactag

SEQ ID NO: 142120 - DNA, 1215 bp, Artificial Sequence
  Description of Artificial Sequence: Synthetic coding sequence
atgaggaagaggacagagcctgtggccctggagcacgagcgctgtgccgccgccggcagcagcagcagcggcagcgctgctgctgccctggatgctgactgccgcctgaagcagaacctgcggctgactggacctgctgctgctgagccccgctgtgccgcagatgctggcatgaagagggccctgggccgcaggaagggcgtgtggctgcggctgaggaagatcctcttctgtgtgctgggcctgtacatcgccatccccttcctgatcaagctgtgccccggcatccaggccaagctgatcttcctgaactttgtgcgggtgccctacttcatcgacctgaagaagccccaggaccagggcctgaaccacacctgcaactactacctgcagcctgaggaggatgtgaccatcggcgtgtggcacacagtgcctgctgtgtggtggaagaatgcccagggcaaggaccagatgtggtatgaagatgccctggccagcagccaccccatcatcctgtacctgcatggaaatgccggcacccggggcggggaccaccgggtggagctgtacaaggtgctgagcagcctgggctaccacgtggtgacctttgactaccggggctggggagacagcgtgggcacccccagcgagcggggcatgacctatgatgccctgcacgtgtttgactggatcaaggcccggagcggggacaaccctgtgtacatctggggccacagcctgggcactggagtggccaccaacctggtgcggcggctgtgtgagcgggagaccccaccagatgccctgatcctggagagccccttcaccaacatccgggaggaggccaagagccaccccttcagcgtcatctaccgctacttccctggctttgactggttcttcctggaccccatcaccagcagcggcatcaagtttgccaatgatgaaaatgtgaagcacatcagctgccccctgctgatcctgcacgcagaagatgatcctgtggtgcccttccagctgggcaggaagctgtacagcattgctgccccagcccgctccttccgggacttcaaggtgcagtttgtgcccttccacagcgacctgggctaccgccacaagtacatctacaagagccctgagctgccccgcatcctgcggccccagcagggccctggcagcagcccagaccccagcatgtggagcgagctggtgtag

SEQ ID NO: 142121 - DNA, 564 bp, Artificial Sequence
  Description of Artificial Sequence: Synthetic coding sequence
atgtctgggggcggccacggcggcgtgtgcttcctgtgctgcatcctgctgcagggcaggaaaggagtgtggctgcggctgaggaagatcctcttctgtgtgctgggcctgtacatcgccatccccttcctgatcaagctgtgccccggcatccaggccaagctgatcttcctgaactttgtgcgggtgccctacttcatcgacctgaagaagccccaggaccagggcctgaaccacacctgcaactactacctgcagccagaagaagatgtgaccatcggcgtgtggcacacagtgcctgctgtgtggtggaagaatgcccagggcaaggaccagatgtggtatgaagatgccctggccagcagccaccccatcatcctgtacctgcacggcaatgccggcacccggggcggggaccaccgggtggagctgtacaaggtgctgagcagcctgggctaccacgtggtgacctttgactaccggggctggggagacagcgtgggcaccccatctgagcggggcatgacctatgatgccctgcacgtgtttgactggatcaagtag

SEQ ID NO: 142122 - DNA, 1083 bp, Artificial Sequence
  Description of Artificial Sequence: Synthetic coding sequence
atgaggaagaggacagagcctgtggccctggagccccgctgtgccgcagatgctggcatgaagagggccctgggccgcaggaagggcgtgtggctgcggctgaggaagatcctcttctgtgtgctgggcctgtacatcgccatccccttcctgatcaagctgtgccccggcatccaggccaagctgatcttcctgaactttgtgcgggtgccctacttcatcgacctgaagaagccccaggaccagggcctgaaccacacctgcaactactacctgcagcctgaggaggatgtgaccatcggcgtgtggcacacagtgcctgctgtgtggtggaagaatgcccagggcaaggaccagatgtggtatgaagatgccctggccagcagccaccccatcatcctgtacctgcatggaaatgccggcacccggggcggggaccaccgggtggagctgtacaaggtgctgagcagcctgggctaccacgtggtgacctttgactaccggggctggggagacagcgtgggcacccccagcgagcggggcatgacctatgatgccctgcacgtgtttgactggatcaaggcccggagcggggacaaccctgtgtacatctggggccacagcctgggcactggagtggccaccaacctggtgcggcggctgtgtgagcgggagaccccaccagatgccctgatcctggagagccccttcaccaacatccgggaggaggccaagagccaccccttcagcgtcatctaccgctacttccctggctttgactggttcttcctggaccccatcaccagcagcggcatcaagtttgccaatgatgaaaatgtgaagcacatcagctgccccctgctgatcctgcacgcagaagatgatcctgtggtgcccttccagctgggcaggaagctgtacagcattgctgccccagcccgctccttccgggacttcaaggtgcagtttgtgcccttccacagcgacctgggctaccgccacaagtacatctacaagagccctgagctgccccgcatcctgcgggagttcctgggcaagtctgagcctgagcaccagcactag

SEQ ID NO: 142123 - DNA, 1020 bp, Artificial Sequence
  Description of Artificial Sequence: Synthetic coding sequence
atgctgtacccaggctctgtgtacctgctgcagaaggccctgatgcctgtgctgctgcagggccaggcccggctggtggaggagtgcaatggccggcgggccaagctgctggcctgtgatggaaatgaaattgacaccatgtttgtggacagaagaggaacagctgagccccagggccagaagctggtgatctgctgtgagggcaatgccggcttctatgaggtgggctgtgtgtccacccccctggaggccggctacagcgtgctgggctggaaccaccctggctttgctggcagcactggagtgcccttcccccagaatgaggccaatgccatggatgtggtggtgcagtttgccatccaccggctgggcttccagccccaggacatcatcatctatgcctggagcattggaggcttcaccgccacctgggccgccatgagctacccagatgtgtctgccatgatcctggatgccagctttgatgacctggtgcccctggccctgaaggtgatgccagacagctggaggggcctggtgaccaggacagtgcggcagcacctgaacctgaacaatgctgagcagctgtgccgctaccagggccctgtgctgctgatccggaggaccaaggatgagatcatcaccaccaccgtgcctgaggacatcatgagcaacagaggaaatgacctgctgctgaagctgctgcagcaccgctacccccgggtgatggccgaggagggcctgcgggtggtgcggcagtggctggaggccagcagccagctggaggaggccagcatctacagccgctgggaggtggaggaggactggtgcctgtctgtgctgcggagctaccaggccgagcacggccctgacttcccctggagcgtgggggaggacatgtctgcagatggaagacggcagctggccctcttcctggccaggaagcacctgcacaactttgaggccacccactgcacccccctgcctgcccagaacttccagatgccctggcacctgtag

SEQ ID NO: 142124 - DNA, 1677 bp, Artificial Sequence
  Description of Artificial Sequence: Synthetic coding sequence
atggccaagctgctgagctgtgtgctgggcccccggctgtacaagatctaccgggagcgggacagcgagcgggccccagcctctgtgcctgagacccccacagctgtgacagccccccacagcagctcctgggacacctactaccagccccgggccctggagaagcatgctgacagcatcctggccctggcctctgtgttctggagcatctcctactacagcagcccctttgccttcttctacctgtacaggaagggctacctgagcctgagcaaggtggtgcccttcagccactacgccggcaccctgctgctgctgctggccggcgtggcctgcctgcggggcatcggccgctggaccaacccccagtaccggcagttcatcaccatcctggaggccacccacaggaaccagagcagcgagaacaagaggcagctggccaactacaactttgacttccgctcctggcctgtggacttccactgggaggagcccagcagcaggaaggagagcagaggaggccccagcagaagaggagtggccctgctgcggcctgagcccctgcaccggggcacagctgacaccctgctgaacagagtgaagaagctgccctgccagatcaccagctacctggtggcccacaccctgggccgcaggatgctgtacccaggctctgtgtacctgctgcagaaggccctgatgcctgtgctgctgcagggccaggcccggctggtggaggagtgcaatggaagaagagccaagctgctggcctgtgatggaaatgaaattgacaccatgtttgtggaccggcggggcacagctgagccccagggccagaagctggtgatctgctgtgagggcaatgccggcttctatgaggtgggctgtgtgtccacccccctggaggccggctacagcgtgctgggctggaaccaccctggctttgctggcagcactggagtgcccttcccccagaatgaggccaatgccatggatgtggtggtgcagtttgccatccaccggctgggcttccagccccaggacatcatcatctatgcctggagcatcggcggcttcaccgccacctgggccgccatgagctacccagatgtgtctgccatgatcctggatgccagctttgatgacctggtgcccctggccctgaaggtgatgccagacagctggaggggcctggtgaccaggacagtgcggcagcacctgaacctgaacaatgctgagcagctgtgccgctaccagggccctgtgctgctgatccggaggaccaaggatgagatcatcaccaccaccgtgcctgaggacatcatgagcaacagaggaaatgacctgctgctgaagctgctgcagcaccgctacccccgggtgatggccgaggagggcctgcgggtggtgcggcagtggctggaggccagcagccagctggaggaggccagcatctacagccgctgggaggtggaggaggactggtgcctgtctgtgctgcggagctaccaggccgagcacggccctgacttcccctggagcgtgggggaggacatgtctgcagatggccggcggcagctggccctcttcctggccaggaagcacctgcacaactttgaggccacccactgcacccccctgcctgcccagaacttccagatgccctggcacctgtag

SEQ ID NO: 142125 - DNA, 1806 bp, Artificial Sequence
  Description of Artificial Sequence: Synthetic coding sequence
atgagccagctggccaggagaagaagccgctatggcctgaccagccgggcccacaacaccagcgaggccggccgggccggccctgctgggggccctgctgctggccgggccgccgcccgggccggggccatggccaagctgctgagctgtgtgctgggcccccggctgtacaagatctaccgggagcgggacagcgagcgggccccagcctctgtgcctgagacccccacagctgtgacagccccccacagcagctcctgggacacctactaccagccccgggccctggagaagcacgccgacagcatcctggccctggccagcgtcttctggagcatctcctactacagcagcccctttgccttcttctacctgtacaggaagggctacctgagcctgagcaaggtggtgcccttcagccactacgccggcaccctgctgctgctgctggccggcgtggcctgcctgcggggcatcggccgctggaccaacccccagtaccggcagttcatcaccatcctggaggccacccacaggaaccagagcagcgagaacaagaggcagctggccaactacaactttgacttccgctcctggcctgtggacttccactgggaggagcccagcagcaggaaggagagccggggcggccccagccggcggggcgtggccctgctgcggcctgagcccctgcaccggggcacagctgacaccctgctgaacagagtgaagaagctgccctgccagatcaccagctacctggtggcccacaccctgggccgcaggatgctgtacccaggctctgtgtacctgctgcagaaggccctgatgcctgtgctgctgcagggccaggcccggctggtggaggagtgcaatggccggcgggccaagctgctggcctgtgatggaaatgaaattgacaccatgtttgtggacagaagaggaacagctgagccccagggccagaagctggtgatctgctgtgagggcaatgccggcttctatgaggtgggctgtgtgtccacccccctggaggccggctacagcgtgctgggctggaaccaccctggctttgctggcagcactggagtgcccttcccccagaatgaggccaatgccatggatgtggtggtgcagtttgccatccaccggctgggcttccagccccaggacatcatcatctatgcctggagcattggaggcttcaccgccacctgggccgccatgagctacccagatgtgtctgccatgatcctggatgccagctttgatgacctggtgcccctggccctgaaggtgatgccagacagctggaggggcctggtgaccaggacagtgcggcagcacctgaacctgaacaatgctgagcagctgtgccgctaccagggccctgtgctgctgatccggaggaccaaggatgagatcatcaccaccaccgtgcctgaggacatcatgagcaacagaggaaatgacctgctgctgaagctgctgcagcaccgctacccccgggtgatggccgaggagggcctgcgggtggtgcggcagtggctggaggccagcagccagctggaggaggccagcatctacagccgctgggaggtggaggaggactggtgcctgtctgtgctgcggagctaccaggccgagcacggccctgacttcccctggagcgtgggggaggacatgtctgcagatggaagacggcagctggccctcttcctggccaggaagcacctgcacaactttgaggccacccactgcacccccctgcctgcccagaacttccagatgccctggcacctgtag

SEQ ID NO: 142126 - DNA, 795 bp, Artificial Sequence
  Description of Artificial Sequence: Synthetic coding sequence
atgcctcctccagccctcttcctgagcagcctgtacccccggctggagttccagaatgacttctaccgcagctgcatcagaagaagcagcccccagcccccacccaacctggcctggaggcctgagagcctgtacagcggggagctggccggcggcggctacctgagcctgagcaaggtggtgcccttcagccactacgccggcaccctgctgctgctgctggccggcgtggcctgcctgcggggcatcggccgctggaccaacccccagtaccggcagttcatcaccatcctggaggccacccacaggaaccagagcagcgagaacaagaggcagctggccaactacaactttgacttccgctcctggcctgtggacttccactgggaggagcccagcagcaggaaggagagccggggcggccccagccggcggggcgtggccctgctgcggcctgagcccctgcaccggggcacagctgacaccctgctgaacagagtgaagaagctgccctgccagatcaccagctacctggtggcccacaccctgggccgcaggatgctgtacccaggctctgtgtacctgctgcagaaggccctgatgcctgtgctgctgcagggccaggcccggctggtggaggagtgcaatggccggcgggccaagctgctggcctgtgatggaaatgaaattgacaccatgtttgtggacagaagaggaacagctgagccccagggccagaagctggtgatctgctgtgagggcaatgccggcttctatgaggtgggctgtgtgtag

SEQ ID NO: 142127 - DNA, 795 bp, Artificial Sequence; identical to SEQ ID NO: 142126
  Description of Artificial Sequence: Synthetic coding sequence

SEQ ID NO: 142128 - DNA, 795 bp, Artificial Sequence; identical to SEQ ID NO: 142126
  Description of Artificial Sequence: Synthetic coding sequence

SEQ ID NO: 142129 - DNA, 1806 bp, Artificial Sequence; identical to SEQ ID NO: 142125
  Description of Artificial Sequence: Synthetic coding sequence

SEQ ID NO: 142130 - DNA, 795 bp, Artificial Sequence; identical to SEQ ID NO: 142126
  Description of Artificial Sequence: Synthetic coding sequence

SEQ ID NO: 142131 - DNA, 1806 bp, Artificial Sequence; identical to SEQ ID NO: 142125
  Description of Artificial Sequence: Synthetic coding sequence

SEQ ID NO: 142132 - DNA, 795 bp, Artificial Sequence; identical to SEQ ID NO: 142126
  Description of Artificial Sequence: Synthetic coding sequence

SEQ ID NO: 142133 - DNA, 1806 bp, Artificial Sequence; identical to SEQ ID NO: 142125
  Description of Artificial Sequence: Synthetic coding sequence

SEQ ID NO: 142134 - DNA, 795 bp, Artificial Sequence; identical to SEQ ID NO: 142126
  Description of Artificial Sequence: Synthetic coding sequence

SEQ ID NO: 142135 - DNA, 1677 bp, Artificial Sequence; identical to SEQ ID NO: 142124
  Description of Artificial Sequence: Synthetic coding sequence

SEQ ID NO: 142136 - DNA, 1806 bp, Artificial Sequence; identical to SEQ ID NO: 142125
  Description of Artificial Sequence: Synthetic coding sequence

SEQ ID NO: 142137 - DNA, 438 bp, Artificial Sequence
  Description of Artificial Sequence: Synthetic coding sequence
atgctgggccactgctgctacttctggcaggtgtggccagccagcgaggccctggccgccggccccacccccagcacaggcagcagcagccccagctggaagcagcacatcggcaccagcctgcagaagacccggggcagcctgcccaccaccaccctgaccagcggggccggccagagcaccagcacaggcaagaacccagctgctggccgcagcctggagggcgccctgcctgctggggtgtggccctgctttgcccagagcccctgcacaggaggccagcagacccccagcagcacaggcctgcggagctgcctggtgcgcagccctgggggcaagcagcagagaggagaggcccactggggcggcggggccatctctggagtgctgtgggagtgggccctgcactgcaagattgctgtgacccactgggcctag

SEQ ID NO: 142138 - DNA, 1677 bp, Artificial Sequence; identical to SEQ ID NO: 142124
  Description of Artificial Sequence: Synthetic coding sequence

SEQ ID NO: 142139 - DNA, 1677 bp, Artificial Sequence; identical to SEQ ID NO: 142124
  Description of Artificial Sequence: Synthetic coding sequence

SEQ ID NO: 142140 - DNA, 1677 bp, Artificial Sequence; identical to SEQ ID NO: 142124
  Description of Artificial Sequence: Synthetic coding sequence

SEQ ID NO: 142141 - DNA, 438 bp, Artificial Sequence; identical to SEQ ID NO: 142137
  Description of Artificial Sequence: Synthetic coding sequence

SEQ ID NO: 142142 - DNA, 438 bp, Artificial Sequence; identical to SEQ ID NO: 142137
  Description of Artificial Sequence: Synthetic coding sequence

SEQ ID NO: 142143 - DNA, 438 bp, Artificial Sequence; identical to SEQ ID NO: 142137
  Description of Artificial Sequence: Synthetic coding sequence

SEQ ID NO: 142144 - DNA, 1578 bp, Artificial Sequence
  Description of Artificial Sequence: Synthetic coding sequence
atgcctcctccagccctcttcctgagcagcctgtacccccggctggagttccagaatgacttctaccgcagctgcatcagaagaagcagcccccagcccccacccaacctggcctggaggcctgagagcctgtacagcggggagctggccggcggcggctacctgagcctgagcaaggtggtgcccttcagccactacgccggcaccctgctgctgctgctggccggcgtggcctgcctgcggggcatcggccgctggaccaacccccagtaccggcagttcatcaccatcctggaggccacccacaggaaccagagcagcgagaacaagaggcagctggccaactacaactttgacttccgctcctggcctgtggacttccactgggaggagcccagcagcaggaaggagagccggggcggccccagccggcggggcgtggccctgctgcggcctgagcccctgcaccggggcacagctgacaccctgctgaacagagtgaagaagctgccctgccagatcaccagctacctggtggcccacaccctgggccgcaggatgctgtacccaggctctgtgtacctgctgcagaaggccctgatgcctgtgctgctgcagggccaggcccggctggtggaggagtgcaatggccggcgggccaagctgctggcctgtgatggaaatgaaattgacaccatgtttgtggacagaagaggaacagctgagccccagggccagaagctggtgatctgctgtgagggcaatgccggcttctatgaggtgggctgtgtgtccacccccctggaggccggctacagcgtgctgggctggaaccaccctggctttgctggcagcactggagtgcccttcccccagaatgaggccaatgccatggatgtggtggtgcagtttgccatccaccggctgggcttccagccccaggacatcatcatctatgcctggagcattggaggcttcaccgccacctgggccgccatgagctacccagatgtgtctgccatgatcctggatgccagctttgatgacctggtgcccctggccctgaaggtgatgccagacagctggaggggcctggtgaccaggacagtgcggcagcacctgaacctgaacaatgctgagcagctgtgccgctaccagggccctgtgctgctgatccggaggaccaaggatgagatcatcaccaccaccgtgcctgaggacatcatgagcaacagaggaaatgacctgctgctgaagctgctgcagcaccgctacccccgggtgatggccgaggagggcctgcgggtggtgcggcagtggctggaggccagcagccagctggaggaggccagcatctacagccgctgggaggtggaggaggactggtgcctgtctgtgctgcggagctaccaggccgagcacggccctgacttcccctggagcgtgggggaggacatgtctgcagatggaagacggcagctggccctcttcctggccaggaagcacctgcacaactttgaggccacccactgcacccccctgcctgcccagaacttccagatgccctggcacctgtag

SEQ ID NO: 142145 - DNA, 1677 bp, Artificial Sequence; identical to SEQ ID NO: 142124
  Description of Artificial Sequence: Synthetic coding sequence

SEQ ID NO: 142146 - DNA, 1578 bp, Artificial Sequence; identical to SEQ ID NO: 142144
  Description of Artificial Sequence: Synthetic coding sequence

SEQ ID NO: 142147 - DNA, 1578 bp, Artificial Sequence; identical to SEQ ID NO: 142144
  Description of Artificial Sequence: Synthetic coding sequence

SEQ ID NO: 142148 - DNA, 438 bp, Artificial Sequence; identical to SEQ ID NO: 142137
  Description of Artificial Sequence: Synthetic coding sequence

SEQ ID NO: 142149 - DNA, 1578 bp, Artificial Sequence; identical to SEQ ID NO: 142144
  Description of Artificial Sequence: Synthetic coding sequence

SEQ ID NO: 142150 - DNA, 1677 bp, Artificial Sequence; identical to SEQ ID NO: 142124
  Description of Artificial Sequence: Synthetic coding sequence

SEQ ID NO: 142151 - DNA, 1578 bp, Artificial Sequence; identical to SEQ ID NO: 142144
  Description of Artificial Sequence: Synthetic coding sequence

SEQ ID NO: 142152 - DNA, 438 bp, Artificial Sequence; identical to SEQ ID NO: 142137
  Description of Artificial Sequence: Synthetic coding sequence

SEQ ID NO: 142153 - DNA, 1578 bp, Artificial Sequence; identical to SEQ ID NO: 142144
  Description of Artificial Sequence: Synthetic coding sequence

SEQ ID NO: 142154 - DNA, 438 bp, Artificial Sequence; identical to SEQ ID NO: 142137
  Description of Artificial Sequence: Synthetic coding sequence

SEQ ID NO: 142155 - DNA, 1578 bp, Artificial Sequence; identical to SEQ ID NO: 142144
  Description of Artificial Sequence: Synthetic coding sequence

SEQ ID NO: 142156 - DNA, 1278 bp, Artificial Sequence
  Description of Artificial Sequence: Synthetic coding sequence
atgaatgccatgctggagaccccagagctgcctgctgtgtttgatggagtgaagctggccgctgtggccgctgtgctgtatgtgattgtgcgctgcctgaacctgaagagccccacagcccccccagacctgtacttccaggacagcggcctgagccgcttcctgctgaagagctgccccctgctgaccaaggagtacatccccccactcatctggggcaagagcggccacatccagacagccctgtatggcaagatgggccgggtgcgcagcccccacccctacggccacaggaagttcatcaccatgtctgatggagccaccagcacctttgacctgtttgagcccctggccgagcactgtgtgggagatgacatcaccatggtgatctgccccggcatcgccaaccacagcgagaagcagtacatccgcacctttgtggactatgcccagaagaatggctaccgctgtgctgtgctgaaccacctgggcgccctgcccaacatcgagctgaccagccccaggatgttcacctacggctgcacctgggagtttggagccatggtgaactacatcaagaagacctaccccctgacccagctggtggtggtgggcttcagcctgggcggcaacatcgtgtgcaagtacctgggggagacccaggccaaccaggagaaggtgctgtgctgcgtgtctgtgtgccagggctacagcgccctgcgggcccaggagaccttcatgcagtgggaccagtgccgccgcttctacaacttcctgatggctgacaacatgaagaagatcatcctgagccaccggcaggccctgtttggagaccacgtgaagaagccccagagcctggaggacacagacctgagccggctgtacacagccaccagcctgatgcagattgatgacaacgtgatgaggaagttccacggctacaacagcctgaaggagtactatgaggaggagagctgcatgagatacctgcaccgcatctacgtgcccctgatgctggtgaatgctgctgatgaccccctggtgcatgagagcctgctgaccatccccaagagcctgtctgagaagcgggagaatgtgatgtttgtgctgcccctgcatggaggccacctgggcttctttgagggctctgtgctcttccctgagcccctgacctggatggacaagctggtggtggagtatgccaatgccatctgccagtgggagaggaacaagctgcagtgcagcgacacagagcaggtggaggccgacctggagtag

SEQ ID NO: 142157 - DNA, 1278 bp, Artificial Sequence; identical to SEQ ID NO: 142156
  Description of Artificial Sequence: Synthetic coding sequence

SEQ ID NO: 142158 - DNA, 1230 bp, Artificial Sequence
  Description of Artificial Sequence: Synthetic coding sequence
atgcagaggctggccatggacctgaggatgctgagccgggagctgagcctgtacctggagcaccaggtgcgggtgggcttcttcggcagcggcgtgggcctgagcctcatcctgggcttctctgtggcctatgccttctactacctgagcagcatcgccaagaagccccagctggtgactggaggagagagcttcagccgcttcctgcaggaccactgccctgtggtgacagagacctactaccccaccgtgtggtgctgggagggccggggccagaccctgctgcggcccttcatcaccagcaagccccctgtgcagtacagaaatgaactcatcaagacagcagatggcggccagatcagcctggactggtttgacaatgacaacagcacctgctacatggatgccagcacccggcccaccatcctgctgctgcccggcctgaccggcaccagcaaggagagctacatcctgcacatgatccacctgtctgaggagctgggctaccgctgtgtggtgttcaacaacagaggagtggccggggagaacctgctgacccccaggacctactgctgtgccaacacagaggacctggagaccgtcatccaccacgtgcacagcctgtaccccagcgcccccttcctggccgccggcgtgtccatgggcggcatgctgctgctgaactacctgggcaagattggcagcaagacccccctgatggccgccgccaccttctctgtgggctggaacacctttgcctgcagcgagagcctggagaagcccctgaactggctgctcttcaactactacctgaccacctgcctgcagagctctgtgaacaagcaccgccacatgtttgtgaagcaggtggacatggaccacgtgatgaaggccaagagcatccgggagtttgacaagcgcttcacctctgtgatgtttggctaccagaccattgatgactactacacagatgccagccccagcccccggctgaagtctgtgggcatccctgtgctgtgcctgaacagcgtggatgatgtgttcagccccagccacgccatccccatcgagacagccaagcagaaccccaacgtggccctggtgctgaccagctatggaggccacatcggcttcctggagggcatctggccccggcagagcacctacatggacagagtcttcaagcagtttgtgcaggccatggtggagcacggccacgagctgtcctag

SEQ ID NO: 142159 - DNA, 1050 bp, Artificial Sequence
  Description of Artificial Sequence: Synthetic coding sequence
atggctgctgaggaggaggaggtggacagcgctgacacaggagagaggagcggctggctgaccggctggctgcccacctggtgccccaccagcatcagccacctgaaggaggccgaggagaagatgctgaagtgtgtgccctgcacctacaagaaggagcctgtgcgcatcagcaatggaaacaagatctggaccctgaagttcagccacaacatcagcaacaagacccccctggtgctgctgcacggctttggaggcggcctgggcctgtgggccctgaactttggagacctgtgcaccaacagacctgtgtatgcctttgacctgctgggcttcggccgcagcagccggcccaggtttgacagtgatgctgaggaggtggagaaccagtttgtggagagcattgaggagtggaggtgtgccctgggcctggacaagatgatcctgctgggccacaacctgggcggcttcctggccgccgcctacagcctgaagtaccccagccgggtgaaccacctgatcctggtggagccctggggcttccctgagaggccagacctggccgaccaggaccggcccatccctgtgtggatccgggccctgggcgccgccctgacccccttcaaccccctggccggcctgagaattgctggccccttcggcctgagcctggtgcagaggctgcggccagacttcaagaggaagtacagctccatgtttgaagatgacacagtgacagagtacatctaccactgcaatgtgcagacccccagcggggagacagccttcaagaacatgaccatcccctacggctgggccaagaggcccatgctgcagagaattggcaagatgcacccagacatccctgtgtctgtcatctttggagcccggagctgcattgatggcaacagcggcaccagcatccagagcctgcggccccacagctatgtgaagaccatcgccatcctgggcgccggccactacgtgtatgctgaccagcctgaggagttcaaccagaaggtgaaggagatctgtgacacagtggactag

SEQ ID NO: 142160 - DNA, 1491 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccagagacatggctttgctgtgctgctgtgcctgctgagcaacagctggccccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccacggcgtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgagaacatctctgtgcccccaccttctggggcccccccagccccacccctggcccccctgctgcctgtgtccacagtgattgctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142161 - DNA, 1530 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagaagtggcacaagatcatccacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgagaacatctctgtgcccccaccttctggggcccccccagccccacccctggcccccctgctgcctgtgtccacagtgattgctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcatcagcatcgcccctcctcctccacccatgccccagctgaccccccagatccccctgaccggctttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142162 - DNA, 1443 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgcccctggcagcgcccctggcagccagtatggcaccatgacccggcagatcagccgccacaacagcaccaccagcagcaccagcagcggcggctacagaaggacccccagcgtgacagcccagttcagcgcccagccccacgtgaatggaggccccctgtacagccagaacagcatcagcatcgcccctcctcctccacccatgccccagctgaccccccagatccccctgactggatttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142163 - DNA, 1449 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagaagtggcacaagatcatccacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgctgcccctggcagcgcccctggcagccagtatggcaccatgacccggcagatcagccgccacaacagcaccaccagcagcaccagcagcggcggctacagaaggacccccagcgtgacagcccagttcagcgcccagccccacgtgaatggaggccccctgtacagccagaacagcatcagcatcgcccctcctcctccacccatgccccagctgaccccccagatccccctgactggatttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142164 - DNA, 1272 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagaagtggcacaagatcatccacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgtgtccatcgcccctcctcctccacccatgccccagctgaccccccagatccccctgaccggctttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142165 - DNA, 1359 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142166 - DNA, 1431 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagcacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgctgcccctggcagcgcccctggcagccagtatggcaccatgacccggcagatcagccgccacaacagcaccaccagcagcaccagcagcggcggctacagaaggacccccagcgtgacagcccagttcagcgcccagccccacgtgaatggaggccccctgtacagccagaacagcatcagcatcgcccctcctcctccacccatgccccagctgaccccccagatccccctgactggatttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142167 - DNA, 1446 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcatcagcatcgcccctcctcctccacccatgccccagctgaccccccagatccccctgaccggctttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142168 - DNA, 1527 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgagaacatctctgtgcccccacccagcggggcccccccagccccacccctggcccccctgctgcctgtgtccacagtgattgctgcccctggcagcgcccctggcagccagtatggcaccatgacccggcagatcagccgccacaacagcaccaccagcagcaccagcagcggcggctacagaaggacccccagcgtgacagcccagttcagcgcccagccccacgtgaatggaggccccctgtacagccagaacagcatcagcatcgcccctcctcctccacccatgccccagctgaccccccagatccccctgactggatttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142169 - DNA, 1428 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagcacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcatcagcatcgcccctcctcctccacccatgccccagctgaccccccagatccccctgaccggctttgtggcccgggtgcaggagaacattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142170 - DNA, 1341 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagcacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgcccctggcagcgcccctggcagccagtatggcaccatgacccggcagatcagccgccacaacagcaccaccagcagcaccagcagcggcggctacagaaggaccccatctgtgacagcccagttcagcgcccagccccacgtgaatggaggccccctgtacagccagaacagcattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142171 - DNA, 1356 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagtggctgaaggccaagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgcccctggcagcgcccctggcagccagtatggcaccatgacccggcagatcagccgccacaacagcaccaccagcagcaccagcagcggcggctacagaaggacccccagcgtgacagcccagttcagcgcccagccccacgtgaatggaggccccctgtacagccagaacagcattgctgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142172 - DNA, 990 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagcacggcaacaaccagcctgccaggacaggcaccctgagcaggaccaacccccccacccagaagccacccagcccccccatgagcggccggggcaccctgggcaggaacaccccctacaagaccctggagcctgtgaagccacccaccgtgcccaatgactacatgaccagccctgcccggctgggcagccagcacagccctggccgcacagccagcctgaaccagaggcccaggacccacagcggcagcagcggcggcagcggcagccgggagaacagcggcagcagcagcatcggcatccccatcgctgtgcccacccccagcccccccaccatcggccctgtggccgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgaaggagtgtgcaacagagtgacaggcctcttccctggcaactacgtggagagcatcatgcactacacagactag

SEQ ID NO: 142173 - DNA, 1185 bp, Artificial Sequence
  Description of Artificial Sequence: Synthetic coding sequence
atggccgagctgcagatgctgctggaggaggagatccccagcggcaagagggccctgattgagagctaccagaacctgaccagggtggccgactactgtgagaacaactacatccaggccacagacaagaggaaggccctggaggagaccaaggcctacaccacccagagcctggcctctgtggcctaccagatcaatgccctggccaacaacgtgctgcagctgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacatggagaggcctgtgcgctacatcaggaagcccatcgactacacagtgctggatgatgtgggccatggagtgaagaagtggcacaagatcatccacggcaacaaccagcctgccaggacaggcaccctgagcaggaccaacccccccacccagaagccacccagcccccccatgagcggccggggcaccctgggcaggaacaccccctacaagaccctggagcctgtgaagcccccaacagtgcccaatgactacatgaccagccctgcccggctgggcagccagcacagccctggccgcacagccagcctgaaccagaggcccaggacccacagcggcagcagcggcggcagcggcagcagagaaaattctggcagcagcagcatcggcatccccatcgctgtgcccacccccagcccccccaccatcggccctgtggccgacagccccaccccacctcctcctcctcctccagatgacatccccatgtttgatgacagccccccacctcctcctcctcctcctgtggactatgaagatgaggaggccgctgtggtgcagtacaatgacccctatgcagatggagaccctgcctgggcccccaagaactacatcgagaaggtggtggccatctatgactacaccaaggacaaggatgatgagctgtccttcatggagggcgccatcatctacgtgatcaagaagaatgatgatggctggtatgagggcgtgtgcaacagagtgacaggcctcttccctggcaactacgtggagagcatcatgcactacacagactag

SEQ ID NO: 142174 - DNA, 3993 bp, Artificial Sequence
  Description of Artificial Sequence: Synthetic coding sequence
atgcccctgagccccccagcccagggcgaccctggagagcccagcccctgcaggcctcccaagaagcacaccaccttccacctgtggaggagcaagaagaagcagcagcctgcccccccagactgtggggtgtttgtgccccaccccctgcctgccccagctggggaggcccgggccctggatgtggtggatggcaagtatgtggtgcgggacagccaggagttccccctgcactgtggggagagccagttcttccacaccaccagcgaggccctgggcagcctgctgctggagagcggcatcttcaagaagagccgggcccagcccccagaggacaacagaaggaagcctgtgctgggcaagctgggcaccctcttcaccgctggaagaagaagaaacagcagaaatggcctggagagccccaccaggagcaatgccaagcccctgagccccaaggatgtggtggccagccccaagctgcctgagcgggagagcgagaggagccgcagccagagcagccagctgaagcagacagacaccagcgaggagggcagcccccgggagaacccccgggaggccgagggggagctgcctgagagcggcggccctgctgcccccccagatgctgagctgagcccccgctggagcagcagcgctgctgctgtggccgtgcagcagtgccatgaaaatgacagcccccagctggagcccctggaggccgagggggagcccttcccagatgccaccaccacagccaagcagctgcacagcagccctggcaacagcagccggcaggagaatgctgagaccccagcccggagccctggagaagatgccagccctggagctggccacgagcaggaggccttcctgggcgtgcggggggcccctggcagccccacccaggagaggcctgctgggggcctgggggaggcccccaacggggcccccagcgtgtgtgccgaggagggcagcctgggccccagaaatgcccggagccagccccccaagggggccagtgacctgcctggagagcccccagctgagggcgccgcccacacagccagcagcgcccaggccgactgcacagcccggcccaagggccacgcccacccagccaaggtgctgaccctggacatctacctgagcaagacagaaggagcccaggtggatgagcctgtggtgatcacccccagggctgaggactgtggggactgggatgacatggagaagaggagcagcggccgccgcagcggcagaagaagaggcagccagaagagcacagacagccctggagcagatgctgagctgcctgagagcgctgccagagatgatgctgtgtttgatgatgaggtggccccaaatgctgccagtgacaatgccagcgctgagaagaaggtgaagagcccccgggccgccctggatggaggagtggccagcgctgccagccctgagagcaagcccagccctggcaccaagggccagctgcggggggagagtgacaggagcaagcagcccccaccagccagcagccccaccaagaggaagggccgcagccgggccctggaggccgtgcctgcccccccagccagcggcccccgggccccagccaaggagagcccccccaagagggtgcctgaccccagccctgtgaccaagggcacagctgctgagagcggggaggaggccgcccgggccatcccccgggagctgcctgtgaagagcagcagcctgctgcctgagatcaagccagagcacaagaggggccccctgcccaaccacttcaacggccgggcagagggcggccgcagccgggagctgggccgggctgctggggcccctggggccagtgatgctgatggcctgaagcccaggaaccactttggagtgggccgcagcacagtgaccaccaaggtgaccctgcctgccaagcccaagcacgtggagctgaacctgaagacccccaagaacctggacagcctgggcaatgagcacaaccccttcagccagcctgtgcacaagggcaacacagccaccaagatcagcctgtttgagaacaagaggaccaacagcagccccaggcacacagacatccggggccagaggaacaccccagccagcagcaagacctttgtgggccgggccaagctgaacctggccaagaaggccaaggagatggagcagcctgagaagaaggtgatgcccaacagcccccagaatggagtgctggtgaaggagacagccatcgagaccaaggtgacagtgtctgaggaggagatcctgcctgccacccggggcatgaatggagacagcagcgagaaccaggccctgggcccccagcccaaccaggatgacaaggcagatgtgcagacagatgctggctgcctgtctgagcctgtggccagcgccctgatccctgtgaaggaccacaagctgctggagaaggaggacagcgaggccgctgacagcaagagcctggtgctggagaatgtgacagacacagcccaggacatccccaccaccgtggacaccaaggacctgcccccaacagccatgcccaagccccagcacaccttcagtgacagccagagccctgctgagagcagccctggccccagcctgagcctgagcgccccagcccctggagatgtgcccaaggacacctgtgtgcagagccccatcagcagcttcccctgcacagacctgaaggtgtctgagaaccacaagggctgtgtgctgcctgtgtcccggcagaacaatgagaagatgcccctgctggagctgggcggggagaccaccccacccctgagcacagagaggagccctgaggccgtgggcagcgagtgccccagccgggtgctggtgcaggtgcgcagctttgtgctgcctgtggagagcacccaggatgtgagcagccaggtgattcctgagagcagcgaggtgcgggaggtgcagctgcccacctgccacagcaatgaacctgaggtggtgtctgtggccagctgtgccccaccccaggaggaggtgctgggcaatgagcacagccactgcacagctgagctggccgccaagagcggcccccaggtgattcctccagccagcgagaagaccctgcccatccaggcccagagccagggcagcaggacccccctgatggccgagagcagccccaccaacagccccagcagcggcaaccacctggccaccccccagaggccagaccagacagtgaccaacggccaggacagccctgccagcctgctgaacatctctgctggcagtgatgattctgtgtttgacagcagcagtgacatggagaagttcacagagatcatcaagcagatggattctgctgtgtgcatgcccatgaagaggaagaaggccaggatgcccaacagccctgccccccactttgccatgccacccatccacgaggaccacctggagaaggtgtttgaccccaaggtgttcaccttcggcctgggcaagaagaaggagagccagcctgagatgagccctgccctgcacctgatgcagaacctggacaccaagagcaagctgcggcccaagagggccagcgctgagcagagcgtgctcttcaagagcctgcacaccaacaccaacggcaacagcgagcccctggtgatgcctgagatcaatgacaaggaaaatagagatgtgaccaatggaggcatcaagaggagccggctggagaagagcgccctcttcagcagcctgctgagcagcctgccccaggacaagatcttcagccccagcgtgacctctgtgaacaccatgaccacagccttcagcaccagccagaatggcagcctgagccagagctctgtgtcccagcccaccacagagggcgccccaccctgtggcctgaacaaggagcagagcaacctgctgcctgacaacagcctgaaggtgttcaacttcaacagcagcagcaccagccacagcagcctgaagagccccagccacatgtag

SEQ ID NO: 142175 - DNA, 5172 bp, Artificial Sequence
  Description of Artificial Sequence: Synthetic coding sequence
atggagaagaggagcagcggccgccgcagcggcagaagaagaggcagccagaagagcacagacagccctggagcagatgctgagctgcctgagagcgctgccagagatgatgctgtgtttgatgatgaggtggccccaaatgctgccagtgacaatgccagcgctgagaagaaggtgaagagcccccgggccgccctggatggaggagtggccagcgctgccagccctgagagcaagcccagccctggcaccaagggccagctgcggggggagagtgacaggagcaagcagcccccaccagccagcagccccaccaagaggaagggccgcagccgggccctggaggccgtgcctgcccccccagccagcggcccccgggccccagccaaggagagcccccccaagagggtgcctgaccccagccctgtgaccaagggcacagctgctgagagcggggaggaggccgcccgggccatcccccgggagctgcctgtgaagagcagcagcctgctgcctgagatcaagccagagcacaagaggggccccctgcccaaccacttcaacggccgggcagagggcggccgcagccgggagctgggccgggctgctggggcccctggggccagtgatgctgatggcctgaagcccaggaaccactttggagtgggccgcagcacagtgaccaccaaggtgaccctgcctgccaagcccaagcacgtggagctgaacctgaagacccccaagaacctggacagcctgggcaatgagcacaaccccttcagccagcctgtgcacaagggcaacacagccaccaagatcagcctgtttgagaacaagaggaccaacagcagccccaggcacacagacatccggggccagaggaacaccccagccagcagcaagacctttgtgggccgggccaagctgaacctggccaagaaggccaaggagatggagcagcctgagaagaaggtgatgcccaacagcccccagaatggagtgctggtgaaggagacagccatcgagaccaaggtgacagtgtctgaggaggagatcctgcctgccacccggggcatgaatggagacagcagcgagaaccaggccctgggcccccagcccaaccaggatgacaaggcagatgtgcagacagatgctggctgcctgtctgagcctgtggccagcgccctgatccctgtgaaggaccacaagctgctggagaaggaggacagcgaggccgctgacagcaagagcctggtgctggagaatgtgacagacacagcccaggacatccccaccaccgtggacaccaaggacctgcccccaacagccatgcccaagccccagcacaccttcagtgacagccagagccctgctgagagcagccctggccccagcctgagcctgagcgccccagcccctggagatgtgcccaaggacacctgtgtgcagagccccatcagcagcttcccctgcacagacctgaaggtgtctgagaaccacaagggctgtgtgctgcctgtgtcccggcagaacaatgagaagatgcccctgctggagctgggcggggagaccaccccacccctgagcacagagaggagccctgaggccgtgggcagcgagtgccccagccgggtgctggtgcaggtgcgcagctttgtgctgcctgtggagagcacccaggatgtgagcagccaggtgattcctgagagcagcgaggtgcgggaggtgcagctgcccacctgccacagcaatgaacctgaggtggtgtctgtggccagctgtgccccaccccaggaggaggtgctgggcaatgagcacagccactgcacagctgagctggccgccaagagcggcccccaggtgattcctccagccagcgagaagaccctgcccatccaggcccagagccagggcagcaggacccccctgatggccgagagcagccccaccaacagccccagcagcggcaaccacctggccaccccccagaggccagaccagacagtgaccaacggccaggacagccctgccagcctgctgaacatctctgctggcagtgatgattctgtgtttgacagcagcagtgacatggagaagttcacagagatcatcaagcagatggattctgctgtgtgcatgcccatgaagaggaagaaggccaggatgcccaacagccctgccccccactttgccatgccacccatccacgaggaccacctggagaaggtgtttgaccccaaggtgttcaccttcggcctgggcaagaagaaggagagccagcctgagatgagccctgccctgcacctgatgcagaacctggacaccaagagcaagctgcggcccaagagggccagcgctgagcagagcgtgctcttcaagagcctgcacaccaacaccaacggcaacagcgagcccctggtgatgcctgagatcaatgacaaggaaaatagagatgtgaccaatggaggcatcaagaggagccggctggagaagagcgccctcttcagcagcctgctgagcagcctgccccaggacaagatcttcagccccagcgtgacctctgtgaacaccatgaccacagccttcagcaccagccagaatggcagcctgagccagagctctgtgtcccagcccaccacagagggcgccccaccctgtggcctgaacaaggagcagagcaacctgctgcctgacaacagcctgaaggtgttcaacttcaacagcagcagcaccagccacagcagcctgaagagccccagccacatggagaagtacccccagaaggagaagaccaaggaggacctggacagccgcagcaacctgcacctgcctgagaccaagttcagcgagctgagcaagctgaagaatgatgacatggagaaggccaaccacattgaatctgtcatcaagagcaacctgcccaactgtgccaacagcgacacagacttcatgggcctcttcaagagcagccgctatgaccccagcatctccttcagcggcatgagcctgagtgacaccatgaccctgcggggctctgtgcagaacaagctgaaccccaggcctgggaaggtggtgatctacagcgagccagatgtgtctgagaagtgcatcgaggtgttcagtgacatccaggactgcagctcctggagcctgagccctgtgatcctgatcaaggtggtgcggggctgctggatcctgtatgagcagcccaactttgagggccacagcatccccctggaggagggggagctggagctgagcggcctgtggggcatcgaggacatcctggagagacatgaggaggccgagagtgacaagcctgtggtgattggcagcatcagacatgtggtgcaggactacagagtgagccacatcgacctcttcacagagcctgagggcctgggcatcctgagcagctactttgatgacacagaggagatgcagggcttcggcgtgatgcagaagacctgcagcatgaaggtgcactggggcacctggctgatctatgaggagcccggcttccagggcgtgcccttcatcctggagcctggagagtacccagacctgtccttctgggacacagaggaggcctacatcggctccatgaggcccctgaagatgggcggcaggaaggtggagttccccacagaccccaaggtggtggtgtatgagaagcccttctttgagggcaaatgtgtggagctggagaccggcatgtgcagctttgtgatggagggcggggagacagaggaggccactggagatgaccacctgcccttcacctctgtgggctccatgaaggtgctgcggggcatctgggtggcctatgagaagccaggcttcaccggccaccagtacctgctggaggagggggagtacagagactggaaggcctggggcggctacaatggagagctgcagagcctgcggcccatcctgggggacttcagcaatgcccacatgatcatgtacagcgagaagaactttggcagcaagggcagcagcattgatgtgctgggcatcgtggccaacctgaaggagaccggctacggcgtgaagacccagagcatcaacgtgctgtctggagtgtgggtggcctatgagaacccagacttcaccggggagcagtacatcctggacaagggcttctacaccagctttgaggactggggcggcaagaactgcaagatcagctctgtgcagcccatctgcctggacagcttcaccggccccaggagaagaaaccagatccacctgttcagcgagccccagttccagggccacagccagagctttgaggagaccaccagccagattgatgacagcttcagcaccaagagctgccgggtgtctgggggctcctgggtggtgtatgatggagagaacttcaccggcaaccagtatgtgctggaggagggccactacccctgcctgagcgccatgggctgccccccaggggccaccttcaagagcctgcgcttcattgatgtggagttcagcgagcccaccatcatcctgtttgagcgggaggacttcaagggcaagaagattgagctgaatgctgagaccgtgaacctgcggagcctgggcttcaacacccagatccgctctgtgcaggtgattggaggcatctgggtgacctatgaatatggcagctaccggggccggcagttcctgctgagccctgctgaggtgcccaactggtatgagttcagcggctgccggcagatcggcagcctgcggccctttgtgcagaagaggatctacttccggctgaggaacaaggccaccggcctcttcatgagcaccaacggcaacctggaggacctgaagctgctgcgcatccaggtgatggaggatgtgggcgcagatgaccagatctggatctaccaggagggctgcatcaagtgcagaattgctgaggactgctgcctgaccatcgtgggcagcctggtgaccagcggcagcaagctgggcctggccctggaccagaatgctgacagccagttctggagcctgaagagtgatggccgcatctacagcaagctgaagcccaacctggtgctggacatcaagggcggcacccagtatgaccagaaccacatcatcctgaacacagtgtccaaggagaagttcacccaggtgtgggaggccatggtgctgtacacctag

SEQ ID NO: 142176 - DNA, 951 bp, Artificial Sequence
  Description of Artificial Sequence: Synthetic coding sequence
atgcagaagcccaagacagtggcctgggagaacctgggccctgagatgtctgccctgggcacagccttcagccgggagggcggcaggaaggtggagttccccacagaccccaaggtggtggtgtatgagaagcccttctttgagggcaaatgtgtggagctggagaccggcatgtgcagctttgtgatggagggcggggagacagaggaggccactggagatgaccacctgcccttcacctctgtgggctccatgaaggtgctgcggggcatctgggtggcctatgagaagccaggcttcaccggccaccagtacctgctggaggagggggagtacagagactggaaggcctggggcggctacaacggggagctgcagagcctgcggcccatcctgggggacttcagcaatgcccacatgatcatgtacagcgagaagaactttggcagcaagggcagcagcattgatgtgctgggcatcgtggccaacctgaaggagaccggctatggagtgaagacccagagcatcaacgtgctgagcggcgtgtgggtggcctatgaaaatccagacttcaccggggagcagtacatcctggacaagggcttctacaccagctttgaggactggggcggcaagaactgcaagatcagctctgtgcagcccatctgcctggacagcttcaccggccccaggagaagaaaccagatccacctgttcagcgagccccagttccagggccacagccagagctttgaggagaccaccagccagattgatgacagcttcagcaccaagagctgccgggtgtctgggggctcctgggtggtgtatgatggagagaacttcaccggcaaccagtatgtgctggaggagggccactacccctgcctgagcgccatgggctgccccccaggggccaccttcaagagcctgcgcttcattgatgtgtag

SEQ ID NO: 142177 - DNA, 1629 bp, Artificial Sequence
  Description of Artificial Sequence: Synthetic coding sequence
atgcagaagcccaagacagtggcctgggagaacctgggccctgagatgtctgccctgggcacagccttcagccgggagggcggcaggaaggtggagttccccacagaccccaaggtggtggtgtatgagaagcccttctttgagggcaaatgtgtggagctggagaccggcatgtgcagctttgtgatggagggcggggagacagaggaggccactggagatgaccacctgcccttcacctctgtgggctccatgaaggtgctgcggggcatctgggtggcctatgagaagccaggcttcaccggccaccagtacctgctggaggagggggagtacagagactggaaggcctggggcggctacaacggggagctgcagagcctgcggcccatcctgggggacttcagcaatgcccacatgatcatgtacagcgagaagaactttggcagcaagggcagcagcattgatgtgctgggcatcgtggccaacctgaaggagaccggctatggagtgaagacccagagcatcaacgtgctgagcggcgtgtgggtggcctatgaaaatccagacttcaccggggagcagtacatcctggacaagggcttctacaccagctttgaggactggggcggcaagaactgcaagatcagctctgtgcagcccatctgcctggacagcttcaccggccccaggagaagaaaccagatccacctgttcagcgagccccagttccagggccacagccagagctttgaggagaccaccagccagattgatgacagcttcagcaccaagagctgccgggtgtctgggggctcctgggtggtgtatgatggagagaacttcaccggcaaccagtatgtgctggaggagggccactacccctgcctgagcgccatgggctgccccccaggggccaccttcaagagcctgcgcttcattgatgtggagttcagcgagcccaccatcatcctgtttgaaagagaggacttcaagggcaagaagattgagctgaatgctgagaccgtgaacctgcggagcctgggcttcaacacccagatccgctctgtgcaggtgattggaggcatctgggtgacctatgaatatggcagctaccggggccggcagttcctgctgagccctgctgaggtgcccaactggtatgagttcagcggctgccggcagatcggcagcctgcggccctttgtgcagaagaggatctacttccggctgaggaacaaggccaccggcctcttcatgagcaccaatggaaacctggaggacctgaagctgctgcgcatccaggtgatggaggatgtgggcgcagatgaccagatctggatctaccaggagggctgcatcaagtgcagaattgctgaggactgctgcctgaccatcgtgggcagcctggtgaccagcggcagcaagctgggcctggccctggaccagaatgctgacagccagttctggagcctgaagagtgatggccgcatctacagcaagctgaagcccaacctggtgctggacatcaagggcggcacccagtatgaccagaaccacatcatcctgaacacagtgtccaaggagaagttcacccaggtgtgggaggccatggtgctgtacacctag

SEQ ID NO: 142178 - DNA, 504 bp, Artificial Sequence
  Description of Artificial Sequence: Synthetic coding sequence
atggtggcccagcaggagagcatccgggagggcttccagaagcgctgcctgcctgtgatggtgctgaaggccaagaagcccttcacctttgagacccaggagggcaagcaggagatgtttcatgccaccgtggccacagagaaggagttcttctttgtgaaggtgttcaacaccctgctgaaggacaagttcatccccaagaggatcatcatcatcgcccgctactaccgccacagcggcttcctggaggtgaacagcgccagccgggtgctggatgctgagagtgaccagaaggtgaatgtgcccctgaacatcatcaggaaggccggggagacccccaagatcaacaccctgcagacccagcccctgggcaccatcgtgaatggcctgtttgtggtgcagaaggtgacagagaagaagaagaacatcctgtttgacctgagtgacaacacaggcaagatggaggtgctgggcgtgagaaatgaagacaccatgaagtgctag

SEQ ID NO: 142179 - DNA, 1032 bp, Artificial Sequence
  Description of Artificial Sequence: Synthetic coding sequence
atggagagcaagtacaaggagatcctgctgctgaccggcctggacaacatcacagatgaggagctggaccgcttcaagttcttcctgagtgatgagttcaacatcgccaccgggaagctgcacacagccaaccgcatccaggtggccaccctgatgatccagaatgctggagctgtgtctgctgtgatgaagaccatccgcatcttccagaagctgaactacatgctgctggccaagaggctgcaggaggagaaggagaaggtggacaagcagtacaagtctgtgaccaagcccaagcccctgagccaggccgagatgagccctgctgccagcgctgccatcagaaatgatgtggccaagcagagagctgcccccaaggtgagcccccacgtgaagccagagcagaagcagatggtggcccagcaggagagcatccgggagggcttccagaagcgctgcctgcctgtgatggtgctgaaggccaagaagcccttcacctttgagacccaggagggcaagcaggagatgttccacgccaccgtggccacagagaaggagttcttctttgtgaaggtgttcaacaccctgctgaaggacaagttcatccccaagaggatcatcatcatcgcccgctactaccgccacagcggcttcctggaggtgaacagcgccagccgggtgctggatgctgagagtgaccagaaggtgaatgtgcccctgaacatcatcaggaaggccggggagacccccaagatcaacaccctgcagacccagcccctgggcaccatcgtgaatggcctgtttgtggtgcagaaggtgacagagaagaagaagaacatcctgtttgacctgagtgacaacacaggcaagatggaggtgctgggcgtgagaaatgaagacaccatgaagtgcaaggagggggacaaggtgcggctgaccttcttcaccctgagcaagaatggagagaagctgcagctgaccagcggcgtgcacagcaccatcaaggtgatcaaggccaagaagaagacctag

SEQ ID NO: 142180 - DNA, 411 bp, Artificial Sequence
  Description of Artificial Sequence: Synthetic coding sequence
atggagagcaagtacaaggagatcctgctgctgaccggcctggacaacatcacagatgaggagctggaccgcttcaagttcttcctgagtgatgagttcaacatcgccaccgggaagctgcacacagccaaccgcatccaggtggccaccctgatgatccagaatgctggagctgtgtctgctgtgatgaagaccatccgcatcttccagaagctgaactacatgctgctggccaagaggctgcaggaggagaaggagaaggtggacaagcagtacaagtctgtgaccaagcccaagcccctgagccaggccgagatgagccctgctgccagcgctgccatcagaaatgatgtggccaagcagagagctgcccccaaggtgagcccccacgtgaagccagagcagaagtag

SEQ ID NO: 142181 - DNA, 1800 bp, Artificial Sequence
  Description of Artificial Sequence: Synthetic coding sequence
atgagcaaggaggagaggcctggccgggaggagatcctggagtgccaggtgatgtgggagccagacagcaagaagaacacccagatggaccgcttccgggctgctgtgggcgccgcctgtggcctggccctggagagctatgatgacctgtaccactggagcgtggagagctacagcgacttctgggccgagttctggaagttctctggaattgtgttcagccgggtgtatgatgaggtggtggacaccagcaaaggaattgctgatgtgcctgagtggttcaagggcagccggctgaactatgcagagaacctgctgcggcacaaggaaaatgacagagtggccctgtacatcgcccgggagggcaaggaggagatcgtgaaggtgacctttgaggagctgcggcaggaggtggccctgtttgctgctgccatgaggaagatgggcgtgaagaagggggacagagtggtgggctacctgcccaacagcgagcacgctgtggaggccatgctggccgccgccagcatcggggccatctggagcagcaccagcccagactttggagtgaatggagtgctggaccgcttcagccagatccagcccaagctgatcttctctgtggaggccgtggtgtacaacgggaaggagcacaaccacatggagaagctgcagcaggtggtgaagggcctgcctgacctgaagaaggtggtggtgatcccctacgtgagcagccgggagaacatcgacctgagcaagatccccaacagcgtcttcctggatgacttcctggccaccggcaccagcgagcaggccccccagctggagtttgagcagctgcccttcagccaccccctcttcatcatgttcagcagcggcaccaccggggcccccaagtgcatggtgcacagcgctgggggcaccctcatccagcacctgaaggagcacctgctgcacggcaacatgaccagcagtgacatcctgctgtgctacaccaccgtgggctggatgatgtggaactggatggtgtccctgctggccactggagctgccatggtgctgtatgatggcagccccctggtgcccacccccaacgtgctgtgggacctggtggacagaattggcatcaccgtgctggtgactggagccaagtggctgtctgtgctggaggagaaggccatgaagcctgtggagacccacagcctgcagatgctgcacaccatcctgagcacaggcagccccctgaaggcccagagctatgaatatgtgtaccgctgcatcaagagcagcatcctgctgggcagcatcagcggcggcacagacatcatcagctgcttcatgggccacaacttcagcctgcctgtgtacaagggggagatccaggccaggaacctgggcatggctgtggaggcctggaatgaggagggcaaggctgtgtggggcgagagcggggagctggtgtgcaccaagcccatcccctgccagcccacccacttctggaatgatgaaaatggaaacaagtacaggaaggcctacttcagcaagtttcctggcatctgggcccatggagactactgccgcatcaaccccaagacaggaggcatcgtgatgctgggccgcagtgatggcaccctgaaccccaatggagtgcgcttcggcagcagcgagatctacaacatcgtgtatgcccagaggcaggagagcggcagctgccggcagacagaccaccgctggaagagcagaggagcccggcgctgcttcctggagccccgggaccccggctctgtgcccggccacccctag

SEQ ID NO: 142182 - DNA, 2019 bp, Artificial Sequence
  Description of Artificial Sequence: Synthetic coding sequence
atgagcaaggaggagaggcctggccgggaggagatcctggagtgccaggtgatgtgggagccagacagcaagaagaacacccagatggaccgcttccgggctgctgtgggcgccgcctgtggcctggccctggagagctatgatgacctgtaccactggagcgtggagagctacagcgacttctgggccgagttctggaagttctctggaattgtgttcagccgggtgtatgatgaggtggtggacaccagcaaaggaattgctgatgtgcctgagtggttcaagggcagccggctgaactatgcagagaacctgctgcggcacaaggaaaatgacagagtggccctgtacatcgcccgggagggcaaggaggagatcgtgaaggtgacctttgaggagctgcggcaggaggtggccctgtttgctgctgccatgaggaagatgggcgtgaagaagggggacagagtggtgggctacctgcccaacagcgagcacgctgtggaggccatgctggccgccgccagcatcggggccatctggagcagcaccagcccagactttggagtgaatggagtgctggaccgcttcagccagatccagcccaagctgatcttctctgtggaggccgtggtgtacaacgggaaggagcacaaccacatggagaagctgcagcaggtggtgaagggcctgcctgacctgaagaaggtggtggtgatcccctacgtgagcagccgggagaacatcgacctgagcaagatccccaacagcgtcttcctggatgacttcctggccaccggcaccagcgagcaggccccccagctggagtttgagcagctgcccttcagccaccccctcttcatcatgttcagcagcggcaccaccggggcccccaagtgcatggtgcacagcgctgggggcaccctcatccagcacctgaaggagcacctgctgcacggcaacatgaccagcagtgacatcctgctgtgctacaccaccgtgggctggatgatgtggaactggatggtgtccctgctggccactggagctgccatggtgctgtatgatggcagccccctggtgcccacccccaacgtgctgtgggacctggtggacagaattggcatcaccgtgctggtgactggagccaagtggctgtctgtgctggaggagaaggccatgaagcctgtggagacccacagcctgcagatgctgcacaccatcctgagcacaggcagccccctgaaggcccagagctatgaatatgtgtaccgctgcatcaagagcagcatcctgctgggcagcatcagcggcggcacagacatcatcagctgcttcatgggccacaacttcagcctgcctgtgtacaagggggagatccaggccaggaacctgggcatggctgtggaggcctggaatgaggagggcaaggctgtgtggggcgagagcggggagctggtgtgcaccaagcccatcccctgccagcccacccacttctggaatgatgaaaatggaaacaagtacaggaaggcctacttcagcaagtttcctggcatctgggcccatggagactactgccgcatcaaccccaagacaggaggcatcgtgatgctgggccgcagtgatggcaccctgaaccccaatggagtgcgcttcggcagcagcgagatctacaacatcgtggagagctttgaggaggtggaggacagcctgtgtgtgccccagtacaacaagtaccgggaggagagggtcatcctcttcctgaagatggccagcggccacgccttccagcctgacctggtgaagaggatcagagatgccatccgcatgggcctgagcgcccggcacgtgcccagcctcatcctggagaccaagggcatcccctacaccctgaatggcaagaaggtggaggtggccgtgaagcagatcatcgccggcaaggctgtggagcagggcggggccttcagcaaccctgagaccctggacctgtacagagacatccctgagctgcagggcttctag

SEQ ID NO: 142183 - DNA, 762 bp, Artificial Sequence
  Description of Artificial Sequence: Synthetic coding sequence
atgaggaagatgggcgtgaagaagggggacagagtggtgggctacctgcccaacagcgagcacgctgtggaggccatgctggccgccgccagcatcggggccatctggagcagcaccagcccagactttggagtgaatggagtgctggaccgcttcagccagatccagcccaagctgatcttctctgtggaggccgtggtgtacaacgggaaggagcacaaccacatggagaagctgcagcaggtggtgaagggcctgcctgacctgaagaaggtggtggtgatcccctacgtgagcagccgggagaacatcgacctgagcaagatccccaacagcgtcttcctggatgacttcctggccaccggcaccagcgagcaggccccccagctggagtttgagcagctgcccttcagccaccccctcttcatcatgttcagcagcggcaccaccggggcccccaagtgcatggtgcacagcgctgggggcaccctcatccagcacctgaaggagcacctgctgcacggcaacatgaccagcagtgacatcctgctgtgctacaccaccgtgggctggatgatgtggaactggatggtgtccctgctggccactggagctgccatggtgctgtatgatggcagccccctggtgcccacccccaacgtgctgtgggacctggtggacagaattggctacctgggctcctggaggctgctgcagaaccagccccaggaccggggccacagacatgcctggccagagtag

SEQ ID NO: 142184 - DNA, 1845 bp, Artificial Sequence
  Description of Artificial Sequence: Synthetic coding sequence
atgaggcctccccagtgcctgctgcacacccccagcctggccagccccctgctgctgctgctgctgtggctgctgggcggcggcgtgggcgctgagggcagagaagatgctgagctgctggtgacagtgcggggcggccgcctgcggggcatccggctgaagacccctgggggccctgtgtctgccttcctgggcatcccctttgctgagccccccatgggcccccggcgcttcctgcccccagagcccaagcagccctggagcggcgtggtggatgccaccaccttccagagcgtgtgctaccagtatgtggacaccctgtacccaggctttgagggcacagagatgtggaaccccaaccgggagctgtctgaggactgcctgtacctgaatgtgtggaccccctacccccggcccaccagccccacccctgtgctggtgtggatctacggcggcggcttctacagcggggccagcagcctggatgtgtatgatggccgcttcctggtgcaggccgagaggacagtgctggtgtccatgaactacagagtgggcgccttcggcttcctggccctgcccggcagccgggaggcccctggaaatgtgggcctgctggaccagaggctggccctgcagtgggtgcaggagaatgtggccgcctttggaggagaccccacctctgtgaccctgtttggagagagcgctggagctgcctctgtgggcatgcacctgctgagcccccccagccggggcctcttccacagagctgtgctgcagagcggggcccccaacggcccctgggccaccgtgggcatgggagaggccaggagaagagccacccagctggcccacctggtgggctgccccccaggcggcactggaggaaatgacacagagctggtggcctgcctgcggaccaggcctgcccaggtgctggtgaaccacgagtggcacgtgctgccccaggagagcgtcttccgcttctcctttgtgcctgtggtggatggagacttcctgagtgacaccccagaggccctgatcaatgctggggacttccacggcctgcaggtgctggtgggcgtggtgaaggatgagggcagctacttcctggtgtatggagcccctggcttcagcaaggacaatgaaagcctcatcagcagagctgagttcctggccggcgtgcgggtgggcgtgccccaggtgtctgacctggccgctgaggccgtggtgctgcactacacagactggctgcaccctgaggaccctgcccggctgcgggaggccctgagtgatgtggtgggggaccacaacgtggtgtgccctgtggcccagctggccggccgcctggccgcccagggcgcccgggtgtatgcctacgtgtttgagcaccgggccagcaccctgtcctggcccctgtggatgggcgtgccccacggctatgaaattgagttcatcttcggcatccccctggaccccagcaggaactacacagctgaggagaagatctttgcccagaggctgatgagatactgggccaactttgccaggactggagaccccaatgagccccgggaccccaaggccccccagtggccaccctacacagctggggcccagcagtatgtgtccctggacctgcggcccctggaggtgcggcggggcctgcgggcccaggcctgtgccttctggaaccgcttcctgcccaagctgctgagcgccacagacaccctggatgaggccgagcggcagtggaaggccgagttccaccgctggagcagctacatggtgcactggaagaaccagtttgaccactacagcaagcaggaccgctgcagcgacctgtag

SEQ ID NO: 142185 - DNA, 1854 bp, Artificial Sequence
  Description of Artificial Sequence: Synthetic coding sequence
atgaggcctccccagtgcctgctgcacacccccagcctggccagccccctgctgctgctgctgctgtggctgctgggcggcggcgtgggcgctgagggcagagaagatgctgagctgctggtgacagtgcggggcggccgcctgcggggcatccggctgaagacccctgggggccctgtgtctgccttcctgggcatcccctttgctgagccccccatgggcccccggcgcttcctgcccccagagcccaagcagccctggagcggcgtggtggatgccaccaccttccagagcgtgtgctaccagtatgtggacaccctgtacccaggctttgagggcacagagatgtggaaccccaaccgggagctgtctgaggactgcctgtacctgaatgtgtggaccccctacccccggcccaccagccccacccctgtgctggtgtggatctacggcggcggcttctacagcggggccagcagcctggatgtgtatgatggccgcttcctggtgcaggccgagaggacagtgctggtgtccatgaactacagagtgggcgccttcggcttcctggccctgcccggcagccgggaggcccctggaaatgtgggcctgctggaccagaggctggccctgcagtgggtgcaggagaatgtggccgcctttggaggagaccccacctctgtgaccctgtttggagagagcgctggagctgcctctgtgggcatgcacctgctgagcccccccagccggggcctcttccacagagctgtgctgcagagcggggcccccaacggcccctgggccaccgtgggcatgggagaggccaggagaagagccacccagctggcccacctggtgggctgccccccaggcggcactggaggaaatgacacagagctggtggcctgcctgcggaccaggcctgcccaggtgctggtgaaccacgagtggcacgtgctgccccaggagagcgtcttccgcttctcctttgtgcctgtggtggatggagacttcctgagtgacaccccagaggccctgatcaatgctggggacttccacggcctgcaggtgctggtgggcgtggtgaaggatgagggcagctacttcctggtgtatggagcccctggcttcagcaaggacaatgaaagcctcatcagcagagctgagttcctggccggcgtgcgggtgggcgtgccccaggtgtctgacctggccgctgaggccgtggtgctgcactacacagactggctgcaccctgaggaccctgcccggctgcgggaggccctgagtgatgtggtgggggaccacaacgtggtgtgccctgtggcccagctggccggccgcctggccgcccagggcgcccgggtgtatgcctacgtgtttgagcaccgggccagcaccctgtcctggcccctgtggatgggcgtgccccacggctatgaaattgagttcatcttcggcatccccctggaccccagcaggaactacacagctgaggagaagatctttgcccagaggctgatgagatactgggccaactttgccaggactggagaccccaatgagccccgggaccccaaggccccccagtggccaccctacacagctggggcccagcagtatgtgtccctggacctgcggcccctggaggtgcggcggggcctgcgggcccaggcctgtgccttctggaaccgcttcctgcccaagctgctgagcgccacagccagcgaggcccccagcacctgccccggcttcacccatggagaggccgccccccggcccggcctgcccctgcccctgctgctgctgcaccagctgctgctgctcttcctgagccacctgcggcggctgtag

SEQ ID NO: 142186 - DNA, 1854 bp, Artificial Sequence; identical to SEQ ID NO: 142185
  Description of Artificial Sequence: Synthetic coding sequence

SEQ ID NO: 142187 - DNA, 1845 bp, Artificial Sequence; identical to SEQ ID NO: 142184
  Description of Artificial Sequence: Synthetic coding sequence

SEQ ID NO: 142188 - DNA, 1581 bp, Artificial Sequence
  Description of Artificial Sequence: Synthetic coding sequence
atgaggcctccccagtgcctgctgcacacccccagcctggccagccccctgctgctgctgctgctgtggctgctgggcggcggcgtgggcgctgagggcagagaagatgctgagctgctggtgacagtgcggggcggccgcctgcggggcatccggctgaagacccctgggggccctgtgtctgccttcctgggcatcccctttgctgagccccccatgggcccccggcgcttcctgcccccagagcccaagcagccctggagcggcgtggtggatgccaccaccttccagagcgtgtgctaccagtatgtggacaccctgtacccaggctttgagggcacagagatgtggaaccccaaccgggagctgtctgaggactgcctgtacctgaatgtgtggaccccctacccccggcccaccagccccacccctgtgctggtgtggatctacggcggcggcttctacagcggggccagcagcctggatgtgtatgatggccgcttcctggtgcaggccgagaggacagtgctggtgtccatgaactacagagtgggcgccttcggcttcctggccctgcccggcagccgggaggcccctggaaatgtgggcctgctggaccagaggctggccctgcagtgggtgcaggagaatgtggccgcctttggaggagaccccacctctgtgaccctgtttggagagagcgctggagctgcctctgtgggcatgcacctgctgagcccccccagccggggcctcttccacagagctgtgctgcagagcggggcccccaacggcccctgggccaccgtgggcatgggagaggccaggagaagagccacccagctggcccacctggtgggctgccccccaggcggcactggaggaaatgacacagagctggtggcctgcctgcggaccaggcctgcccaggtgctggtgaaccacgagtggcacgtgctgccccaggagagcgtcttccgcttctcctttgtgcctgtggtggatggagacttcctgagtgacaccccagaggccctgatcaatgctggggacttccacggcctgcagctggccggccgcctggccgcccagggcgcccgggtgtatgcctacgtgtttgagcaccgggccagcaccctgtcctggcccctgtggatgggcgtgccccacggctatgaaattgagttcatcttcggcatccccctggaccccagcaggaactacacagctgaggagaagatctttgcccagaggctgatgagatactgggccaactttgccaggactggagaccccaatgagccccgggaccccaaggccccccagtggccaccctacacagctggggcccagcagtatgtgtccctggacctgcggcccctggaggtgcggcggggcctgcgggcccaggcctgtgccttctggaaccgcttcctgcccaagctgctgagcgccacagacaccctggatgaggccgagcggcagtggaaggccgagttccaccgctggagcagctacatggtgcactggaagaaccagtttgaccactacagcaagcaggaccgctgcagcgacctgtag

SEQ ID NO: 142189 - DNA, 1806 bp, Artificial Sequence
  Description of Artificial Sequence: Synthetic coding sequence
atgaggcctccccagtgcctgctgcacacccccagcctggccagccccctgctgctgctgctgctgtggctgctgggcggcggcgtgggcgctgagggcagagaagatgctgagctgctggtgacagtgcggggcggccgcctgcggggcatccggctgaagacccctgggggccctgtgtctgccttcctgggcatcccctttgctgagccccccatgggcccccggcgcttcctgcccccagagcccaagcagccctggagcggcgtggtggatgccaccaccttccagagcgtgtgctaccagtatgtggacaccctgtacccaggctttgagggcacagagatgtggaaccccaaccgggagctgtctgaggactgcctgtacctgaatgtgtggaccccctacccccggcccaccagccccacccctgtgctggtgtggatctacggcggcggcttctacagcggggccagcagcctggatgtgtatgatggccgcttcctggtgcaggccgagaggacagtgctggtgtccatgaactacagagtgggcgccttcggcttcctggccctgcccggcagccgggaggcccctggaaatgtgggcctgctggaccagaggctggccctgcagtgggtgcaggagaatgtggccgcctttggaggagaccccacctctgtgaccctgtttggagagagcgctggagctgcctctgtgggcatgcacctgctgagcccccccagccggggcctcttccacagagctgtgctgcagagcggggcccccaacggcccctgggccaccgtgggcatgggagaggccaggagaagagccacccagctggcccacctggtgggctgccccccaggcggcactggaggaaatgacacagagctggtggcctgcctgcggaccaggcctgcccaggtgctggtgaaccacgagtggcacgtgctgccccaggagagcgtcttccgcttctcctttgtgcctgtggtggatggagacttcctgagtgacaccccagaggccctgatcaatgctggggacttccacggcctgcaggtgctggtgggcgtggtgaaggatgagggcagctacttcctggtgtatggagcccctggcttcagcaaggacaatgaaagcctcatcagcagagctgagttcctggccggcgtgcgggtgggcgtgccccaggtgtctgacctggccgctgaggccgtggtgctgcactacacagactggctgcaccctgaggaccctgcccggctgcgggaggccctgagtgatgtggtgggggaccacaacgtggtgtgccctgtggcccagctggccggccgcctggccgcccagggcgcccgggtgtatgcctacgtgtttgagcaccgggccagcaccctgtcctggcccctgtggatgggcgtgccccacggctatgaaattgagttcatcttcggcatccccctggaccccagcaggaactacacagctgaggagaagatctttgcccagaggctgatgagatactgggccaactttgccaggactggagaccccaatgagccccgggaccccaaggccccccagtggccaccctacacagctggggcccagcagtatgtgtccctggacctgcggcccctggaggtgcggcggggcctgcgggcccaggcctgtgccttctggaaccgcttcctgcccaagctgctgagcgccaccggcatgcagggccctgctggcagcggccggcggggcgtgggcgcccgctgcaaccccagcctgctgcccctggccagcgagtag

SEQ ID NO: 142190 - DNA, 1845 bp, Artificial Sequence; identical to SEQ ID NO: 142184
  Description of Artificial Sequence: Synthetic coding sequence

SEQ ID NO: 142191 - DNA, 480 bp, Artificial Sequence
  Description of Artificial Sequence: Synthetic coding sequence
atgaggcctccccagtgcctgctgcacacccccagcctggccagccccctgctgctgctgctgctgtggctgctgggcggcggcgtgggcgctgagggcagagaagatgctgagctgctggtgacagtgcggggcggccgcctgcggggcatccggctgaagacccctgggggccctgtgtctgccttcctgggcatcccctttgctgagccccccatgggcccccggcgcttcctgcccccagagcccaagcagccctggagcggcgtggtggatgccaccaccttccagagcgtgtgctaccagtatgtggacaccctgtacccaggctttgagggcacagagatgtggaaccccaaccgggagctgtctgaggactgcctgtacctgaatgtgtggaccccctacccccggcccaccagccccacccctgtgctggtgtggatctacggcggcggcttctacagcggggccagctag

SEQ ID NO: 142192 - DNA, 87 bp, Artificial Sequence
  Description of Artificial Sequence: Synthetic coding sequence
atgaggcctccccagtgcctgctgcacacccccagcctggccagccccctgctgctgctgctgctgtggctgctgggcggcggctag

SEQ ID NO: 142193 - DNA, 282 bp, Artificial Sequence
  Description of Artificial Sequence: Synthetic coding sequence
atgctgggcctggtgatgagctgcccagacaggaccctggtgaccaaggtgcgcagccaccccagcggcaaccagcaccggcccacccggggcggcagccgctccttccactgcagaagaggagtgcccaggcctgctgccctgcgggtgctgccccgctgcccagccttcagtgatgctgcctgcccagctgccatgaggcctccccagtgcctgctgcacacccccagcctggccagccccctgctgctgctgctgctgtggctgctgggcggcggctag

SEQ ID NO: 142194 - DNA, 1284 bp, Artificial Sequence
  Description of Artificial Sequence: Synthetic coding sequence
atggctgtgctggccgccctgctgcggagcggggcccggagccgcagccccctgctgcggcggctggtgcaggagatccgctacgtggagaggagctatgtgtccaagcccaccctgaaggaggtggtgattgtgtctgccaccaggacccccatcggcagcttcctgggcagcctgagcctgctgcctgccaccaagctgggcagcatcgccatccagggcgccatcgagaaggccggcatccccaaggaggaggtgaaggaggcctacatgggaaatgtgctgcagggcggggagggccaggcccccacccggcaggccgtgctgggcgccggcctgcccatcagcaccccctgcaccaccatcaacaaggtgtgtgccagcggcatgaaggccatcatgatggccagccagagcctgatgtgtggccaccaggatgtgatggtggccggcggcatggagagcatgagcaatgtgccctacgtgatgaacagaggcagcaccccctacggcggcgtgaagctggaggacctgattgtgaaggatggcctgacagatgtgtacaacaagatccacatgggcagctgtgccgagaacacagccaagaagctgaacatcgccagaaatgagcaggatgcctatgccatcaacagctacaccaggagcaaggccgcctgggaggccggcaagtttggaaatgaagtcatccctgtgacagtgacagtgaagggccagccagatgtggtggtgaaggaggatgaggagtacaagagggtggacttcagcaaggtgcccaagctgaagacagtgttccagaaggaaaatggaacagtgacagctgccaatgccagcaccctgaatgatggagctgctgccctggtgctgatgacagcagatgctgccaagaggctgaatgtgacccccctggcccgcatcgtggcctttgctgatgctgctgtggagcccatcgacttccccatcgcccctgtgtatgctgcctccatggtgctgaaggatgtgggcctgaagaaggaggacatcgccatgtgggaggtgaatgaggccttcagcctggtggtgctggccaacatcaagatgctggagattgacccccagaaggtgaacatcaatggaggagctgtgtccctgggccaccccatcggcatgtctggggcccgcatcgtgggccacctgacccacgccctgaagcagggcgagtatggcctggccagcatctgcaatggaggcggcggggccagcgccatgctgatccagaagctgtag

SEQ ID NO: 142195 - DNA, 1194 bp, Artificial Sequence
  Description of Artificial Sequence: Synthetic coding sequence
atgaatgccggcagtgaccctgtggtgattgtgtctgctgcccggaccatcatcggcagcttcaacggggccctggccgctgtgcctgtgcaggacctgggcagcaccgtcatcaaggaggtgctgaagagggccaccgtggccccagaagatgtgtctgaggtgatctttggacatgtgctggccgccggctgcggccagaaccctgtgcggcaggcctctgtgggcgccggcatcccctacagcgtgcctgcctggagctgccagatgatctgtggcagcggcctgaaggctgtgtgcctggccgtgcagagcatcggcatcggggacagcagcatcgtggtggccggcggcatggagaacatgagcaaggccccccacctggcctacctgaggactggagtgaagattggagagatgcccctgacagacagcatcctgtgtgatggcctgacagatgccttccacaactgccacatgggcatcacagcagaaaatgtggccaagaagtggcaggtgtcccgggaggaccaggacaaggtggccgtgctgagccagaacagaacagaaaatgcccagaaggccggccactttgacaaggagatcgtgcctgtgctggtgtccaccaggaagggcctcatcgaggtgaagacagatgagttccccaggcatggcagcaacatcgaggccatgagcaagctgaagccctacttcctgacagatggcactggaacagtgaccccagccaatgccagcggcatcaatgatggagctgctgctgtggtgctgatgaagaagtctgaggccgacaagaggggcctgacccccctggcccgcatcgtgtcctggagccaggtgggcgtggagcccagcatcatgggcatcggccccatcccagccatcaagcaggccgtgaccaaggccggctggagcctggaggatgtggacatctttgagatcaatgaggcctttgctgctgtgtctgctgccatcgtgaaggagctgggcctgaaccctgagaaggtgaacatcgagggcggggccatcgccctgggccaccccctgggcgccagcggctgccgcatcctggtgaccctgctgcacaccctggagaggatgggccgcagccggggcgtggccgccctgtgcatcggcggcggcatgggcatcgccatgtgtgtgcagcgggagtag

SEQ ID NO: 142196 - DNA, 1281 bp, Artificial Sequence
  Description of Artificial Sequence: Synthetic coding sequence
atgggcagccaccctgtgctgcgcatctggggcaacagaagagccacagctgccagcctgggccgcagcggcggccgcctgagcagcccccggctgctgcgggtggtggcccccaccctgacctttgcccagaccagccgctgcagcttcaatggagccctggccgctgtgcctgtgcaggacctgggcagcaccgtcatcaaggaggtgctgaagagggccaccgtggccccagaagatgtgtctgaggtgatcttcggccacgtgctggccgccggctgcggccagaaccctgtgcggcaggcctctgtgggcgccggcatcccctacagcgtgcctgcctggagctgccagatgatctgtggcagcggcctgaaggctgtgtgcctggccgtgcagagcattggaattggagacagcagcatcgtggtggccggcggcatggagaacatgagcaaggccccccacctggcctacctgaggactggagtgaagatcggggagatgcccctgacagacagcatcctgtgtgatggcctgacagatgccttccacaactgccacatgggcatcacagcagaaaatgtggccaagaagtggcaggtgtcccgggaggaccaggacaaggtggccgtgctgagccagaacagaacagaaaatgcccagaaggccggccactttgacaaggagatcgtgcctgtgctggtgtccaccaggaagggcctgattgaggtgaagacagatgagttccccaggcatggcagcaacatcgaggccatgagcaagctgaagccctacttcctgacagatggcaccggcaccgtgaccccagccaatgccagcggcatcaatgatggagctgctgctgtggtgctgatgaagaagtctgaggccgacaagaggggcctgacccccctggccagaattgtgtcctggagccaggtgggcgtggagcccagcatcatgggcatcggccccatcccagccatcaagcaggccgtgaccaaggccggctggagcctggaggatgtggacatctttgagatcaatgaggcctttgctgctgtgtctgctgccatcgtgaaggagctgggcctgaaccctgagaaggtgaacattgaaggaggagccatcgccctgggccaccccctgggcgccagcggctgccgcatcctggtgaccctgctgcacaccctggagaggatgggccgcagcagaggagtggccgccctgtgcattggaggcggcatgggcatcgccatgtgtgtgcagcgggagtag

SEQ ID NO: 142197 - DNA, 1275 bp, Artificial Sequence
  Description of Artificial Sequence: Synthetic coding sequence
atgcagaggctgcaggtggtgctgggccacctgcggggccctgctgacagcggctggatgccccaggccgccccctgcctgagcggggccccccaggccagcgctgctgatgtggtggtggtgcacggccgcaggacagccatctgcagagctggccggggcggcttcaaggacaccaccccagatgagctgctgtctgctgtgatgacagctgtgctgaaggatgtgaacctgcggcctgagcagctgggggacatctgtgtgggcaatgtgctgcagcccggggccggggccatcatggccagaattgcccagttcctgagtgacatccctgagaccgtgcccctgagcacagtgaaccggcagtgcagcagcggcctgcaggccgtggccagcattgctgggggcatcagaaatggcagctatgacatcggcatggcctgtggggtggagagcatgagcctggccgaccggggcaaccctggcaacatcaccagccggctgatggagaaggagaaggcccgggactgcctgatccccatgggcatcaccagtgaaaatgtggccgagcgcttcggcatcagccgggagaagcaggacacctttgccctggccagccagcagaaggccgcccgggcccagagcaagggctgcttccaggccgagatcgtgcctgtgaccaccaccgtgcatgatgacaagggcaccaagaggagcatcaccgtgacccaggatgagggcatccggcccagcaccaccatggagggcctggccaagctgaagccagccttcaagaaggatggcagcaccacagctggcaacagcagccaggtgtctgatggagctgctgccatcctgctggcccggcgcagcaaggccgaggagctgggcctgcccatcctgggcgtgctgcggagctatgctgtggtgggcgtgcccccagacatcatgggcatcggccctgcctatgccatccctgtggccctgcagaaggccggcctgactgtgtctgatgtggacatctttgagatcaatgaggcctttgccagccaggccgcctactgtgtggagaagctgcggctgcccccagagaaggtgaaccccctgggcggcgctgtggccctgggccaccccctgggctgcaccggggcccggcaggtgatcaccctgctgaatgagctgaagaggcggggcaagagggcctacggcgtggtgtccatgtgcattggaacaggcatgggcgctgctgctgtgtttgagtacccaggcaactag

SEQ ID NO: 142198 - DNA, 1071 bp, Artificial Sequence
  Description of Artificial Sequence: Synthetic coding sequence
atgacagctgtgctgaaggatgtgaacctgcggcctgagcagctgggggacatctgtgtgggcaatgtgctgcagcccggggccggggccatcatggccagaattgcccagttcctgagtgacatccctgagaccgtgcccctgagcacagtgaaccggcagtgcagcagcggcctgcaggccgtggccagcattgctgggggcatcagaaatggcagctatgacatcggcatggcctgtggggtggagagcatgagcctggccgaccggggcaaccctggcaacatcaccagccggctgatggagaaggagaaggcccgggactgcctgatccccatgggcatcaccagtgaaaatgtggccgagcgcttcggcatcagccgggagaagcaggacacctttgccctggccagccagcagaaggccgcccgggcccagagcaagggctgcttccaggccgagatcgtgcctgtgaccaccaccgtgcatgatgacaagggcaccaagaggagcatcaccgtgacccaggatgagggcatccggcccagcaccaccatggagggcctggccaagctgaagccagccttcaagaaggatggcagcaccacagctggcaacagcagccaggtgtctgatggagctgctgccatcctgctggcccggcgcagcaaggccgaggagctgggcctgcccatcctgggcgtgctgcggagctatgctgtggtgggcgtgcccccagacatcatgggcatcggccctgcctatgccatccctgtggccctgcagaaggccggcctgactgtgtctgatgtggacatctttgagatcaatgaggcctttgccagccaggccgcctactgtgtggagaagctgcggctgcccccagagaaggtgaaccccctgggcggcgctgtggccctgggccaccccctgggctgcaccggggcccggcaggtgatcaccctgctgaatgagctgaagaggcggggcaagagggcctacggcgtggtgtccatgtgcattggaacaggcatgggcgctgctgctgtgtttgagtacccaggcaactag

SEQ ID NO: 142199 - DNA, 462 bp, Artificial Sequence
  Description of Artificial Sequence: Synthetic coding sequence
atgcagaggctgcaggtggtgctgggccacctgcggggccctgctgacagcggctggatgccccaggccgccccctgcctgagcggggccccccaggccagcgctgctgatgtggtggtggtgcacggccgcaggacagccatctgcagagctggccggggcggcttcaaggacaccaccccagatgagctgctgtctgctgtgatgacagctgtgctgaaggatgtgaacctgcggcctgagcagctgggggacatctgtgtgggcaatgtgctgcagcccggggccggggccatcatggccagaattgcccagttcctgagtgacatccctgagaccgtgcccctgagcacagtgaaccggcagtgcagcagcggcctgcaggccgtggccagcattgctggctggagcccctgcccctggctgacagagggcaccctggagatcctgctgcgggcctag

SEQ ID NO: 142200 - DNA, 381 bp, Artificial Sequence
  Description of Artificial Sequence: Synthetic coding sequence
atgagcctggccgaccggggcaaccctggcaacatcaccagccggctgatggagaaggagaaggcccgggactgcctgatccccatgggcatcaccagtgaaaatgtggccgagcgcttcggcatcagccgggagaagcaggacacctttgccctggccagccagcagaaggccgcccgggcccagagcaagggctgcttccaggccgagatcgtgcctgtgaccaccaccgtgcatgatgacaagggcaccaagaggagcatcaccgtgacccaggatgagggcatccggcccagcaccaccatggagggcctggccaagctgaagccagccttcaagaaggatggcagcaccacagctggggagactggacctggatag

SEQ ID NO: 142201 - DNA, 996 bp, Artificial Sequence
  Description of Artificial Sequence: Synthetic coding sequence
atgcagaggctgcaggtggtgctgggccacctgcggggccctgctgacagcggctggatgccccaggccgccccctgcctgagcggggccccccaggccagcgctgctgatgtggtggtggtgcacggccgcaggacagccatctgcagagctggccggggcggcttcaaggacaccaccccagatgagctgctgtctgctgtgatgacagctgtgctgaaggatgtgaacctgcggcctgagcagctgggggacatctgtgtgggcaatgtgctgcagcccggggccggggccatcatggccagaattgcccagttcctgagtgacatccctgagaccgtgcccctgagcacagtgaaccggcagtgcagcagcggcctgcaggccgtggccagcattgctgggggcatcagaaatggcagctatgacatcggcatggcctgtggcatcaccagtgaaaatgtggccgagagatttggcatcagccgggagaagcaggacacctttgccctggccagccagcagaaggccgcccgggcccagagcaagggctgcttccaggccgagatcgtgcctgtgaccaccaccgtgcatgatgacaagggcaccaagaggagcatcaccgtgacccaggatgagggcatccggcccagcaccaccatggagggcctggccaagctgaagccagccttcaagaaggatggcagcaccacagctggcctgactgtgtctgatgtggacatctttgagatcaatgaggcctttgccagccaggccgcctactgtgtggagaagctgcggctgcccccagagaaggtgaaccccctgggcggcgctgtggccctgggccaccccctgggctgcacaggagcccggcaggtgatcaccctgctgaatgagctgaagagaagaggcaagagggcctatggagtggtgtccatgtgcatcggcaccggcatgggcgctgctgctgtgtttgagtacccaggcaactag

SEQ ID NO: 142202 - DNA, 7377 bp, Artificial Sequence
  Description of Artificial Sequence: Synthetic coding sequence
atggtgctgctgctgtgcctgagctgcctgatcttcagctgcctgaccttctcctggctgaagatctggggcaagatgacagacagcaagcccatcaccaagagcaagtctgaggccaacctgatccccagccaggagcccttccctgccagtgacaacagcggggagaccccccagagaaatggagagggccacaccctgcccaagacccccagccaggccgagcccgccagccacaagggccccaaggatgctggaagaagaagaaacagcctgccccccagccaccagaagcccccaagaaaccccctgagcagcagtgatgctgcccccagccctgagctgcaggccaacggcaccggcacccagggcctggaggccacagacaccaacggcctgagcagcagcgcccggccccagggccagcaggccggcagccccagcaaggaggacaagaagcaggccaacatcaagaggcagctgatgaccaacttcatcctgggcagctttgatgactacagcagtgatgaagattctgtggccggcagcagccgggagagcaccaggaagggcagccgggccagcctgggcgccctgagcctggaggcctacctgaccactggagaggccgagaccagggtgcccaccatgaggcccagcatgagcggcctgcacctggtgaagaggggccgggagcacaagaagctggacctgcaccgggacttcaccgtggccagccctgctgagtttgtgaccaggtttggaggagacagagtcatcgagaaggtgctgattgccaacaacggcattgctgctgtgaagtgcatgaggagcatccgccgctgggcctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgattgtggacatcgccaagagaattcctgtgcaggccgtgtgggccggctggggccacgccagcgagaaccccaagctgcctgagctgctgtgcaagaatggagtggccttcctgggcccccccagcgaggccatgtgggccctgggggacaagatcgccagcacagtggtggcccagaccctgcaggtgcccaccctgccctggagcggcagcggcctgactgtggagtggacagaagatgacctgcagcagggcaagaggatctctgtgcctgaagatgtgtatgacaagggctgtgtgaaggatgtggatgagggcctggaggccgctgagagaattggcttccccctgatgatcaaggccagcgagggcggcggcggcaagggcatcaggaaggccgagagcgctgaggacttccccatcctcttccggcaggtgcagagcgagatccctggcagccccatcttcctgatgaagctggcccagcacgcccggcacctggaggtgcagatcctggccgaccagtatggaaatgctgtgtccctgtttggccgggactgcagcatccagaggaggcaccagaagatcgtggaggaggccccagccaccatcgcccccctggccatctttgagttcatggagcagtgtgccatccggctggccaagacagtgggctacgtgtctgctggcaccgtggagtacctgtacagccaggacggcagcttccacttcctggagctgaacccccggctgcaggtggagcacccctgcacagagatgattgctgatgtgaacctgcctgctgcccagctgcagatcgccatgggcgtgcccctgcaccggctgaaggacatccggctgctgtatggagagagcccctggggcgtgacccccatcagctttgagacccccagcaacccccccctggcccggggccacgtgattgctgcccgcatcaccagcgagaacccagatgagggcttcaagcccagcagcggcaccgtgcaggagctgaacttccgcagcagcaagaatgtgtggggctacttctctgtggccgccactggaggcctgcatgaatttgctgacagccagtttggccactgcttctcctggggcgagaaccgggaggaggccatcagcaacatggtggtggccctgaaggagctgagcatccggggggacttccgcaccaccgtggagtacctgatcaacctgctggagacagagagcttccagaacaatgacatcgacaccggctggctggactacctgattgctgagaaggtgcaggccgagaagccagacatcatgctgggcgtggtgtgtggggccctgaatgtggctgatgccatgttccgcacctgcatgacagacttcctgcacagcctggagcggggccaggtgctgcctgctgacagcctgctgaacctggtggatgtggagctgatctatggaggagtgaagtacatcctgaaggtggcccggcagagcctgaccatgtttgtgctgatcatgaatggctgccacattgaaattgatgcccaccggctgaatgatggcggcctgctgctgagctacaacggcaacagctacaccacctacatgaaggaggaggtggacagctaccgcatcaccatcggcaacaagacctgtgtgtttgagaaggaaaatgaccccaccgtgctgcggagccccagcgctgggaagctgacccagtacacagtggaggatggcggccacgtggaggccggcagcagctatgcagagatggaggtgatgaagatgatcatgaccctgaatgtgcaggagcggggccgggtgaagtacatcaagaggcctggagctgtgctggaggccggctgtgtggtggcccggctggagctggatgaccccagcaaggtgcaccctgctgagcccttcaccggggagctgcctgcccagcagaccctgcccatcctgggggagaagctgcaccaggtgttccacagcgtgctggagaacctgaccaacgtgatgagcggcttctgcctgcctgagcctgtgttcagcatcaagctgaaggagtgggtgcagaagctgatgatgaccctgcggcaccccagcctgcccctgctggagctgcaggagatcatgacctctgtggccggccgcatcccagcccctgtggagaagtctgtgcggcgggtgatggcccagtatgccagcaacatcacctctgtgctgtgccagttccccagccagcagatcgccaccatcctggactgccacgccgccaccctgcagaggaaggctgaccgggaggtgttcttcatcaacacccagagcatcgtgcagctggtgcagcgctaccgcagcggcatccggggctacatgaagacagtggtgctggacctgctgcggcgctacctgcgggtggagcaccacttccagcaggcccactatgacaagtgtgtgatcaacctgcgggagcagttcaagccagacatgagccaggtgctggactgcatcttcagccacgcccaggtggccaagaagaaccagctggtgatcatgctgattgatgagctgtgtggccctgaccccagcctgagtgatgagctgatcagcatcctgaatgagctgacccagctgagcaagtctgagcactgcaaggtggccctgcgggcccggcagatcctgattgccagccacctgcccagctatgagctgcggcacaaccaggtggagagcatcttcctgagcgccatcgacatgtatggccaccagttctgcccagagaacctgaagaagctgatcctgtctgagaccaccatctttgatgtgctgcccaccttcttctaccacgccaacaaggtggtgtgcatggccagcctggaggtgtatgtgcggcggggctacatcgcctatgagctgaacagcctgcagcaccggcagctgcctgatggcacctgtgtggtggagttccagttcatgctgcccagcagccaccccaacaggatgacagtgcccatcagcatcaccaacccagacctgctgcggcacagcacagagctgttcatggattctggcttcagccccctgtgccagaggatgggcgccatggtggccttcagaagatttgaggacttcaccaggaactttgatgaagtcatcagctgctttgccaacgtgcccaaggacacccccctcttcagcgaggcccggaccagcctgtacagtgaagatgactgcaagagcctgcgggaggagcccatccacatcctgaatgtgtccatccagtgtgccgaccacctggaggatgaggccctggtgcccatcctgcggacctttgtgcagagcaagaagaacatcctggtggactatggcctgcggcgcatcaccttcctgattgcccaggagaaggagttccccaagttcttcaccttccgggccagagatgaatttgctgaagatcgcatctaccgccacctggagcccgccctggccttccagctggagctgaacaggatgaggaactttgacctgacagctgtgccctgtgccaaccacaagatgcacctgtacctgggcgccgccaaggtgaaggagggcgtggaggtgacagaccaccgcttcttcatccgggccatcatccgccacagcgacctgatcaccaaggaggccagctttgagtacctgcagaatgaaggagagcggctgctgctggaggccatggatgagctggaggtggccttcaacaacacctctgtgaggacagactgcaaccacatcttcctgaactttgtgcccaccgtcatcatggaccccttcaagattgaggagagcgtgcgctacatggtgatgagatatggcagccggctgtggaagctgcgggtgctgcaggccgaggtgaagatcaacatccggcagaccaccactggatctgctgtgcccatccgcctcttcatcaccaatgaaagtggctactacctggacatcagcctgtacaaggaggtgacagacagccgcagcggcaacatcatgttccacagctttggaaacaagcagggcccccagcacggcatgctgatcaacaccccctacgtgaccaaggacctgctgcaggccaagcgcttccaggcccagaccctgggcaccacctacatctatgacttccctgagatgttccggcaggccctcttcaagctgtggggcagcccagacaagtaccccaaggacatcctgacctacacagagctggtgctggacagccagggccagctggtggagatgaaccggctgcccggcggcaatgaggtgggcatggtggccttcaagatgaggttcaagacccaggagtacccagagggcagagatgtgattgtgattggaaatgacatcaccttcagaattggcagctttggacctggagaggacctgctgtacctgcgggccagcgagatggcccgggcagagggcatccccaagatctacgtggccgccaacagcggggccagaattggcatggccgaggagatcaagcacatgttccacgtggcctgggtggaccctgaggacccccacaagggcttcaagtacctgtacctgaccccccaggactacacccgcatcagcagcctgaacagcgtgcactgcaagcacatcgaggagggcggggagagccgctacatgatcacagacatcatcggcaaggatgatggcctgggcgtggagaacctgcggggcagcggcatgattgctggggagagcagcctggcctatgaggagatcgtgaccatcagcctggtgacctgccgggccatcggcatcggggcctacctggtgcggctgggccagagggtcatccaggtggagaacagccacatcatcctgaccggggccagcgccctgaacaaggtgctgggccgggaggtgtacaccagcaacaaccagctgggcggcgtgcagatcatgcactacaatggagtgagccacatcaccgtgcctgatgactttgagggcgtgtacaccatcctggagtggctgagctacatgcccaaggacaaccacagccctgtgcccatcatcacccccacagaccccatcgaccgggagattgagttcctgcccagccgggccccctatgacccccgctggatgctggccggccggccccaccccaccctgaagggcacctggcagagcggcttctttgaccacggcagcttcaaggagatcatggccccctgggcccagacagtggtgacaggccgggcccggctgggcggcatccctgtgggcgtgattgctgtggagaccaggacagtggaggtggccgtgcctgctgaccctgccaacctggacagcgaggccaagatcatccagcaggccggccaggtgtggttcccagattctgcctacaagacagcccaggccgtgaaggacttcaaccgggagaagctgcccctgatgatctttgccaactggaggggcttcagcggcggcatgaaggacatgtatgaccaggtgctgaagtttggagcctacatcgtggatggcctgcggcagtacaagcagcccatcctgatctacatccccccctatgcagagctgcggggcggctcctgggtggtgattgatgccaccatcaaccccctgtgcatcgagatgtatgctgacaaggagagccggggcggcgtgctggagcctgagggcaccgtggagatcaagttcaggaagaaggacctgatcaagtccatgagaagaattgatcctgcctacaagaagctgatggagcagctgggggagccagacctgagtgacaaggacaggaaggacctggagggccgcctgaaggcccgggaggacctgctgctgcccatctaccaccaggtggccgtgcagtttgctgacttccatgacaccccaggccgcatgctggagaagggcgtcatcagtgacatcctggagtggaagacagcccggaccttcctgtactggaggctgcggcggctgctgctggaggaccaggtgaagcaggagatcctgcaggccagcggggagctgagccacgtgcacatccagagcatgctgcggcgctggtttgtggagacagagggcgctgtgaaggcctacctgtgggacaacaaccaggtggtggtgcagtggctggagcagcactggcaggccggagatggccccaggagcaccatccgggagaacatcacctacctgaagcatgacagcgtgctgaagaccatccggggcctggtggaggagaaccctgaggtggccgtggactgtgtgatctacctgagccagcacatcagccctgctgagcgggcccaggtggtgcacctgctgagcaccatggacagccctgccagcacctag

SEQ ID NO: 142203 - DNA, 7377 bp, Artificial Sequence; identical to SEQ ID NO: 142202
  Description of Artificial Sequence: Synthetic coding sequence

SEQ ID NO: 142204 - DNA, 7167 bp, Artificial Sequence
  Description of Artificial Sequence: Synthetic coding sequence
atggtgctgctgctgtgcctgagctgcctgatcttcagctgcctgaccttctcctggctgaagatctggggcaagatgacagacagcaagcccatcaccaagagcaagtctgaggccaacctgatccccagccaggagcccttccctgccagtgacaacagcggggagaccccccagagaaatggagagggccacaccctgcccaagacccccagccaggccgagcccgccagccacaagggccccaaggatgctggaagaagaagaaacagcctgccccccagccaccagaagcccccaagaaaccccctgagcagcagtgatgctgcccccagccctgagctgcaggccaacggcaccggcacccagggcctggaggccacagacaccaacggcctgagcagcagcgcccggccccagggccagcaggccggcagccccagcaaggaggacaagaagcaggccaacatcaagaggcagctgatgaccaacttcatcctgggcagctttgatgactacagcagtgatgaagattctgtggccggcagcagccgggagagcaccaggaagggcagccgggccagcctgggcgccctgagcctggaggcctacctgaccactggagaggccgagaccagggtgcccaccatgaggcccagcatgagcggcctgcacctggtgaagaggggccgggagcacaagaagctggacctgcaccgggacttcaccgtggccagccctgctgagtttgtgaccaggtttggaggagacagagtcatcgagaaggtgctgattgccaacaacggcattgctgctgtgaagtgcatgaggagcatccgccgctgggcctatgagatgttcagaaatgaaagagccatccgctttgtggtgatggtgaccccagaggacctgaaggccaatgctgagtacatcaagatggctgaccactacgtgcctgtgcctgggggccccaacaacaacaactatgccaacgtggagctgattgtggacatcgccaagagaattcctgtgcaggccgtgtgggccggctggggccacgccagcgagaaccccaagctgcctgagctgctgtgcaagaatggagtggccttcctgggcccccccagcgaggccatgtgggccctgggggacaagatcgccagcacagtggtggcccagaccctgcaggtgcccaccctgccctggagcggcagcggcctgactgtggagtggacagaagatgacctgcagcagggcaagaggatctctgtgcctgaagatgtgtatgacaagggctgtgtgaaggatgtggatgagggcctggaggccgctgagagaattggcttccccctgatgatcaaggccagcgagggcggcggcggcaagggcatcaggaaggccgagagcgctgaggacttccccatcctcttccggcaggtgcagagcgagatccctggcagccccatcttcctgatgaagctggcccagcacgcccggcacctggaggtgcagatcctggccgaccagtatggaaatgctgtgtccctgtttggccgggactgcagcatccagaggaggcaccagaagatcgtggaggaggccccagccaccatcgcccccctggccatctttgagttcatggagcagtgtgccatccggctggccaagacagtgggctacgtgtctgctggcaccgtggagtacctgtacagccaggacggcagcttccacttcctggagctgaacccccggctgcaggtggagcacccctgcacagagatgattgctgatgtgaacctgcctgctgcccagctgcagatcgccatgggcgtgcccctgcaccggctgaaggacatccggctgctgtatggagagagcccctggggcgtgacccccatcagctttgagacccccagcaacccccccctggcccggggccacgtgattgctgcccgcatcaccagcgagaacccagatgagggcttcaagcccagcagcggcaccgtgcaggagctgaacttccgcagcagcaagaatgtgtggggctacttctctgtggccgccactggaggcctgcatgaatttgctgacagccagtttggccactgcttctcctggggcgagaaccgggaggaggccatcagcaacatggtggtggccctgaaggagctgagcatccggggggacttccgcaccaccgtggagtacctgatcaacctgctggagacagagagcttccagaacaatgacatcgacaccggctggctggactacctgattgctgagaaggtgcaggccgagaagccagacatcatgctgggcgtggtgtgtggggccctgaatgtggctgatgccatgttccgcacctgcatgacagacttcctgcacagcctggagcggggccaggtgctgcctgctgacagcctgctgaacctggtggatgtggagctgatctatggaggagtgaagtacatcctgaaggtggcccggcagagcctgaccatgtttgtgctgatcatgaatggctgccacattgaaattgatgcccaccggctgaatgatggcggcctgctgctgagctacaacggcaacagctacaccacctacatgaaggaggaggtggacagctaccgcatcaccatcggcaacaagacctgtgtgtttgagaaggaaaatgaccccaccgtgctgcggagccccagcgctgggaagctgacccagtacacagtggaggatggcggccacgtggaggccggcagcagctatgcagagatggaggtgatgaagatgatcatgaccctgaatgtgcaggagcggggccgggtgaagtacatcaagaggcctggagctgtgctggaggccggctgtgtggtggcccggctggagctggatgaccccagcaaggtgcaccctgctgagcccttcaccggggagctgcctgcccagcagaccctgcccatcctgggggagaagctgcaccaggtgttccacagcgtgctggagaacctgaccaacgtgatgagcggcttctgcctgcctgagcctgtgttcagcatcaagctgaaggagtgggtgcagaagctgatgatgaccctgcggcaccccagcctgcccctgctggagctgcaggagatcatgacctctgtggccggccgcatcccagcccctgtggagaagtctgtgcggcgggtgatggcccagtatgccagcaacatcacctctgtgctgtgccagttccccagccagcagatcgccaccatcctggactgccacgccgccaccctgcagaggaaggctgaccgggaggtgttcttcatcaacacccagagcatcgtgcagctggtgcagagcaaggatgagctgtgtggccctgaccccagcctgagtgatgagctgatcagcatcctgaatgagctgacccagctgagcaagtctgagcactgcaaggtggccctgcgggcccggcagatcctgattgccagccacctgcccagctatgagctgcggcacaaccaggtggagagcatcttcctgagcgccatcgacatgtatggccaccagttctgcccagagaacctgaagaagctgatcctgtctgagaccaccatctttgatgtgctgcccaccttcttctaccacgccaacaaggtggtgtgcatggccagcctggaggtgtatgtgcggcggggctacatcgcctatgagctgaacagcctgcagcaccggcagctgcctgatggcacctgtgtggtggagttccagttcatgctgcccagcagccaccccaacaggatgacagtgcccatcagcatcaccaacccagacctgctgcggcacagcacagagctgttcatggattctggcttcagccccctgtgccagaggatgggcgccatggtggccttcagaagatttgaggacttcaccaggaactttgatgaagtcatcagctgctttgccaacgtgcccaaggacacccccctcttcagcgaggcccggaccagcctgtacagtgaagatgactgcaagagcctgcgggaggagcccatccacatcctgaatgtgtccatccagtgtgccgaccacctggaggatgaggccctggtgcccatcctgcggacctttgtgcagagcaagaagaacatcctggtggactatggcctgcggcgcatcaccttcctgattgcccaggagaaggagttccccaagttcttcaccttccgggccagagatgaatttgctgaagatcgcatctaccgccacctggagcccgccctggccttccagctggagctgaacaggatgaggaactttgacctgacagctgtgccctgtgccaaccacaagatgcacctgtacctgggcgccgccaaggtgaaggagggcgtggaggtgacagaccaccgcttcttcatccgggccatcatccgccacagcgacctgatcaccaaggaggccagctttgagtacctgcagaatgaaggagagcggctgctgctggaggccatggatgagctggaggtggccttcaacaacacctctgtgaggacagactgcaaccacatcttcctgaactttgtgcccaccgtcatcatggaccccttcaagattgaggagagcgtgcgctacatggtgatgagatatggcagccggctgtggaagctgcgggtgctgcaggccgaggtgaagatcaacatccggcagaccaccactggatctgctgtgcccatccgcctcttcatcaccaatgaaagtggctactacctggacatcagcctgtacaaggaggtgacagacagccgcagcggcaacatcatgttccacagctttggaaacaagcagggcccccagcacggcatgctgatcaacaccccctacgtgaccaaggacctgctgcaggccaagcgcttccaggcccagaccctgggcaccacctacatctatgacttccctgagatgttccggcaggccctcttcaagctgtggggcagcccagacaagtaccccaaggacatcctgacctacacagagctggtgctggacagccagggccagctggtggagatgaaccggctgcccggcggcaatgaggtgggcatggtggccttcaagatgaggttcaagacccaggagtacccagagggcagagatgtgattgtgattggaaatgacatcaccttcagaattggcagctttggacctggagaggacctgctgtacctgcgggccagcgagatggcccgggcagagggcatccccaagatctacgtggccgccaacagcggggccagaattggcatggccgaggagatcaagcacatgttccacgtggcctgggtggaccctgaggacccccacaagggcttcaagtacctgtacctgaccccccaggactacacccgcatcagcagcctgaacagcgtgcactgcaagcacatcgaggagggcggggagagccgctacatgatcacagacatcatcggcaaggatgatggcctgggcgtggagaacctgcggggcagcggcatgattgctggggagagcagcctggcctatgaggagatcgtgaccatcagcctggtgacctgccgggccatcggcatcggggcctacctggtgcggctgggccagagggtcatccaggtggagaacagccacatcatcctgaccggggccagcgccctgaacaaggtgctgggccgggaggtgtacaccagcaacaaccagctgggcggcgtgcagatcatgcactacaatggagtgagccacatcaccgtgcctgatgactttgagggcgtgtacaccatcctggagtggctgagctacatgcccaaggacaaccacagccctgtgcccatcatcacccccacagaccccatcgaccgggagattgagttcctgcccagccgggccccctatgacccccgctggatgctggccggccggccccaccccaccctgaagggcacctggcagagcggcttctttgaccacggcagcttcaaggagatcatggccccctgggcccagacagtggtgacaggccgggcccggctgggcggcatccctgtgggcgtgattgctgtggagaccaggacagtggaggtggccgtgcctgctgaccctgccaacctggacagcgaggccaagatcatccagcaggccggccaggtgtggttcccagattctgcctacaagacagcccaggccgtgaaggacttcaaccgggagaagctgcccctgatgatctttgccaactggaggggcttcagcggcggcatgaaggacatgtatgaccaggtgctgaagtttggagcctacatcgtggatggcctgcggcagtacaagcagcccatcctgatctacatccccccctatgcagagctgcggggcggctcctgggtggtgattgatgccaccatcaaccccctgtgcatcgagatgtatgctgacaaggagagccggggcggcgtgctggagcctgagggcaccgtggagatcaagttcaggaagaaggacctgatcaagtccatgagaagaattgatcctgcctacaagaagctgatggagcagctgggggagccagacctgagtgacaaggacaggaaggacctggagggccgcctgaaggcccgggaggacctgctgctgcccatctaccaccaggtggccgtgcagtttgctgacttccatgacaccccaggccgcatgctggagaagggcgtcatcagtgacatcctggagtggaagacagcccggaccttcctgtactggaggctgcggcggctgctgctggaggaccaggtgaagcaggagatcctgcaggccagcggggagctgagccacgtgcacatccagagcatgctgcggcgctggtttgtggagacagagggcgctgtgaaggcctacctgtgggacaacaaccaggtggtggtgcagtggctggagcagcactggcaggccggagatggccccaggagcaccatccgggagaacatcacctacctgaagcatgacagcgtgctgaagaccatccggggcctggtggaggagaaccctgaggtggccgtggactgtgtgatctacctgagccagcacatcagccctgctgagcgggcccaggtggtgcacctgctgagcaccatggacagccctgccagcacctag

SEQ ID NO: 142205 - DNA, 5070 bp, Artificial Sequence
  Description of Artificial Sequence: Synthetic coding sequence
ctgcccttcctgctgaagccaccccagaccctgcccagcccagatgccatgttccgcacctgcatgacagacttcctgcacagcctggagcggggccaggtgctgcctgctgacagcctgctgaacctggtggatgtggagctgatctacggcggcgtgaagtacatcctgaaggtggcccggcagagcctgaccatgtttgtgctgatcatgaatggctgccacatcgagattgatgcccaccggctgaatgatggcggcctgctgctgagctacaatggaaacagctacaccacctacatgaaggaggaggtggacagctaccgcatcaccatcggcaacaagacctgtgtgtttgagaaggaaaatgaccccaccgtgctgcggagccccagcgctgggaagctgacccagtacacagtggaggatggcggccacgtggaggccggcagcagctatgcagagatggaggtgatgaagatgatcatgaccctgaatgtgcaggagcggggccgggtgaagtacatcaagaggcctggagctgtgctggaggccggctgtgtggtggcccggctggagctggatgaccccagcaaggtgcaccctgctgagcccttcaccggggagctgcctgcccagcagaccctgcccatcctgggggagaagctgcaccaggtgttccacagcgtgctggagaacctgaccaacgtgatgagcggcttctgcctgcctgagcccgtcttcagcatcaagctgaaggagtgggtgcagaagctgatgatgaccctgcggcaccccagcctgcccctgctggagctgcaggagatcatgacctctgtggccggccgcatcccagcccctgtggagaagtctgtgagaagagtgatggcccagtatgccagcaacatcacctctgtgctgtgccagttccccagccagcagatcgccaccatcctggactgccacgccgccaccctgcagaggaaggctgaccgggaggtgttcttcatcaacacccagagcatcgtgcagctggtgcagcgctacagaagtggcatccggggctacatgaagacagtggtgctggacctgctgcggcgctacctgcgggtggagcaccacttccagcaggcccactatgacaagtgtgtgatcaacctgcgggagcagttcaagccagacatgagccaggtgctggactgcatcttcagccacgcccaggtggccaagaagaaccagctggtgatcatgctgattgatgagctgtgtggccctgaccccagcctgagtgatgagctgatcagcatcctgaatgagctgacccagctgagcaagtctgagcactgcaaggtggccctgcgggcccggcagatcctgattgccagccacctgcccagctatgagctgcggcacaaccaggtggagagcatcttcctgagcgccatcgacatgtatggccaccagttctgcccagagaacctgaagaagctgatcctgtctgagaccaccatctttgatgtgctgcccaccttcttctaccacgccaacaaggtggtgtgcatggccagcctggaggtgtatgtgagaagaggctacatcgcctatgagctgaacagcctgcagcaccggcagctgcctgatggcacctgtgtggtggagttccagttcatgctgcccagcagccaccccaacaggatgacagtgcccatcagcatcaccaacccagacctgctgcggcacagcacagagctgttcatggacagcggcttcagccccctgtgccagaggatgggcgccatggtggccttccgccgctttgaggacttcaccaggaactttgatgaggtgatcagctgctttgccaacgtgcccaaggacacccccctcttcagcgaggcccggaccagcctgtacagtgaagatgactgcaagagcctgcgggaggagcccatccacatcctgaatgtgtccatccagtgtgccgaccacctggaggatgaggccctggtgcccatcctgcggacctttgtgcagagcaagaagaacatcctggtggactatggcctgcggcgcatcaccttcctgattgcccaggagaaggagttccccaagttcttcaccttccgggccagagatgaatttgctgaggaccgcatctaccgccacctggagcccgccctggccttccagctggagctgaacaggatgaggaactttgacctgacagctgtgccctgtgccaaccacaagatgcacctgtacctgggcgccgccaaggtgaaggagggcgtggaggtgacagaccaccgcttcttcatccgggccatcatccgccacagcgacctgatcaccaaggaggccagctttgagtacctgcagaatgaaggagagcggctgctgctggaggccatggatgagctggaggtggccttcaacaacacctctgtgaggacagactgcaaccacatcttcctgaactttgtgcccaccgtcatcatggaccccttcaagattgaggagagcgtgcgctacatggtgatgagatatggcagccggctgtggaagctgcgggtgctgcaggccgaggtgaagatcaacatccggcagaccaccaccggcagcgctgtgcccatccgcctcttcatcaccaatgaaagtggctactacctggacatcagcctgtacaaggaggtgacagacagccgcagcggcaacatcatgttccacagctttggaaacaagcagggcccccagcacggcatgctgatcaacaccccctacgtgaccaaggacctgctgcaggccaagcgcttccaggcccagaccctgggcaccacctacatctatgacttccctgagatgttccggcaggccctcttcaagctgtggggcagcccagacaagtaccccaaggacatcctgacctacacagagctggtgctggacagccagggccagctggtggagatgaaccggctgcccggcggcaatgaggtgggcatggtggccttcaagatgaggttcaagacccaggagtacccagagggcagagatgtgattgtgattggaaatgacatcaccttccgcatcggcagctttggacctggagaggacctgctgtacctgcgggccagcgagatggcccgggcagagggcatccccaagatctacgtggccgccaacagcggggcccgcatcggcatggccgaggagatcaagcacatgtttcatgtggcctgggtggaccctgaggacccccacaagggcttcaagtacctgtacctgaccccccaggactacacccgcatcagcagcctgaacagcgtgcactgcaagcacatcgaggagggcggggagagccgctacatgatcacagacatcatcggcaaggatgatggcctgggcgtggagaacctgcggggcagcggcatgattgctggggagagcagcctggcctatgaggagatcgtgaccatcagcctggtgacctgccgggccatcggcattggagcctacctggtgcggctgggccagagggtcatccaggtggagaacagccacatcatcctgactggagccagcgccctgaacaaggtgctgggccgggaggtgtacaccagcaacaaccagctgggcggcgtgcagatcatgcactacaacggggtgagccacatcaccgtgcctgatgactttgaaggagtgtacaccatcctggagtggctgagctacatgcccaaggacaaccacagccctgtgcccatcatcacccccacagaccccatcgaccgggagattgagttcctgcccagccgggccccctatgacccccgctggatgctggccggccggccccaccccaccctgaagggcacctggcagagcggcttctttgaccacggcagcttcaaggagatcatggccccctgggcccagacagtggtgacaggccgggcccggctgggcggcatccctgtgggcgtgattgctgtggagaccaggacagtggaggtggccgtgcctgctgaccctgccaacctggacagcgaggccaagatcatccagcaggccggccaggtgtggttcccagacagcgcctacaagacagcccaggccgtgaaggacttcaaccgggagaagctgcccctgatgatctttgccaactggaggggcttcagcggcggcatgaaggacatgtatgaccaggtgctgaagtttggagcctacatcgtggatggcctgcggcagtacaagcagcccatcctgatctacatccccccctatgcagagctgcggggcggctcctgggtggtgattgatgccaccatcaaccccctgtgcatcgagatgtatgctgacaaggagagcagaggaggagtgctggagcctgagggcaccgtggagatcaagttcaggaagaaggacctgatcaagtccatgagaagaattgatcctgcctacaagaagctgatggagcagctgggggagccagacctgagtgacaaggacaggaaggacctggagggccgcctgaaggcccgggaggacctgctgctgcccatctaccaccaggtggccgtgcagtttgctgacttccatgacaccccaggccgcatgctggagaagggcgtcatcagtgacatcctggagtggaagacagcccggaccttcctgtactggaggctgcggcggctgctgctggaggaccaggtgaagcaggagatcctgcaggccagcggggagctgagccacgtgcacatccagagcatgctgcggcgctggtttgtggagacagaaggagctgtgaaggcctacctgtgggacaacaaccaggtggtggtgcagtggctggagcagcactggcaggccggagatggccccaggagcaccatccgggagaacatcacctacctgaagcatgattctgtgctgaagaccatccggggcctggtggaggagaaccctgaggtggccgtggactgtgtgatctacctgagccagcacatcagccctgctgagcgggcccaggtggtgcacctgctgagcaccatggacagccctgccagcacctag

SEQ ID NO: 142206 - DNA, 432 bp, Artificial Sequence
  Description of Artificial Sequence: Synthetic coding sequence
atgacagacagcaagcccatcaccaagagcaagtctgaggccaacctgatccccagccaggagcccttccctgccagtgacaacagcggggagaccccccagagaaatggagagggccacaccctgcccaagacccccagccaggccgagcccgccagccacaagggccccaaggatgctggaagaagaagaaacagcctgccccccagccaccagaagccacccaggaaccccctgagcagcagtgatgctgcccccagccctgagctgcaggccaatggaacaggcacccagggcctggaggccacagacaccaacggcctgagcagcagcgcccggccccagggccagcaggccggcagccccagcaaagaagacaagaagcaggccaacatcaagaggcagctgatgaccaacttcatcctgggctag

SEQ ID NO: 142207 - DNA, 2577 bp, Artificial Sequence
  Description of Artificial Sequence: Synthetic coding sequence
atgacagtgcccatcagcatcaccaacccagacctgctgcggcacagcacagagctgttcatggattctggcttcagccccctgtgccagaggatgggcgccatggtggccttcagaagatttgaggacttcaccaggaactttgatgaagtcatcagctgctttgccaacgtgcccaaggacacccccctcttcagcgaggcccggaccagcctgtacagtgaagatgactgcaagagcctgcgggaggagcccatccacatcctgaatgtgtccatccagtgtgccgaccacctggaggatgaggccctggtgcccatcctgcggacctttgtgcagagcaagaagaacatcctggtggactatggcctgcggcgcatcaccttcctgattgcccaggagaaggagttccccaagttcttcaccttccgggccagagatgaatttgctgaagatcgcatctaccgccacctggagcccgccctggccttccagctggagctgaacaggatgaggaactttgacctgacagctgtgccctgtgccaaccacaagatgcacctgtacctgggcgccgccaaggtgaaggagggcgtggaggtgacagaccaccgcttcttcatccgggccatcatccgccacagcgacctgatcaccaaggaggccagctttgagtacctgcagaatgaaggagagcggctgctgctggaggccatggatgagctggaggtggccttcaacaacacctctgtgaggacagactgcaaccacatcttcctgaactttgtgcccaccgtcatcatggaccccttcaagattgaggagagcgtgcgctacatggtgatgagatatggcagccggctgtggaagctgcgggtgctgcaggccgaggtgaagatcaacatccggcagaccaccactggatctgctgtgcccatccgcctcttcatcaccaatgaaagtggctactacctggacatcagcctgtacaaggaggtgacagacagccgcagcggcaacatcatgttccacagctttggaaacaagcagggcccccagcacggcatgctgatcaacaccccctacgtgaccaaggacctgctgcaggccaagcgcttccaggcccagaccctgggcaccacctacatctatgacttccctgagatgttccggcaggccctcttcaagctgtggggcagcccagacaagtaccccaaggacatcctgacctacacagagctggtgctggacagccagggccagctggtggagatgaaccggctgcccggcggcaatgaggtgggcatggtggccttcaagatgaggttcaagacccaggagtacccagagggcagagatgtgattgtgattggaaatgacatcaccttcagaattggcagctttggacctggagaggacctgctgtacctgcgggccagcgagatggcccgggcagagggcatccccaagatctacgtggccgccaacagcggggccagaattggcatggccgaggagatcaagcacatgttccacgtggcctgggtggaccctgaggacccccacaagggcttcaagtacctgtacctgaccccccaggactacacccgcatcagcagcctgaacagcgtgcactgcaagcacatcgaggagggcggggagagccgctacatgatcacagacatcatcggcaaggatgatggcctgggcgtggagaacctgcggggcagcggcatgattgctggggagagcagcctggcctatgaggagatcgtgaccatcagcctggtgacctgccgggccatcggcatcggggcctacctggtgcggctgggccagagggtcatccaggtggagaacagccacatcatcctgaccggggccagcgccctgaacaaggtgctgggccgggaggtgtacaccagcaacaaccagctgggcggcgtgcagatcatgcactacaatggagtgagccacatcaccgtgcctgatgactttgagggcgtgtacaccatcctggagtggctgagctacatgcccaaggacaaccacagccctgtgcccatcatcacccccacagaccccatcgaccgggagattgagttcctgcccagccgggccccctatgacccccgctggatgctggccggccggccccaccccaccctgaagggcacctggcagagcggcttctttgaccacggcagcttcaaggagatcatggccccctgggcccagacagtggtgacaggccgggcccggctgggcggcatccctgtgggcgtgattgctgtggagaccaggacagtggaggtggccgtgcctgctgaccctgccaacctggacagcgaggccaagatcatccagcaggccggccaggtgtggttcccagattctgcctacaagacagcccaggccgtgaaggacttcaaccgggagaagctgcccctgatgatctttgccaactggaggggcttcagcggcggcatgaagggctgcctgggcacctggagagatgtgtcctggtggaagatccgggccatgctgcccatgcacatcggggagggctctgtgtag

SEQ ID NO: 142208 - DNA, 1038 bp, Artificial Sequence
  Description of Artificial Sequence: Synthetic coding sequence
atgggcagcagcgaggaccaggcctaccgcctgctgaatgactatgccaacggcttcatggtgtcccaggtgctgtttgctgcctgtgagctgggcgtgtttgacctgctggccgaggcccctggccccctggatgtggccgctgtggccgccggcgtgcgggccagcgcccacggcacagagctgctgctggacatctgtgtgtccctgaagctgctgaaggtggagacccggggcggcaaggccttctacagaaacacagagctgagcagtgactacctgaccaccgtgagccccaccagccagtgcagcatgctgaagtacatgggccgcaccagctaccgctgctggggccacctggctgatgctgtgcgggagggcaggaaccagtacctggagacctttggagtgcctgctgaggagctgttcaccgccatctacagaagtgaaggagagcggctgcagttcatgcaggccctgcaggaggtgtggagcgtgaatggccgctctgtgctgacagcctttgacctgagcgtcttccccctgatgtgtgacctgggcggcggggccggggccctggccaaggagtgcatgagcctgtacccaggctgcaagatcaccgtgtttgacatccctgaggtggtgtggacagccaagcagcacttctccttccaggaggaggagcagattgacttccaggagggggacttcttcaaggaccccctgcctgaggccgacctgtacatcctggcccgggtgctgcatgactgggcagatggcaagtgcagccacctgctggagcgcatctaccacacctgcaagccaggcggcggcatcctggtgattgagagcctgctggatgaggaccggcggggccccctgctgacccagctgtacagcctgaacatgctggtgcagacagagggccaggagaggacccccacccactaccacatgctgctgagcagcgctggcttccgggacttccagttcaagaagacaggagccatctatgatgccatcctggccaggaagtag

SEQ ID NO: 142209 - DNA, 897 bp, Artificial Sequence
  Description of Artificial Sequence: Synthetic coding sequence
atgggcagcagcgaggaccaggcctaccgcctgctgaatgactatgccaacggcttcatggtgtcccaggtgctgtttgctgcctgtgagctgggcgtgtttgacctgctggccgaggcccctggccccctggatgtggccgctgtggccgccggcgtgcgggccagcgcccacggcacagagctgctgctggacatctgtgtgtccctgaagctgctgaaggtggagacccggggcggcaaggccttctacagaaacacagagctgagcagtgactacctgaccaccgtgagccccaccagccagtgcagcatgctgaagtacatgggccgcaccagctaccgctgctggggccacctggctgatgctgtgcgggagggcaggaaccagtacctggagacctttggagtgcctgctgaggagctgttcaccgccatctacagaagtgaaggagagcggctgcagttcatgcaggccctgcaggaggtgtggagcgtgaatggccgctctgtgctgacagcctttgacctgagcgtcttccccctgatgtgtgacctgggcggggacttcttcaaggaccccctgcctgaggccgacctgtacatcctggcccgggtgctgcatgactgggcagatggcaagtgcagccacctgctggagcgcatctaccacacctgcaagccaggcggcggcatcctggtgattgagagcctgctggatgaagatagaagaggccccctgctgacccagctgtacagcctgaacatgctggtgcagacagagggccaggagaggacccccacccactaccacatgctgctgagcagcgctggcttccgggacttccagttcaagaagacaggagccatctatgatgccatcctggccaggaagtag

SEQ ID NO: 142210 - DNA, 1122 bp, Artificial Sequence
  Description of Artificial Sequence: Synthetic coding sequence
atgggcagcagcgaggaccaggcctaccgcctgctgaatgactatgccaacggcttcatggtgtcccaggtgctgtttgctgcctgtgagctgggcgtgtttgacctgctggccgaggcccctggccccctggatgtggccgctgtggccgccggcgtgcgggccagcgcccacggcacagagctgctgctggacatctgtgtgtccctgaagctgctgaaggtggagacccggggcggcaaggccttctacagaaacacagagctgagcagtgactacctgaccaccgtgagccccaccagccagtgcagcatgctgaagtacatgggccgcaccagctaccgctgctggggccacctggctgatgctgtgcgggagggcaggaaccagtacctggagacctttggagtgcctgctgaggagctgttcaccgccatctacagaagtgaaggagagcggctgcagttcatgcaggccctgcaggaggtgtggagcgtgaatggccgctctgtgctgacagcctttgacctgagcgtcttccccctgatgtgtgacctgggcggcacctggatcaagctggagaccatcatcctgagcaagctgagccagggccagaagaccaagcacagggtcttcagcctgattggaggagctggggccctggccaaggagtgcatgagcctgtacccaggctgcaagatcaccgtgtttgacatccctgaggtggtgtggacagccaagcagcacttctccttccaggaggaggagcagattgacttccaggagggggacttcttcaaggaccccctgcctgaggccgacctgtacatcctggcccgggtgctgcatgactgggcagatggcaagtgcagccacctgctggagcgcatctaccacacctgcaagccaggcggcggcatcctggtgattgagagcctgctggatgaggaccggcggggccccctgctgacccagctgtacagcctgaacatgctggtgcagacagagggccaggagaggacccccacccactaccacatgctgctgagcagcgctggcttccgggacttccagttcaagaagacaggagccatctatgatgccatcctggccaggaagtag

SEQ ID NO: 142211 - DNA, 375 bp, Artificial Sequence
  Description of Artificial Sequence: Synthetic coding sequence
gactgccgcctgacctctgtgtgcctgccctgtgtgcctggggacttcttcaaggaccccctgcctgaggccgacctgtacatcctggcccgggtgctgcatgactgggcagatggcaagtgcagccacctgctggagcgcatctaccacacctgcaagccaggcggcggcatcctggtgattgagagcctgctggatgaagatagaagaggccccctgctgacccagctgtacagcctgaacatgctggtgcagacagagggccaggagaggacccccacccactaccacatgctgctgagcagcgctggcttccgggacttccagttcaagaagacaggagccatctatgatgccatcctggccaggaagtag

SEQ ID NO: 142212 - DNA, 711 bp, Artificial Sequence
  Description of Artificial Sequence: Synthetic coding sequence
atggagagcagcgccaagatggagagcggcggggccggccagcagccccagccccagccccagcagcccttcctgcccccagctgcctgcttctttgccacagctgctgctgctgctgctgctgctgctgctgctgctgcccagagcgcccagcagcagcagcagcagcagcagcagcagcagcaggccccccagctgcggcctgctgctgatggccagcccagcggcggcggccacaagagcgcccccaagcaggtgaagaggcagaggagcagcagccctgagctgatgcgctgcaagaggcggctgaacttcagcggcttcggctacagcctgccccagcagcagcctgctgctgtggccaggagaaatgaaagagagaggaacagagtgaagctggtgaacctgggctttgccaccctgcgggagcacgtgcccaatggagctgccaacaagaagatgagcaaggtggagaccctgcggtctgctgtggagtacatccgggccctgcagcagctgctggatgaacatgatgctgtgtctgctgccttccaggccggcgtgctgagccccaccatcagccccaactacagcaatgacctgaacagcatggccggcagccctgtgtcctcctacagcagtgatgagggcagctatgaccccctgagccctgaggagcaggagctgctggacttcaccaactggttctag

SEQ ID NO: 142213 - DNA, 582 bp, Artificial Sequence
  Description of Artificial Sequence: Synthetic coding sequence
atggatggcggcaccctgcccaggtctgcccccccagcccctcctgtgcctgtgggctgtgccgcccggcggcggcctgccagccctgagctgctgcgctgcagcagaagaagaagacctgccacagctgagactggaggaggagctgctgctgtggccaggagaaatgaaagagagaggaacagagtgaagctggtgaacctgggcttccaggccctgcggcagcacgtgccccatggaggagccagcaagaagctgagcaaggtggagaccctgcggtctgctgtggagtacatccgggccctgcagaggctgctggccgagcatgatgctgtgagaaatgccctggccggcggcctgcggccccaggccgtgcggcccagcgccccccggggccccccaggcaccacccctgtggccgccagccccagccgggccagcagcagccctggccggggcggcagcagcgagcccggcagccccaggtctgcctacagcagtgatgacagcggctgtgagggcgccctgagccctgctgagcgggagctgctggacttcagctcctggctgggcggctactag

SEQ ID NO: 142214 - DNA, 1542 bp, Artificial Sequence
  Description of Artificial Sequence: Synthetic coding sequence
atgtgcagcctgggcctcttccccccacctccaccccggggccaggtgaccctgtatgagcacaacaatgagctggtgacaggcagcagctatgagagccccccaccagacttccggggccagtggatcaacctgcctgtgctgcagctgaccaaggaccccctgaagaccccaggccgcctggaccacggcaccaggacagccttcatccaccaccgggagcaggtgtggaagcgctgcatcaacatctggagagatgtgggcctgtttggagtgctgaatgagatcgccaacagcgaggaggaggtgtttgagtgggtgaagacagccagcggctgggccctggccctgtgccgctgggccagcagcctgcacggcagcctcttcccccacctgagcctgcggtctgaggacctgattgctgagtttgcccaggtgaccaactgcaccatcgtgcccagcctgaagcaccggctgcagagaaatgtggccagcctggcctggaagcccctgagcgcctctgtgctggccgtggcctgccagagctgcatcctgatctggaccctggaccccaccagcctgagcacccggcccagcagcggctgtgcccaggtgctgagccaccctggccacacccctgtgaccagcctggcctgggcccccagcggcggccgcctgctgagcgccagccctgtggatgctgccatccgggtgtgggatgtgtccacagagacctgtgtgcccctgccctggttccggggcggcggcgtgaccaacctgctgtggagcccagatggcagcaagatcctggccaccaccccatctgctgtgttccgggtgtgggaggcccagatgtggacctgtgagcgctggcccaccctgagcggccgctgccagacaggctgctggagcccagatggcagccggctgctcttcaccgtgctgggggagcccctcatctacagcctgtccttccctgagcgctgtggggagggcaagggctgtgtgggcggggccaagagcgccaccatcgtggccgacctgtctgagaccaccatccagaccccagatggagaggagcggctgggcggggaggcccacagcatggtgtgggaccccagcggggagcggctggccgtgctgatgaagggcaagccccgggtgcaggacggcaagcctgtgatcctgctcttccgcaccaggaacagccctgtgtttgagctgctgccctgtggcatcatccagggcgagcccggggcccagccccagctgatcaccttccaccccagcttcaacaagggggccctgctgtctgtgggctggagcacaggccgcatcgcccacatccccctgtactttgtgaatgcccagttcccccgcttcagccctgtgctgggccgggcccaggagcccccagctgggggcggcggcagcatccatgacctgcccctcttcacagagaccagccccaccagcgccccctgggaccccctgcccggccccccacctgtgctgccccacagcccccacagccacctgtag

SEQ ID NO: 142215 - DNA, 1683 bp, Artificial Sequence
  Description of Artificial Sequence: Synthetic coding sequence
atgccccagaccaggagccaggcccaggccaccatctccttccccaagaggaagctgagccgggccctgaacaaggccaagaacagcagtgatgccaagctggagcccaccaacgtgcagacagtgacctgcagcccccgggtgaaggccctgcccctgagccccaggaagaggctgggagatgacaacctgtgcaacaccccccacctgcccccctgcagcccccccaagcagggcaagaaggaaaatggaccaccccacagccacaccctgaagggccggcggctggtgtttgacaaccagctgaccatcaagagccccagcaagcgggagctggccaaggtgcaccagaacaagatcctgagctctgtgaggaagagccaggagatcaccaccaacagcgagcagcgctgccccctgaagaaggagagcgcctgtgtgcggctcttcaagcaggagggcacctgctaccagcaggccaagctggtgctgaacacagctgtgcctgaccggctgcctgcccgggagcgggagatggatgtgatccggaacttcctgcgggagcacatctgtgggaagaaggccggcagcctgtacctgagcggggcccctggcaccgggaagacagcctgcctgagccgcatcctgcaggacctgaagaaggagctgaagggcttcaagaccatcatgctgaactgcatgagcctgaggacagcccaggccgtgtttcctgccatcgcccaggagatctgccaggaggaggtgtccaggcctgctgggaaggacatgatgaggaagctggagaagcacatgacagctgagaagggccccatgattgtgctggtgctggatgagatggaccagctggacagcaagggccaggatgtgctgtacaccctgtttgagtggccctggctgagcaacagccacctggtgctgattggcatcgccaacaccctggacctgacagaccgcatcctgccccggctgcaggcccgggagaagtgcaagccccagctgctgaacttccccccctacaccaggaaccagatcgtgaccatcctgcaggaccggctgaaccaggtgtcccgggaccaggtgctggacaatgctgctgtgcagttctgtgccaggaaggtgtctgctgtgtctggagatgtgaggaaggccctggatgtgtgcagaagagccatcgagatcgtggagagtgatgtgaagagccagaccatcctgaagcccctgtctgagtgcaagagccccagcgagcccctcatccccaagagggtgggcctcatccacatcagccaggtgatcagcgaggtggatggcaacaggatgaccctgagccaggagggcgcccaggacagcttccccctgcagcagaagatcctggtgtgcagcctgatgctgctgatccggcagctgaagatcaaggaggtgaccctgggcaagctgtatgaggcctacagcaaggtgtgcaggaagcagcaggtggccgctgtggaccagagtgaatgtctgagcctgagcggcctgctggaggcccggggcatcctgggcctgaagaggaacaaggagacccggctgaccaaggtgttcttcaagattgaggagaaggagattgaacatgccctgaaggacaaggccctgattggcaacatcctggccaccggcctgccctag

SEQ ID NO: 142216 - DNA, 339 bp, Artificial Sequence
  Description of Artificial Sequence: Synthetic coding sequence
atggccgagcaggccaccaagtctgtgctgtttgtgtgcctgggcaacatctgccgcagccccatcgccgaggccgtgttcaggaagctggtgacagaccagaacatcagcgagaactggagggtggacagcgctgccaccagcggctatgagatcggcaaccccccagactaccggggccagagctgcatgaagagacatggcatccccatgagccacgtggcccggcaggtgcccagcctggacctgaagctgtgtgtgctgtgcttcagcggcagcctgacagctgtgctcttcctgaccggcacctgggccggcccccagacccaggagctgtag

SEQ ID NO: 142217 - DNA, 477 bp, Artificial Sequence
  Description of Artificial Sequence: Synthetic coding sequence
atggccgagcaggccaccaagtctgtgctgtttgtgtgcctgggcaacatctgccgcagccccatcgccgaggccgtgttcaggaagctggtgacagaccagaacatcagcgagaactggagggtggacagcgctgccaccagcggctatgagatcggcaaccccccagactaccggggccagagctgcatgaagagacatggcatccccatgagccacgtggcccggcagatcaccaaggaggactttgccacctttgactacatcctgtgcatggatgagagcaacctgcgggacctgaacaggaagagcaaccaggtgaagacctgcaaggccaagattgagctgctgggcagctatgacccccagaagcagctgatcatcgaggacccctactatggaaatgacagcgactttgaaacagtgtaccagcagtgtgtgcgctgctgccgggccttcctggagaaggcccactag

SEQ ID NO: 142218 - DNA, 477 bp, Artificial Sequence
  Description of Artificial Sequence: Synthetic coding sequence
atggccgagcaggccaccaagtctgtgctgtttgtgtgcctgggcaacatctgccgcagccccatcgccgaggccgtgttcaggaagctggtgacagaccagaacatcagcgagaactgggtgattgacagcggggctgtgtctgactggaatgtgggccgcagcccagaccccagggctgtgtcctgcctgagaaatcatggcatccacacagcccacaaggcccggcagatcaccaaggaggactttgccacctttgactacatcctgtgcatggatgagagcaacctgcgggacctgaacaggaagagcaaccaggtgaagacctgcaaggccaagattgagctgctgggcagctatgacccccagaagcagctgatcatcgaggacccctactatggaaatgacagcgactttgaaacagtgtaccagcagtgtgtgcgctgctgccgggccttcctggagaaggcccactag

SEQ ID NO: 142219 - DNA, 219 bp, Artificial Sequence
  Description of Artificial Sequence: Synthetic coding sequence
atggccgagcaggccaccaagtctgtgctgtttgtgtgcctgggcaacatctgccgcagccccatcgccgaggccgtgttcaggaagctggtgacagaccagaacatcagcgagaactggagggtggacagcgctgccaccagcggcggcagcctgacagctgtgctcttcctgaccggcacctgggccggcccccagaccaagagctgtgccgcctag

SEQ ID NO: 142220 - DNA, 483 bp, Artificial Sequence
  Description of Artificial Sequence: Synthetic coding sequence
atggccggcaagaggagcggctggagcagagctgccctgctgcagctgctgctgggcgtgaacctggtggtgatgccacccacccgggcccggagcctgcgctttgtgaccctgctgtaccgccacggggacaggagccctgtgaagacctaccccaaggacccctaccaggaggaggagtggccccagggcttcggccagctgaccaaggagggcatgctgcagcactgggagctgggccaggccctgcggcagcgctaccacggcttcctgaacaccagctaccaccggcaggaggtgtatgtgcgcagcacagactttgacaggaccctgatgtctgctgaggccaacctggccggcctcttccccccaaatggcatgcagcgcttcaaccccaacatctcctggcagcccatccctgtgcacacagtgcccatcacagaggacagagtgcgggtggccagccccagcctgggctggtag

SEQ ID NO: 142221 - DNA, 1272 bp, Artificial Sequence
  Description of Artificial Sequence: Synthetic coding sequence
atggccggcaagaggagcggctggagcagagctgccctgctgcagctgctgctgggcgtgaacctggtggtgatgccacccacccgggcccggagcctgcgctttgtgaccctgctgtaccgccacggggacaggagccctgtgaagacctaccccaaggacccctaccaggaggaggagtggccccagggcttcggccagctgaccaaggagggcatgctgcagcactgggagctgggccaggccctgcggcagcgctaccacggcttcctgaacaccagctaccaccggcaggaggtgtatgtgcgcagcacagactttgacaggaccctgatgtctgctgaggccaacctggccggcctcttccccccaaatggcatgcagcgcttcaaccccaacatctcctggcagcccatccctgtgcacacagtgcccatcacagaggaccggctgctgaagttccccctgggcccctgccccaggtatgagcagctgcagaatgagacccggcagaccccagagtaccagaatgaaagcagcagaaatgcccagttcctggacatggtggccaatgaaacaggcctgacagacctgaccctggagaccgtgtggaatgtgtatgacaccctcttctgtgagcagacccacggcctgcggctgcccccctgggccagcccccagaccatgcagaggctgagccggctgaaggacttctccttccgcttcctgtttggcatctaccagcaggccgagaaggcccggctgcagggcggcgtgctgctggcccagatcaggaagaacctgaccctgatggccaccaccagccagctgcccaagctgctggtgtacagcgcccatgacaccaccctggtggccctgcagatggccctggatgtgtacaatggagagcaggccccctatgccagctgccacatctttgagctgtaccaggaggacagcggcaacttctctgtggagatgtacttcagaaatgaaagtgacaaggccccctggcccctgagcctgcccggctgcccccaccgctgccccctgcaggacttcctgcggctgacagagcctgtggtgcccaaggactggcagcaggagtgccagctggccagcggccctgctgacacagaggtgattgtggccctggccgtgtgtggcagcatcctcttcctgctgattgtgctgctgctgactgtgctcttcaggatgcaggcccagcccccaggctacagacatgtggctgatggagaggaccacgcctag

SEQ ID NO: 142222 - DNA, 1176 bp, Artificial Sequence
  Description of Artificial Sequence: Synthetic coding sequence
atggccggcaagaggagcggctggagcagagctgccctgctgcagctgctgctgggcgtgaacctggtggtgatgccacccacccgggcccggagcctgcgctttgtgaccctggagggcatgctgcagcactgggagctgggccaggccctgcggcagcgctaccacggcttcctgaacaccagctaccaccggcaggaggtgtatgtgcgcagcacagactttgacaggaccctgatgtctgctgaggccaacctggccggcctcttccccccaaatggcatgcagcgcttcaaccccaacatctcctggcagcccatccctgtgcacacagtgcccatcacagaggaccggctgctgaagttccccctgggcccctgccccaggtatgagcagctgcagaatgagacccggcagaccccagagtaccagaatgaaagcagcagaaatgcccagttcctggacatggtggccaatgaaacaggcctgacagacctgaccctggagaccgtgtggaatgtgtatgacaccctcttctgtgagcagacccacggcctgcggctgcccccctgggccagcccccagaccatgcagaggctgagccggctgaaggacttctccttccgcttcctgtttggcatctaccagcaggccgagaaggcccggctgcagggcggcgtgctgctggcccagatcaggaagaacctgaccctgatggccaccaccagccagctgcccaagctgctggtgtacagcgcccatgacaccaccctggtggccctgcagatggccctggatgtgtacaatggagagcaggccccctatgccagctgccacatctttgagctgtaccaggaggacagcggcaacttctctgtggagatgtacttcagaaatgaaagtgacaaggccccctggcccctgagcctgcccggctgcccccaccgctgccccctgcaggacttcctgcggctgacagagcctgtggtgcccaaggactggcagcaggagtgccagctggccagcggccctgctgacacagaggtgattgtggccctggccgtgtgtggcagcatcctcttcctgctgattgtgctgctgctgactgtgctcttcaggatgcaggcccagcccccaggctacagacatgtggctgatggagaggaccacgcctag

SEQ ID NO: 142223 - DNA, 711 bp, Artificial Sequence
  Description of Artificial Sequence: Synthetic coding sequence
atggtggccaatgagaccggcctgacagacctgaccctggagaccgtgtggaatgtgtatgacaccctcttctgtgagcagacccacggcctgcggctgcccccctgggccagcccccagaccatgcagaggctgagccggctgaaggacttctccttccgcttcctgtttggcatctaccagcaggccgagaaggcccggctgcagggcggcgtgctgctggcccagatcaggaagaacctgaccctgatggccaccaccagccagctgcccaagctgctggtgtacagcgcccatgacaccaccctggtggccctgcagatggccctggatgtgtacaacggggagcaggccccctatgccagctgccacatctttgagctgtaccaggaggacagcggcaacttctctgtggagatgtacttcagaaatgaaagtgacaaggccccctggcccctgagcctgcccggctgcccccaccgctgccccctgcaggacttcctgcggctgacagagcctgtggtgcccaaggactggcagcaggagtgccagctggccagcggccctgctgacacagaggtgattgtggccctggccgtgtgtggcagcatcctcttcctgctgattgtgctgctgctgactgtgctcttcaggatgcaggcccagcccccaggctaccgccacgtggctgatggagaagatcatgcctag

SEQ ID NO: 142224 - DNA, 1242 bp, Artificial Sequence
  Description of Artificial Sequence: Synthetic coding sequence
atggccggcaagaggagcggctggagcagagctgccctgctgcagctgctgctgggcgtgaacctggtggtgatgccacccacccgggcccggagcctgcgctttgtgaccctgctgtaccgccacggggacaggagccctgtgaagacctaccccaaggacccctaccaggaggaggagtggccccagggcttcggccagctgaccaaggagggcatgctgcagcgctaccacggcttcctgaacaccagctaccaccggcaggaggtgtatgtgcgcagcacagactttgacaggaccctgatgtctgctgaggccaacctggccggcctcttccccccaaatggcatgcagcgcttcaaccccaacatctcctggcagcccatccctgtgcacacagtgcccatcacagaggaccggctgctgaagttccccctgggcccctgccccaggtatgagcagctgcagaatgagacccggcagaccccagagtaccagaatgaaagcagcagaaatgcccagttcctggacatggtggccaatgaaacaggcctgacagacctgaccctggagaccgtgtggaatgtgtatgacaccctcttctgtgagcagacccacggcctgcggctgcccccctgggccagcccccagaccatgcagaggctgagccggctgaaggacttctccttccgcttcctgtttggcatctaccagcaggccgagaaggcccggctgcagggcggcgtgctgctggcccagatcaggaagaacctgaccctgatggccaccaccagccagctgcccaagctgctggtgtacagcgcccatgacaccaccctggtggccctgcagatggccctggatgtgtacaatggagagcaggccccctatgccagctgccacatctttgagctgtaccaggaggacagcggcaacttctctgtggagatgtacttcagaaatgaaagtgacaaggccccctggcccctgagcctgcccggctgcccccaccgctgccccctgcaggacttcctgcggctgacagagcctgtggtgcccaaggactggcagcaggagtgccagctggccagcggccctgctgacacagaggtgattgtggccctggccgtgtgtggcagcatcctcttcctgctgattgtgctgctgctgactgtgctcttcaggatgcaggcccagcccccaggctacagacatgtggctgatggagaggaccacgcctag

SEQ ID NO: 142225 - DNA, 978 bp, Artificial Sequence
  Description of Artificial Sequence: Synthetic coding sequence
atggacatgtggacagccctgctgatcctgcaggccctgctgctgcccagcctggctgatggagccaccccagccctgcgctttgtggccgtgggggactggggcggcgtgcccaatgcccccttccacacagcccgggagatggccaatgccaaggagatcgccaggacagtgcagatcctgggcgctgacttcatcctgagcctgggggacaacttctacttcaccggggtgcaggacatcaatgacaagcgcttccaggagacctttgaagatgtgttcagtgacaggagcctgaggaaggtgccctggtacgtgctggccggcaaccacgaccacctgggcaatgtgtctgcccagatcgcctacagcaagatcagcaagcgctggaacttccccagccccttctaccgcctgcacttcaagatcccccagaccaacgtgtctgtggccatcttcatgctggacacagtgaccctgtgtggcaacagtgatgacttcctgagccagcagcctgagcggcccagagatgtgaagctggcccggacccagctgtcctggctgaagaagcagctggccgccgccagagaagattatgtgctggtggccggccactaccctgtgtggagcattgctgagcacggccccacccactgcctggtgaagcagctgcggcccctgctggccacctatggagtgacagcctacctgtgtggccatgaccacaacctgcagtacctgcaggatgaaaatggagtgggctacgtgctgagcggggccggcaacttcatggaccccagcaagaggcaccagaggaaggtgcccaacggctacctgcgcttccactatggaacagaggacagcctgggcggctttgcctacgtggagatcagcagcaaggagatgacagtgacctacatcgaggccagcggcaagagcctcttcaagacccggctgccccggcgggcccggccctag

SEQ ID NO: 142226 - DNA, 1239 bp, Artificial Sequence
  Description of Artificial Sequence: Synthetic coding sequence
atgggcagcccctggaatggaagtgatggccctgagggcgcccgggagcccccctggccagccctgcccccctgtgatgagcggcgctgcagccccttccccctgggcgccctggtgcctgtgacagctgtgtgcctgtgcctgtttgtggtgggcgtgtctggaaatgtggtgacagtgatgctgattggccgctacagagacatgaggaccaccaccaacctgtacctgggctccatggctgtgtctgacctgctgatcctgctgggcctgccctttgacctgtaccgcctgtggaggagccggccctgggtgtttggccccctgctgtgccgcctgagcctgtatgtgggggagggctgcacctacgccaccctgctgcacatgacagccctgtctgtggagcgctacctggccatctgccggcccctgcgggcccgggtgctggtgaccaggagaagagtgcgggccctgattgctgtgctgtgggccgtggccctgctgtctgctggccccttcctgttcctggtgggcgtggagcaggaccccggcatctctgtggtgcccggcctgaatggaacagccagaattgccagcagccccctggccagcagcccccccctgtggctgagccgggcccccccacccagcccccccagcggccctgagacagctgaggccgccgccctcttcagccgggagtgccggcccagccctgcccagctgggcgccctgcgggtgatgctgtgggtgaccacagcctacttcttcctgcccttcctgtgcctgagcatcctgtatggcctcatcggccgggagctgtggagcagccggcggcccctgcggggccctgctgccagcggccgggagcggggccaccggcagacagtgcgggtgctgctggtggtggtgctggccttcatcatctgctggctgcccttccacgtgggccgcatcatctacatcaacacagaggacagcaggatgatgtacttcagccagtacttcaacatcgtggccctgcagctgttctacctgagcgccagcatcaaccccatcctgtacaacctgatcagcaagaagtacagagctgctgccttcaagctgctgctggccaggaagagccggccccggggcttccacaggagccgggacacagctggggaggtggccggggacaccggcggggacacagtgggctacacagagaccagcgccaacgtgaagaccatgggctag

SEQ ID NO: 142227 - DNA, 978 bp, Artificial Sequence; identical to SEQ ID NO: 142225
  Description of Artificial Sequence: Synthetic coding sequence

SEQ ID NO: 142228 - DNA, 978 bp, Artificial Sequence; identical to SEQ ID NO: 142225
  Description of Artificial Sequence: Synthetic coding sequence

SEQ ID NO: 142229 - DNA, 1161 bp, Artificial Sequence
  Description of Artificial Sequence: Synthetic coding sequence
atgagagctgcccccctgctgctggcccgggccgccagcctgagcctgggcttcctgttcctgctcttcttctggctggacagatctgtgctggccaaggagctgaagtttgtgaccctggtgttccgccacggggacaggagccccatcgacaccttccccacagaccccatcaaggagagctcctggccccagggcttcggccagctgacccagctgggcatggagcagcactatgagctgggggagtacatcaggaagcgctacaggaagttcctgaatgaaagctacaagcatgagcaggtgtacatccgcagcacagatgtggacaggaccctgatgtctgccatgaccaacctggccgccctcttccccccagagggcgtgtccatctggaaccccatcctgctgtggcagcccatccctgtgcacacagtgcccctgtctgaggaccagctgctgtacctgcccttcaggaactgcccccgcttccaggagctggagagcgagaccctgaagtctgaggagttccagaagaggctgcacccctacaaggacttcatcgccaccctgggcaagctgagcggcctgcacggccaggacctgtttggcatctggagcaaggtgtatgaccccctgtactgtgagagcgtgcacaacttcaccctgcccagctgggccacagaggacaccatgaccaagctgcgggagctgtctgagctgagcctgctgagcctgtatggcatccacaagcagaaggagaagagccggctgcagggcggcgtgctggtgaatgagatcctgaaccacatgaagagggccacccagatccccagctacaagaagctgatcatgtacagcgcccatgacaccaccgtgtctggcctgcagatggccctggatgtgtacaacggcctgctgcccccctatgccagctgccacctgacagagctgtactttgagaagggggagtactttgtggagatgtactacagaaatgagacccagcacgagccctaccccctgatgctgcccggctgcagccccagctgccccctggagagatttgctgagctggtgggccctgtgatcccccaggactggagcacagagtgcatgaccaccaacagccaccagggcacagaggacagcacagactag

SEQ ID NO: 142230 - DNA, 1257 bp, Artificial Sequence
  Description of Artificial Sequence: Synthetic coding sequence
atgagagctgcccccctgctgctggcccgggccgccagcctgagcctgggcttcctgttcctgctcttcttctggctggacagatctgtgctggccaaggagctgaagtttgtgaccctggtgttccgccacggggacaggagccccatcgacaccttccccacagaccccatcaaggagagctcctggccccagggcttcggccagctgacccagctgggcatggagcagcactatgagctgggggagtacatcaggaagcgctacaggaagttcctgaatgaaagctacaagcatgagcaggtgtacatccgcagcacagatgtggacaggaccctgatgtctgccatgaccaacctggccgccctcttccccccagagggcgtgtccatctggaaccccatcctgctgtggcagcccatccctgtgcacacagtgcccctgtctgaggaccagctgctgtacctgcccttcaggaactgcccccgcttccaggagctggagagcgagaccctgaagtctgaggagttccagaagaggctgcacccctacaaggacttcatcgccaccctgggcaagctgagcggcctgcacggccaggacctgtttggcatctggagcaaggtgtatgaccccctgtactgtgagagcgtgcacaacttcaccctgcccagctgggccacagaggacaccatgaccaagctgcgggagctgtctgagctgagcctgctgagcctgtatggcatccacaagcagaaggagaagagccggctgcagggcggcgtgctggtgaatgagatcctgaaccacatgaagagggccacccagatccccagctacaagaagctgatcatgtacagcgcccatgacaccaccgtgtctggcctgcagatggccctggatgtgtacaacggcctgctgcccccctatgccagctgccacctgacagagctgtactttgagaagggggagtactttgtggagatgtactacagaaatgagacccagcacgagccctaccccctgatgctgcccggctgcagccccagctgccccctggagagatttgctgagctggtgggccctgtgatcccccaggactggagcacagagtgcatgaccaccaacagccaccaggtgctgaaggtgatctttgctgtggccttctgcctgatctctgctgtgctgatggtgctgctcttcatccacatcagaagaggcctgtgctggcagcgggagagctatggcaacatctag

SEQ ID NO: 142231 - DNA, 1281 bp, Artificial Sequence
  Description of Artificial Sequence: Synthetic coding sequence
atggccggcctgggcttctggggccaccctgctggccccctgctgctgctgctgctgctggtgctgcccccccgggccctgcctgagggccccctggtgtttgtggccctggtgttcagacatggagaccgggcccccctggccagctaccccatggacccccacaaggaggtggccagcaccctgtggccccggggcctgggccagctgaccacagagggcgtgcggcagcagctggagctgggccgcttcctgcggagccgctatgaggccttcctgagccctgagtaccgccgggaggaggtgtacatccgcagcacagactttgacaggaccctggagagcgcccaggccaacctggccggcctcttccctgaggccgcccctggcagccctgaggcccgctggaggcccatccctgtgcacacagtgcctgtggccgaggacaagctgctgcgcttccccatgaggagctgcccccgctaccacgagctgctgcgggaggccacagaggccgctgagtaccaggaggccctggagggctggacaggcttcctgagccggctggagaacttcaccggcctgagcctggtgggggagcccctgcggcgggcctggaaggtgctggacaccctgatgtgccagcaggcccacggcctgcccctgcctgcctgggccagcccagatgtgctgcggaccctggcccagatcagcgccctggacatcggggcccacgtgggcccccccagggctgctgagaaggcccagctgaccggcggcatcctgctgaatgccatcctggccaacttcagccgggtgcagaggctgggcctgcccctgaagatggtgatgtacagcgcccatgacagcaccctgctggccctgcagggcgccctgggcctgtatgatggccacaccccaccctatgctgcctgcctgggctttgagttcaggaagcacctgggcaacccagccaaggatggcggcaatgtgacagtgtccctcttctacagaaatgattctgcccacctgcccctgcccctgagcctgcccggctgcccagccccctgccccctgggccgcttctaccagctgacagccccagcccggcccccagcccacggcgtgtcctgccacggcccctatgaggccgccatccccccagcccctgtggtgcccctgctggccggggctgtggccgtgctggtggccctgagcctgggcctgggcctgctggcctggaggcctggctgcctgcgggccctgggcggccctgtgtag

SEQ ID NO: 142232 - DNA, 1002 bp, Artificial Sequence
  Description of Artificial Sequence: Synthetic coding sequence
atggccggcctgggcttctggggccaccctgctggccccctgctgctgctgctgctgctggtgctgcccccccgggccctgcctgagggccccctggtgtttgtggccctggtgttcagacatggagaccgggcccccctggccagctaccccatggacccccacaaggaggtggccagcaccctgtggccccggggcctgggccagctgaccacagagggcgtgcggcagcagctggagctgggccgcttcctgcggagccgctatgagggcttcctgagccggctggagaacttcaccggcctgagcctggtgggggagcccctgcggcgggcctggaaggtgctggacaccctgatgtgccagcaggcccacggcctgcccctgcctgcctgggccagcccagatgtgctgcggaccctggcccagatcagcgccctggacattggagcccacgtgggcccccccagggctgctgagaaggcccagctgactggaggcatcctgctgaatgccatcctggccaacttcagccgggtgcagaggctgggcctgcccctgaagatggtgatgtacagcgcccatgacagcaccctgctggccctgcagggcgccctgggcctgtatgatggccacaccccaccctatgctgcctgcctgggctttgagttcaggaagcacctgggcaacccagccaaggatggcggcaatgtgacagtgtccctcttctacagaaatgacagcgcccacctgcccctgcccctgagcctgcccggctgcccagccccctgccccctgggccgcttctaccagctgacagccccagcccggcccccagcccatggagtgtcctgccacggcccctatgaagctgccatccccccagcccctgtggtgcccctgctggccggggctgtggccgtgctggtggccctgagcctgggcctgggcctgctggcctggaggcctggctgcctgcgggccctgggcggccctgtgtag

SEQ ID NO: 142233 - DNA, 633 bp, Artificial Sequence
  Description of Artificial Sequence: Synthetic coding sequence
atggagatgggccgccgcatccacctggagctgaggaacagaacacccagtgatgtgaaggagctggtgctggacaacagccgcagcaatgaaggcaagctggagggcctgacagatgaatttgaggagctggagttcctgagcaccatcaacgtgggcctgaccagcatcgccaacctgcccaagctgaacaagctgaagaagctggagctgagtgacaacagagtgtctgggggcctggaggtgctggccgagaagtgccccaacctgacccacctgaacctgagcggcaacaagatcaaggacctgagcaccatcgagcccctgaagaagctggagaacctgaagagcctggacctcttcaactgtgaggtgaccaacctgaatgactacagagaaaatgtgttcaagctgctgccccagctgacctacctggatggctatgacagagatgacaaggaggccccagacagtgatgctgagggctacgtggagggcctggatgatgaggaggaggatgaagatgaggaggagtatgatgatgaggagggctacaatgatggagaggtggatgatgaggaggacaagaagaagaagaagaagaagaagaagaagaagaagaagaagaagtag

SEQ ID NO: 142234 - DNA, 750 bp, Artificial Sequence
  Description of Artificial Sequence: Synthetic coding sequence
atggagatgggccgccgcatccacctggagctgaggaacagaacacccagtgatgtgaaggagctggtgctggacaacagccgcagcaatgaaggcaagctggagggcctgacagatgaatttgaggagctggagttcctgagcaccatcaacgtgggcctgaccagcatcgccaacctgcccaagctgaacaagctgaagaagctggagctgagtgacaacagagtgtctgggggcctggaggtgctggccgagaagtgccccaacctgacccacctgaacctgagcggcaacaagatcaaggacctgagcaccatcgagcccctgaagaagctggagaacctgaagagcctggacctcttcaactgtgaggtgaccaacctgaatgactacagagaaaatgtgttcaagctgctgccccagctgacctacctggatggctatgacagagatgacaaggaggccccagacagtgatgctgagggctacgtggagggcctggatgatgaggaggaggatgaagatgaggaggagtatgatgaagatgcccaggtggtggaggatgaggaggatgaagatgaggaggaggagggggaggaggaggatgtgtctggagaggaggaggaggatgaggagggctacaatgatggagaggtggatgatgaagaagatgaggaggagctgggggaggaggagcggggccagaagaggaagcgggagccagaagatgaaggagaagatgatgactag

SEQ ID NO: 142235 - DNA, 396 bp, Artificial Sequence
  Description of Artificial Sequence: Synthetic coding sequence
atggagatgggcaagtggatccacctggagctgaggaacagaacacccagtgatgtgaaggagctgttcctggacaacagccagagcaatgaaggcaagctggagggcctgacagatgaatttgaggagctggagctgctgaacaccatcaacatcggcctgaccagcatcgccaacctgcccaagctgaacaagctgaagaagctggagctgagcagcaacagagcctctgtgggcctggaggtgctggccgagaagtgccccaacctgatccacctgaacctgagcggcaacaagatcaaggacctgagcaccatcgagcccctgaagaagctggagaacctggagagcctggacctcttcacctgtgaggtgaccaacctgaacaactactag

SEQ ID NO: 142236 - DNA, 807 bp, Artificial Sequence
  Description of Artificial Sequence: Synthetic coding sequence
atggagatgaagaagaagatcaacctggagctgaggaacagaagccctgaggaggtgacagagctggtgctggacaactgcctgtgtgtgaatggagaaattgagggcctgaatgacaccttcaaggagctggagttcctgtccatggccaacgtggagctgagcagcctggcccggctgcccagcctgaacaagctgaggaagctggagctgagtgacaacatcatcagcggcggcctggaggtgctggccgagaagtgccccaacctgacctacctgaacctgagcggcaacaagatcaaggacctgagcacagtggaggccctgcagaacctgaagaacctgaagagcctggacctcttcaactgtgagatcaccaacctggaggactaccgggagagcatctttgagctgctgcagcagatcacctacctggatggctttgaccaggaggacaatgaggccccagacagcgaggaggaggatgatgaagatggagatgaagatgatgaggaggaggaggagaatgaggccggccccccagagggctatgaggaggaggaggaggaggaggaggaggaggatgaagatgaagatgaagatgaagatgaagctggcagcgagctgggggagggggaggaggaggtgggcctgagctacctgatgaaggaggagatccaggatgaggaggatgatgatgattatgtggaggagggggaggaggaggaggaggaggaggagggcggcctgcggggggagaagaggaagagagatgctgaagatgatggagaggaggaggatgactag

SEQ ID NO: 142237 - DNA, 411 bp, Artificial Sequence
  Description of Artificial Sequence: Synthetic coding sequence
atggagatgaagaagaagatcaacctggagctgaggaacagaagccctgaggaggaggacaatgaggccccagacagcgaggaggaggatgatgaagatggagatgaagatgatgaggaggaggaggagaatgaggccggccccccagagggctatgaggaggaggaggaggaggaggaggaggaggatgaagatgaagatgaagatgaagatgaagctggcagcgagctgggggagggggaggaggaggtgggcctgagctacctgatgaaggaggagatccaggatgaggaggatgatgatgattatgtggaggagggggaggaggaggaggaggaggaggagggcggcctgcggggggagaagaggaagagagatgctgaagatgatggagaggaggaggatgactag

SEQ ID NO: 142238 - DNA, 663 bp, Artificial Sequence
  Description of Artificial Sequence: Synthetic coding sequence
atggccaacgtggagctgagcagcctggcccggctgcccagcctgaacaagctgaggaagctggagctgagtgacaacatcatcagcggcggcctggaggtgctggccgagaagtgccccaacctgacctacctgaacctgagcggcaacaagatcaaggacctgagcacagtggaggccctgcagaacctgaagaacctgaagagcctggacctcttcaactgtgagatcaccaacctggaggactaccgggagagcatctttgagctgctgcagcagatcacctacctggatggctttgaccaggaggacaatgaggccccagacagcgaggaggaggatgatgaagatggagatgaagatgatgaggaggaggaggagaatgaggccggccccccagagggctatgaggaggaggaggaggaggaggaggaggaggatgaagatgaagatgaagatgaagatgaagctggcagcgagctgggggagggggaggaggaggtgggcctgagctacctgatgaaggaggagatccaggatgaggaggatgatgatgattatgtggaggagggggaggaggaggaggaggaggaggagggcggcctgcggggggagaagaggaagagagatgctgaagatgatggagaggaggaggatgactag

SEQ ID NO: 142239 - DNA, 684 bp, Artificial Sequence
  Description of Artificial Sequence: Synthetic coding sequence
atggagatgaagaagaagatcaacctggagctgaggaacagaagccctgaggaggtgacagagctggtgctggacaactgcctgtgtgtgaatggagaaattgagggcctgaatgacaccttcaaggagctggagttcctgtccatggccaacgtggagctgagcagcctggcccggctgcccagcctgaacaagctgaggaagcagaacctgaagaacctgaagagcctggacctcttcaactgtgagatcaccaacctggaggactaccgggagagcatctttgagctgctgcagcagatcacctacctggatggctttgaccaggaggacaatgaggccccagattctgaggaggaggatgatgaagatggagatgaagatgatgaggaggaggaggagaatgaagctggccccccagagggctatgaggaggaggaggaggaggaggaggaggaggatgaagatgaagatgaagatgaagatgaggccggcagcgagctgggggagggggaggaggaggtgggcctgagctacctgatgaaggaggagatccaggatgaagaagatgatgatgattatgtggaggagggggaggaggaggaggaggaggaggagggcggcctgcggggggagaagaggaagagagatgctgaagatgatggagaggaggaggatgactag

SEQ ID NO: 142240 - DNA, 2076 bp, Artificial Sequence
  Description of Artificial Sequence: Synthetic coding sequence
atggatggctgcaagaaggagctgccccggctgcaggagcctgaggaggatgaggactgctacatcctgaatgtgcagagcagcagtgatgacaccagcggcagctctgtggcccggcgggcccccaagaggcaggccagctgcatcctgaatgtgcagagccgcagcggggacaccagcggcagctctgtggcccggcgggcccccaagaggcaggccagctctgtggtggtgattgacagcgacagtgatgaggagtgccacacccatgaggagaagaaggccaagctgctggagatcaacagtgatgatgagagccctgagtgctgccacgtgaagccagccatccaggagccccccatcgtcatcagtgatgatgacaatgatgatgacaatggaaatgacctggaggtgcctgatgacaacagtgatgacagcgaggccccagatgacaacagtgatgacagcgaggccccagatgacaacagtgatgacagcgaggccccagatgacaacagtgatgacagcgaggccccagatgacaacagtgatgacagtgatgtgcctgatgacaacagtgatgacagcagtgatgacaacagtgatgacagcagtgatgacaacagtgatgacagtgatgtgcctgatgacaagagtgatgacagtgatgtgcctgatgacagcagtgatgacagtgatgtgcctgatgacagcagtgatgacagcgaggccccagatgacagcagtgatgacagcgaggccccagatgacagcagtgatgacagcgaggccccagatgacagcagtgatgacagcgaggccccagatgacagcagtgatgacagcgaggccagtgatgacagcagtgatgacagcgaggccagtgatgacagcagtgatgacagcgaggccccagatgacaagagtgatgacagtgatgtgcctgaggacaagagtgatgacagtgatgtgcctgatgacaacagtgatgacctggaggtgcctgtgcctgctgaggacctgtgcaatgaaggccagatcgccagtgatgaggaggagctggtggaggccgctgctgctgtgtcccagcacgacagcagtgatgatgctggggagcaggacctgggggagaacctgagcaagccacccagcgaccctgaggccaaccctgaggtgtctgagaggaagctgcccacagaggaggagcccgcccctgtggtggagcagagcggcaagaggaagagcaagaccaagaccatcgtggagccccccaggaagaggcagaccaagaccaagaacatcgtggagccccccaggaagaggcagaccaagaccaagaacatcgtggagcccctgaggaagaggaaggccaagaccaagaatgtgtctgtgaccccaggccacaagaagaggggccccagcaagaagaagccaggggccgccaaggtggagaagaggaagaccaggacccccaagtgcaaggtgcccggctgcttcctgcaggacctggagaagagcaagaagtacagcggcaagaacctgaagaggaacaaggatgagctggtgcagaggatctatgacctcttcaacagatctgtgtgtgacaagaagctgcctgagaagctgcgcatcggctggaacaacaagatggtgaagacagctggcctgtgcagcactggagagatgtggtaccccaagtggaggagatttgccaagatccagatcggcctgaaggtgtgtgacagcgctgaccgcatccgggacaccctcatccacgagatgtgccacgccgcctcctggctgattgatggcatccatgacagccatggagatgcctggaagtactatgccaggaagagcaaccgcatccaccctgagctgccccgggtgacccgctgccacaactacaagatcaactacaaggtgcactatgaatgtacaggctgcaagaccagaattggctgctacaccaagagcctggacaccagccgcttcatctgtgccaagtgcaagggcagcctggtgatggtgcccctgacccagaaggatggcaccagaattgtgccccacgtgtag

SEQ ID NO: 142241 - DNA, 2076 bp, Artificial Sequence; identical to SEQ ID NO: 142240
  Description of Artificial Sequence: Synthetic coding sequence

SEQ ID NO: 142242 - DNA, 540 bp, Artificial Sequence
  Description of Artificial Sequence: Synthetic coding sequence
atggtgcaggcctggtacatggatgatgcccctggggacccccggcagccccacaggccagaccccggccggcctgtgggcctggagcagctgcggcggctgggcgtgctgtactggaagctggatgctgacaagtatgaaaatgaccctgagctggagaagatccggcgggagaggaactacagctggatggacatcatcaccatctgcaaggacaagctgcccaactatgaggagaagatcaagatgttttatgaggagcacctgcacctggatgatgagatccgctacatcctggatggcagcggctactttgatgtgcgggacaaggaggaccagtggatccgcatcttcatggagaagggggacatggtgaccctgcctgctggcatctaccaccgcttcaccgtggatgagaagaactacaccaaggccatgaggctgtttgtgggggagcctgtgtggacagcctacaacagacctgctgaccactttgaggcccggggccagtatgtgaagttcctggcccagacagcctag

SEQ ID NO: 142243 - DNA, 2670 bp, Artificial Sequence
  Description of Artificial Sequence: Synthetic coding sequence
atgagcaacccctttgcccacctggccgagcccctggaccctgtgcagcccgggaagaagttcttcaacctgaacaagctggaggacagccgctatggccgcctgcccttcagcatccgggtgctgctggaggccgccatccggaactgtgatgagttcctggtgaagaagcaggacatcgagaacatcctgcactggaatgtgacccagcacaagaacatcgaggtgcccttcaagccagcccgggtcatcctgcaggacttcaccggggtgcctgctgtggtggactttgctgccatgagagatgctgtgaagaagctgggcggggaccctgagaagatcaaccctgtgtgcccagctgacctggtgattgaccacagcatccaggtggacttcaacagaagagctgacagcctgcagaagaaccaggacctggagtttgaaagaaaccgggagagatttgagttcctgaagtggggcagccaggccttccacaacatgaggatcatccccccaggcagcggcatcatccaccaggtgaacctggagtacctggcccgggtggtgtttgaccaggacggctactactacccagacagcctggtgggcacagacagccacaccaccatgattgatggcctgggcatcctgggctggggcgtgggcggcatcgaggccgaggccgtgatgctgggccagcccatctccatggtgctgccccaggtgattggctaccgcctgatgggcaagccccaccccctggtgaccagcacagacatcgtgctgaccatcaccaagcacctgcggcaggtgggcgtggtgggcaagtttgtggagttctttggacctggggtggcccagctgagcattgctgaccgggccaccatcgccaacatgtgcccagaatatggagccacagctgccttcttccctgtggatgaggtgtccatcacctacctggtgcagacaggaagagatgaggagaagctgaagtacatcaagaagtacctgcaggccgtgggcatgttccgggacttcaatgaccccagccaggaccctgacttcacccaggtggtggagctggacctgaagacagtggtgccctgctgcagcggccccaagaggccccaggacaaggtggccgtgtctgacatgaagaaggactttgagagctgcctgggcgccaagcagggcttcaagggcttccaggtggcccctgagcaccacaatgaccacaagaccttcatctatgacaacacagagttcaccctggcccacggctctgtggtgattgctgccatcaccagctgcaccaacaccagcaaccccagcgtgatgctgggcgccggcctgctggccaagaaggctgtggatgctggcctgaatgtgatgccctacatcaagaccagcctgagccctggcagcggcgtggtgacctactacctgcaggagagcggcgtgatgccctacctgagccagctgggctttgatgtggtgggctacggctgcatgacctgcatcggcaacagcggccccctgcctgagcctgtggtggaggccatcacccagggcgacctggtggccgtgggcgtgctgagcggcaacagaaactttgagggccgggtgcaccccaacacccgggccaactacctggccagcccccccctggtgattgcctatgccatcgccggcaccatcagaattgactttgagaaggagcccctgggcgtgaatgccaagggccagcaggtgttcctgaaggacatctggcccaccagagatgagatccaggccgtggagcggcagtatgtgattcctggcatgttcaaggaggtgtaccagaagattgagaccgtgaatgaatcctggaatgccctggccacccccagcgacaagctgttcttctggaacagcaagagcacctacatcaagagcccccccttctttgagaacctgaccctggacctgcagccccccaagagcatcgtggatgcctacgtgctgctgaacctgggggacagcgtgaccacagaccacatcagccctgctggcaacatcgccaggaacagccctgctgcccgctacctgaccaacagaggcctgaccccccgggagttcaacagctatggcagcagaagaggaaatgatgctgtgatggcccggggcacctttgccaacatccggctgctgaaccgcttcctgaacaagcaggccccccagaccatccacctgcccagcggggagatcctggatgtgtttgatgctgctgagcgctaccagcaggccggcctgcccctgattgtgctggccggcaaggagtatggagctggcagcagccgggactgggccgccaagggccccttcctgctgggcatcaaggctgtgctggccgagagctatgaaagaatccacaggagcaacctggtgggcatgggcgtcatccccctggagtacctgcccggggagaatgctgatgccctgggcctgaccggccaggagcgctacaccatcatcatccctgagaacctgaagccccagatgaaggtgcaggtgaagctggacaccgggaagaccttccaggccgtgatgagatttgacacagatgtggagctgacctacttcctgaatggaggcatcctgaactacatgatcaggaagatggccaagtag

SEQ ID NO: 142244 - DNA, 1305 bp, Artificial Sequence
  Description of Artificial Sequence: Synthetic coding sequence
atgagcaacccctttgcccacctggccgagcccctggaccctgtgcagcccgggaagaagttcttcaacctgaacaagctggaggacagccgctatggccgcctgcccttcagcatccgggtgctgctggaggccgccatccggaactgtgatgagttcctggtgaagaagcaggacatcgagaacatcctgcactggaatgtgacccagcacaagaacatcgaggtgcccttcaagccagcccgggtcatcctgcaggacttcaccggggtgcctgctgtggtggactttgctgccatgagagatgctgtgaagaagctgggcggggaccctgagaagatcaaccctgtgtgcccagctgacctggtgattgaccacagcatccaggtggacttcaacagaagagctgacagcctgcagaagaaccaggacctggagtttgaaagaaaccgggagagatttgagttcctgaagtggggcagccaggccttccacaacatgaggatcatccccccaggcagcggcatcatccaccaggtgaacctggagtacctggcccgggtggtgtttgaccaggacggctactactacccagacagcctggtgggcacagacagccacaccaccatgattgatggcctgggcatcctgggctggggcgtgggcggcatcgaggccgaggccgtgatgctgggccagcccatctccatggtgctgccccaggtgattggctaccgcctgatgggcaagccccaccccctggtgaccagcacagacatcgtgctgaccatcaccaagcacctgcggcaggtgggcgtggtgggcaagtttgtggagttctttggacctggggtggcccagctgagcattgctgaccgggccaccatcgccaacatgtgcccagaatatggagccacagctgccttcttccctgtggatgaggtgtccatcacctacctggtgcagacaggaagagatgaggagaagctgaagtacatcaagaagtacctgcaggccgtgggcatgttccgggacttcaatgaccccagccaggaccctgacttcacccaggtggtggagctggacctgaagacagtggtgccctgctgcagcggccccaagaggccccaggacaaggtggccgtgtctgacatgaagaaggactttgagagctgcctgggcgccaagcagggcttcaagggcttccaggtggcccctgagcaccacaatgaccacaagaccttcatctatgacaacacagagttcaccctggcccacggctctgtggtgattgctgccctgtag

SEQ ID NO: 142245 - DNA, 2670 bp, Artificial Sequence; identical to SEQ ID NO: 142243
  Description of Artificial Sequence: Synthetic coding sequence

SEQ ID NO: 142246 - DNA, 2346 bp, Artificial Sequence
  Description of Artificial Sequence: Synthetic coding sequence
cagctggagcccaggtctgcccgggagcgggtgcccctgctgggcagcggcagccctgtggccggggccccaccctgcagcagaagaaacacctggcccagcgtcatcatgagcaacccctttgcccacctggccgagcccctggaccctgtgcagcccgggaagaagttcttcaacctgaacaagctggaggacagccgctatggccgcctgcccttcagcatccgggtgctgctggaggccgccatccggaactgtgatgagttcctggtgaagaagcaggacatcgagaacatcctgcactggaatgtgacccagcacaagaacatcgaggtgcccttcaagccagcccgggtcatcctgcaggacttcaccggggtgcctgctgtggtggactttgctgccatgagagatgctgtgaagaagctgggcggggaccctgagaagatcaaccctgtgtgcccagctgacctggtgattgaccacagcatccaggtggacttcaacagaagagctgacagcctgcagaagaaccaggacctggagtttgaaagaaaccgggagagatttgagttcctgaagtggggcagccaggccttccacaacatgaggatcatccccccaggcagcggcatcatccaccaggtgaacctggagtacctggcccgggtggtgtttgaccaggacggctactactacccagacagcctggtgggcacagacagccacaccaccatgattgatggcctgggcatcctgggctggggcgtgggcggcatcgaggccgaggccgtgatgctgggccagcccatctccatggtgctgccccaggtgattggctaccgcctgatgggcaagccccaccccctggtgaccagcacagacatcgtgctgaccatcaccaagcacctgcggcaggtgggcgtggtgggcaagtttgtggagttctttggacctggggtggcccagctgagcattgctgaccgggccaccatcgccaacatgtgcccagaatatggagccacagctgccttcttccctgtggatgaggtgtccatcacctacctggtgcagacaggaagagatgaggagaagctgaagtacatcaagaagtacctgcaggccgtgggcatgttccgggacttcaatgaccccagccaggaccctgacttcacccaggtggtggagctggacctgaagacagtggtgccctgctgcagcggccccaagaggccccaggacaaggtggccgtgtctgacatgaagaaggactttgagagctgcctgggcgccaagcagggcttcaagggcttccaggtggcccctgagcaccacaatgaccacaagaccttcatctatgacaacacagagttcaccctggcccacggctctgtggtgattgctgccatcaccagctgcaccaacaccagcaaccccagcgtgatgctgggcgccggcctgctggccaagaaggctgtggatgctggcctgaatgtgatgccctacatcaagaccagcctgagccctggcagcggcgtggtgacctactacctgcaggagagcggcgtgatgccctacctgagccagctgggctttgatgtggtgggctacggctgcatgacctgcatcggcaacagcggccccctgcctgagcctgtggtggaggccatcacccagggcgacctggtggccgtgggcgtgctgagcggcaacagaaactttgagggccgggtgcaccccaacacccgggccaactacctggccagcccccccctggtgattgcctatgccatcgccggcaccatcagaattgactttgagaaggagcccctgggcgtgaatgccaagggccagcaggtgttcctgaaggacatctggcccaccagagatgagatccaggccgtggagcggcagtatgtgattcctggcatgttcaaggaggtgtaccagaagattgagaccgtgaatgaatcctggaatgccctggccacccccagcgacaagctgttcttctggaacagcaagagcacctacatcaagagcccccccttctttgagaacctgaccctggacctgcagccccccaagagcatcgtggatgcctacgtgctgctgaacctgggggacagcgtgaccacagaccacatcagccctgctggcaacatcgccaggaacagccctgctgcccgctacctgaccaacagaggatttgagcggcagctgacccaggagaacacagacctgtgcctgagcccccccctgctgaccagcctgagcagccccctgaagctgtggggccagctgttctgccacggggagcagtgcctgggggacctggagaagtag

SEQ ID NO: 142247 - DNA, 2373 bp, Artificial Sequence
  Description of Artificial Sequence: Synthetic coding sequence
atgagagatgctgtgaagaagctgggcggggaccctgagaagatcaaccctgtgtgcccagctgacctggtgattgaccacagcatccaggtggacttcaacagaagagctgacagcctgcagaagaaccaggacctggagtttgagaggaaccgggagagatttgagttcctgaagtggggcagccaggccttccacaacatgaggatcatccccccaggcagcggcatcatccaccaggtgaacctggagtacctggcccgggtggtgtttgaccaggacggctactactacccagacagcctggtgggcacagacagccacaccaccatgattgatggcctgggcatcctgggctggggcgtgggcggcattgaagctgaggccgtgatgctgggccagcccatctccatggtgctgccccaggtgattggctaccgcctgatgggcaagccccaccccctggtgaccagcacagacatcgtgctgaccatcaccaagcacctgcggcaggtgggcgtggtgggcaagtttgtggagttcttcggccctggggtggcccagctgagcattgctgaccgggccaccatcgccaacatgtgcccagaatatggagccacagctgccttcttccctgtggatgaggtgtccatcacctacctggtgcagacaggaagagatgaggagaagctgaagtacatcaagaagtacctgcaggccgtgggcatgttccgggacttcaatgaccccagccaggaccctgacttcacccaggtggtggagctggacctgaagacagtggtgccctgctgcagcggccccaagaggccccaggacaaggtggccgtgtctgacatgaagaaggactttgagagctgcctgggcgccaagcagggcttcaagggcttccaggtggcccctgagcaccacaatgaccacaagaccttcatctatgacaacacagagttcaccctggcccacggctctgtggtgattgctgccatcaccagctgcaccaacaccagcaaccccagcgtgatgctgggcgccggcctgctggccaagaaggctgtggatgctggcctgaatgtgatgccctacatcaagaccagcctgagccctggcagcggcgtggtgacctactacctgcaggagagcggcgtgatgccctacctgagccagctgggctttgatgtggtgggctacggctgcatgacctgcatcggcaacagcggccccctgcctgagcctgtggtggaggccatcacccagggcgacctggtggccgtgggcgtgctgagcggcaacagaaactttgagggccgggtgcaccccaacacccgggccaactacctggccagcccccccctggtgattgcctatgccatcgccggcaccatcagaattgactttgagaaggagcccctgggcgtgaatgccaagggccagcaggtgttcctgaaggacatctggcccaccagagatgagatccaggccgtggagcggcagtatgtgattcctggcatgttcaaggaggtgtaccagaagattgaaacagtgaatgaatcctggaatgccctggccacccccagcgacaagctgttcttctggaacagcaagagcacctacatcaagagcccccccttctttgagaacctgaccctggacctgcagccccccaagagcatcgtggatgcctacgtgctgctgaacctgggggacagcgtgaccacagaccacatcagccctgctggcaacatcgccaggaacagccctgctgcccgctacctgaccaacagaggcctgaccccccgggagttcaacagctatggcagcagaagaggaaatgatgctgtgatggcccggggcacctttgccaacatccggctgctgaaccgcttcctgaacaagcaggccccccagaccatccacctgcccagcggggagatcctggatgtgtttgatgctgctgagcgctaccagcaggccggcctgcccctcatcgtgctggccggcaaggagtatggagctggcagcagccgggactgggccgccaagggccccttcctgctgggcatcaaggctgtgctggccgagagctatgagcgcatccacaggagcaacctggtgggcatgggcgtcatccccctggagtacctgcctggagaaaatgctgatgccctgggcctgaccggccaggagcgctacaccatcatcatccctgagaacctgaagccccagatgaaggtgcaggtgaagctggacaccgggaagaccttccaggccgtgatgagatttgacacagatgtggagctgacctacttcctgaatggaggcatcctgaactacatgatcaggaagatggccaagtag

SEQ ID NO: 142248 - DNA, 333 bp, Artificial Sequence
  Description of Artificial Sequence: Synthetic coding sequence
atggccaagcaccacccagacctgatcttctgcaggaagcaggccggcgtggccatcggccgcctgtgtgagaagtgtgatggaaaatgtgtgatctgtgacagctatgtgcggccctgcaccctggtgcgcatctgtgatgagtgcaactacggcagctaccagggccgctgcgtcatctgtggcggccctggggtgtctgatgcctactactgcaaggagtgcaccatccaggagaaggacagagatggctgccccaagatcgtgaacctgggcagcagcaagacagacctcttctatgaaaggaagaagtatggcttcaagaagaggtag

SEQ ID NO: 142249 - DNA, 2418 bp, Artificial Sequence
  Description of Artificial Sequence: Synthetic coding sequence
atggccccctacagcctgctggtgacccggctgcagaaggccctgggcgtgcggcagtaccacgtggcctctgtgctgtgccagagggccaaggtggccatgagccactttgagcccaatgagtacatccactatgacctgctggagaagaacatcaacatcgtgaggaagaggctgaaccggcccctgaccctgtctgagaagatcgtgtatggccacctggatgatcctgccagccaggagattgaaagaggcaagagctacctgcggctgcggccagacagagtggccatgcaggatgccacagcccagatggccatgctgcagttcatcagcagcggcctgagcaaggtggccgtgcccagcaccatccactgtgaccacctgattgaggcccaggtgggcggggagaaggacctgcggcgggccaaggacatcaaccaggaggtgtacaacttcctggccacagctggggccaagtatggagtgggcttctggaagccaggcagcggcatcatccaccagatcatcctggagaactatgcctacccaggagtgctgctgattggaacagacagccacaccccaaatggaggcggcctgggcggcatctgcatcggcgtgggcggcgcagatgctgtggatgtgatggccggcatcccctgggagctgaagtgccccaaggtgattggagtgaagctgaccggcagcctgagcggctggagcagccccaaggatgtgatcctgaaggtggccggcatcctgactgtgaagggcggcactggagccatcgtggagtaccacggccctggggtggacagcatcagctgcaccggggaggagggcggccaggccacctggcccctgccctgtgccggcccagatggcagccctgtgggcagccgcagcggcatggccaccatctgcaacatgggcgctgagattggagccaccaccagcgtcttcccctacaaccacaggatgaagaagtacctgagcaagacaggccgggaggacatcgccaacctggctgatgagttcaaggaccacctggtgcctgaccccggctgccactatgaccagctgattgagatcaacctgtctgagctgaagccccacatcaatggccccttcaccccagacctggcccaccctgtggccgaggtgggcaaggtggccgagaaggagggctggcccctggacatccgggtgggcctgattggcagctgcaccaacagcagctatgaggacatgggccgctctgctgctgtggccaagcaggccctggcccacggcctgaagtgcaagagccagttcaccatcaccccaggcagcgagcagatccgggccaccatcgagagagatggctacgcccagatcctgcgggacctgggcggcatcgtgctggccaatgcctgtggcccctgcatcggccagtgggacaggaaggacatcaagaagggggagaagaacaccatcgtgaccagctacaacagaaacttcaccggcagaaatgatgccaaccctgagacccacgcctttgtgaccagccctgagatcgtgacagccctggccatcgccggcaccctgaagttcaaccctgagacagactacctgaccggcacagatggcaagaagttccggctggaggccccagatgctgatgagctgcccaagggggagtttgaccccggccaggacacctaccagcacccccccaaggacagcagcggccagcacgtggatgtgagccccaccagccagaggctgcagctgctggagccctttgacaagtgggatggcaaggacctggaggacctgcagatcctgatcaaggtgaagggcaagtgcaccacagaccacatctctgctgctggcccctggctgaagttccggggccacctggacaacatcagcaacaacctgctgattggagccatcaacattgaaaatggcaaggccaacagcgtgagaaatgctgtgacccaggagtttggacctgtgcctgacacagcccgctactacaagaagcacggcatccgctgggtggtgattggagatgagaactacggggagggcagcagccgggagcacgccgccctggagcccaggcacctgggcggccgggccatcatcaccaagagctttgcccgcatccacgagaccaacctgaagaagcagggcctgctgcccctgacctttgctgaccctgctgactacaacaagatccaccctgtggacaagctgaccatccagggcctgaaggacttcaccccaggcaagcccctgaagtgcatcatcaagcaccccaacggcacccaggagaccatcctgctgaaccacaccttcaatgagacccagatcgagtggttccgggccggcagcgccctgaacaggatgaaggagctgcagcagtag

SEQ ID NO: 142250 - DNA, 1506 bp, Artificial Sequence
  Description of Artificial Sequence: Synthetic coding sequence
atggccaccatctgcaacatgggcgctgagattggagccaccaccagcgtcttcccctacaaccacaggatgaagaagtacctgagcaagacaggccgggaggacatcgccaacctggctgatgagttcaaggaccacctggtgcctgaccccggctgccactatgaccagctgattgagatcaacctgtctgagctgaagccccacatcaatggccccttcaccccagacctggcccaccctgtggccgaggtgggcaaggtggccgagaaggagggctggcccctggacatccgggtgggcctgattggcagctgcaccaacagcagctatgaggacatgggccgctctgctgctgtggccaagcaggccctggcccacggcctgaagtgcaagagccagttcaccatcaccccaggcagcgagcagatccgggccaccatcgagagagatggctacgcccagatcctgcgggacctgggcggcatcgtgctggccaatgcctgtggcccctgcatcggccagtgggacaggaaggacatcaagaagggggagaagaacaccatcgtgaccagctacaacagaaacttcaccggcagaaatgatgccaaccctgagacccacgcctttgtgaccagccctgagatcgtgacagccctggccatcgccggcaccctgaagttcaaccctgagacagactacctgaccggcacagatggcaagaagttccggctggaggccccagatgctgatgagctgcccaagggggagtttgaccccggccaggacacctaccagcacccccccaaggacagcagcggccagcacgtggatgtgagccccaccagccagaggctgcagctgctggagccctttgacaagtgggatggcaaggacctggaggacctgcagatcctgatcaaggtgaagggcaagtgcaccacagaccacatctctgctgctggcccctggctgaagttccggggccacctggacaacatcagcaacaacctgctgattggagccatcaacattgaaaatggcaaggccaacagcgtgagaaatgctgtgacccaggagtttggacctgtgcctgacacagcccgctactacaagaagcacggcatccgctgggtggtgattggagatgagaactacggggagggcagcagccgggagcacgccgccctggagcccaggcacctgggcggccgggccatcatcaccaagagctttgcccgcatccacgagaccaacctgaagaagcagggcctgctgcccctgacctttgctgaccctgctgactacaacaagatccaccctgtggacaagctgaccatccagggcctgaaggacttcaccccaggcaagcccctgaagtgcatcatcaagcaccccaacggcacccaggagaccatcctgctgaaccacaccttcaatgagacccagatcgagtggttccgggccggcagcgccctgaacaggatgaaggagctgcagcagtag

SEQ ID NO: 142251 - DNA, 2286 bp, Artificial Sequence
  Description of Artificial Sequence: Synthetic coding sequence
atggccccctacagcctgctggtgacccggctgcagaaggccctgggcgtgcggcagtaccacgtggcctctgtgctgtgccagagggccaaggtggccatgagccactttgagcccaatgagtacatccactatgacctgctggagaagaacatcaacatcgtgaggaagaggctgaaccggcccctgaccctgtctgagaagatcgtgtatggccacctggatgatcctgccagccaggagattgaaagaggcaagagctacctgcggctgcggccagacagagtggccatggtggccgtgcccagcaccatccactgtgaccacctgattgaggcccaggtgggcggggagaaggacctgcggcgggccaaggacatcaaccaggaggtgtacaacttcctggccacagctggggccaagtatggagtgggcttctggaagccaggcagcggcatcatccaccagatcatcctggagaactatgcctacccaggagtgctgctgattggaacagacagccacacccccaacggcggcggcctgggcggcatctgcattggagtgggcggcgcagatgctgtggatgtgatggccggcatcccctgggagctgaagtgccccaaggtgattggagtgaagctgaccggcagcctgagcggctggagcagccccaaggatgtgatcctgaaggtggccggcatcctgactgtgaagggcggcaccggggccatcgtggagtaccacggccctggggtggacagcatcagctgcaccggcatggccaccatctgcaacatgggcgctgagattggagccaccaccagcgtcttcccctacaaccacaggatgaagaagtacctgagcaagacaggccgggaggacatcgccaacctggctgatgagttcaaggaccacctggtgcctgaccccggctgccactatgaccagctgattgagatcaacctgtctgagctgaagccccacatcaatggccccttcaccccagacctggcccaccctgtggccgaggtgggcaaggtggccgagaaggagggctggcccctggacatccgggtgggcctgattggcagctgcaccaacagcagctatgaggacatgggccgctctgctgctgtggccaagcaggccctggcccacggcctgaagtgcaagagccagttcaccatcaccccaggcagcgagcagatccgggccaccatcgagagagatggctacgcccagatcctgcgggacctgggcggcatcgtgctggccaatgcctgtggcccctgcatcggccagtgggacaggaaggacatcaagaagggggagaagaacaccatcgtgaccagctacaacagaaacttcaccggcagaaatgatgccaaccctgagacccacgcctttgtgaccagccctgagatcgtgacagccctggccatcgccggcaccctgaagttcaaccctgagacagactacctgaccggcacagatggcaagaagttccggctggaggccccagatgctgatgagctgcccaagggggagtttgaccccggccaggacacctaccagcacccccccaaggacagcagcggccagcacgtggatgtgagccccaccagccagaggctgcagctgctggagccctttgacaagtgggatggcaaggacctggaggacctgcagatcctgatcaaggtgaagggcaagtgcaccacagaccacatctctgctgctggcccctggctgaagttccggggccacctggacaacatcagcaacaacctgctgattggagccatcaacattgaaaatggcaaggccaacagcgtgagaaatgctgtgacccaggagtttggacctgtgcctgacacagcccgctactacaagaagcacggcatccgctgggtggtgattggagatgagaactacggggagggcagcagccgggagcacgccgccctggagcccaggcacctgggcggccgggccatcatcaccaagagctttgcccgcatccacgagaccaacctgaagaagcagggcctgctgcccctgacctttgctgaccctgctgactacaacaagatccaccctgtggacaagctgaccatccagggcctgaaggacttcaccccaggcaagcccctgaagtgcatcatcaagcaccccaacggcacccaggagaccatcctgctgaaccacaccttcaatgagacccagatcgagtggttccgggccggcagcgccctgaacaggatgaaggagctgcagcagtag

SEQ ID NO: 142252 - DNA, 756 bp, Artificial Sequence
  Description of Artificial Sequence: Synthetic coding sequence
atggagctgagcgccatcggggagcaggtgtttgctgtggagagcatcaggaagaagagggtgaggaagggcaaggtggagtacctggtgaagtggaagggctggccacccaagtacagcacctgggagcctgaggagcacatcctggacccccggctggtgatggcctatgaggagaaggaggagcgggaccgggccagcggctacaggaagaggggccccaagcccaagaggctgctgctgcagaggctgtacagcatggacctgcggagcagccacaaggccaagggcaaggagaagctgtgcttcagcctgacctgccccctgggcagcggcagccctgagggcgtggtgaaggccggggcccctgagctggtggacaagggccccctggtgcccaccctgcccttccccctgaggaagcccaggaaggcccacaagtacctgcggctgagcaggaagaagtttcctccccggggccccaacctggagagccacagccacagaagagagctgttcctgcaggagcccccagccccagatgtgctgcaggccgccggggagtgggagcctgctgcccagcccccagaggaggaggctgatgctgacctggccgagggccccccaccctggaccccagccctgcccagcagcgaggtgacagtgacagacatcacagccaacagcatcaccgtgaccttccgggaggcccaggccgctgagggcttcttccgggacagaagtggcaagttctag

SEQ ID NO: 142253 - DNA, 633 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcctgctgccacagagcacgccgagggggagcacacagtgggggagcagcccagcggggagcagcccagcggggagcacctgagcggggagcagcccctgtctgagctggagagcggggagcagcccagtgatgagcagcccagcggggagcacggcagcggggagcagcccagcggggagcaggccagcggggagcagcccagcggggagcacgccagcggggagcaggccagcggggcccccatcagcagcaccagcacaggcaccatcctgaactgctacacctgtgcctacatgaatgaccagggcaagtgcctgcggggggagggcacctgcatcacccagaacagccagcagtgcatgctgaagaagatctttgagggcggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142254 - DNA, 741 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagttcttcagcctggagaaccccagtgatgctgaggccctgtatgagaccagcagcggcctgaacaccctgtctgagcacggcagcagcgagcacggcagcagcaagcacacagtggccgagcacaccagcggggagcacgccgagagcgagcacgccagcggggagcctgctgccacagaacatgctgagggggagcacacagtgggggagcagcccagcggggagcagcccagcggggagcacctgtctggagagcagcccctgtctgagctggagagcggggagcagcccagtgatgagcagcccagcggggagcacggcagcggggagcagcccagcggggagcaggccagcggggagcagcccagcggcaccatcctgaactgctacacctgtgcctacatgaatgaccagggcaagtgcctgcggggggagggcacctgcatcacccagaacagccagcagtgcatgctgaagaagatctttgagggcggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142255 - DNA, 468 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcagcccagcggggagcagcccagcggggagcacctgtctggagagcagcccctgtctgagctggagagcggggagcagcccagtgatgagcagcccagcggggagcacggcagcggggagcagcccagcggggagcaggccagcggggagcagcccagcggggagcacgccagcggggagcaggccagcggggcccccatcagcagcaccagcactggaggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142256 - DNA, 498 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcctgctgccacagagcacgccgagggggagcacacagtgggggagcagcccagcggggagcagcccagcggggagcacgccagcggggagcaggccagcggggcccccatcagcagcaccagcacaggcaccatcctgaactgctacacctgtgcctacatgaatgaccagggcaagtgcctgcggggggagggcacctgcatcacccagaacagccagcagtgcatgctgaagaagatctttgaaggaggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142257 - DNA, 246 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggcggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142258 - DNA, 366 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggcaccatcctgaactgctacacctgtgcctacatgaatgaccagggcaagtgcctgcggggggagggcacctgcatcacccagaacagccagcagtgcatgctgaagaagatctttgaaggaggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142259 - DNA, 588 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcagcccagcggggagcagcccagcggggagcacctgtctggagagcagcccctgtctgagctggagagcggggagcagcccagtgatgagcagcccagcggggagcacggcagcggggagcagcccagcggggagcaggccagcggggagcagcccagcggggagcacgccagcggggagcaggccagcggggcccccatcagcagcaccagcacaggcaccatcctgaactgctacacctgtgcctacatgaatgaccagggcaagtgcctgcggggggagggcacctgcatcacccagaacagccagcagtgcatgctgaagaagatctttgaaggaggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142260 - DNA, 741 bp, Artificial Sequence; identical to SEQ ID NO: 142254
  Description of Artificial Sequence: Synthetic coding sequence

SEQ ID NO: 142261 - DNA, 513 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcagcccagtgatgagcagcccagcggggagcacggcagcggggagcagcccagcggggagcaggccagcggggagcagcccagcggggagcacgccagcggggagcaggccagcggggcccccatcagcagcaccagcacaggcaccatcctgaactgctacacctgtgcctacatgaatgaccagggcaagtgcctgcggggggagggcacctgcatcacccagaacagccagcagtgcatgctgaagaagatctttgagggcggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142262 - DNA, 531 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagcagcccagcggggagcagcccagcggggagcacctgtctggagagcagcccctgtctgagctggagagcggggagcagcccagtgatgagcagcccagcggggagcacggcagcggggagcagcccagcggggagcaggccagcggggagcagcccagcggcaccatcctgaactgctacacctgtgcctacatgaatgaccagggcaagtgcctgcggggggagggcacctgcatcacccagaacagccagcagtgcatgctgaagaagatctttgagggcggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142263 - DNA, 588 bp, Artificial Sequence; identical to SEQ ID NO: 142259
  Description of Artificial Sequence: Synthetic coding sequence

SEQ ID NO: 142264 - DNA, 633 bp, Artificial Sequence; identical to SEQ ID NO: 142253
  Description of Artificial Sequence: Synthetic coding sequence

SEQ ID NO: 142265 - DNA, 798 bp, Artificial Sequence
  Description of Artificial Sequence: Synthetic coding sequence
atgaaccgcttcctgctgctgatgagcctgtacctgctgggcagcgcccggggcaccagcagccagcccaatgagctgagcggcagcattgaccaccagacctctgtgcagcagctgcccggggagttcttcagcctggagaaccccagtgatgctgaggccctgtatgagaccagcagcggcctgaacaccctgtctgagcacggcagcagcgagcacggcagcagcaagcacacagtggccgagcacaccagcggggagcacgccgagagcgagcacgccagcggggagcctgctgccacagaacatgctgagggggagcacacagtgggggagcagcccagcggggagcagcccagcggggagcacctgtctggagagcagcccctgtctgagctggagagcggggagcagcccagtgatgagcagcccagcggggagcacggcagcggggagcagcccagcggggagcaggccagcggggagcagcccagcggggagcacgccagcggggagcaggccagcggggcccccatcagcagcaccagcacaggcaccatcctgaactgctacacctgtgcctacatgaatgaccagggcaagtgcctgcggggggagggcacctgcatcacccagaacagccagcagtgcatgctgaagaagatctttgaaggaggcaagctgcagttcatggtgcagggctgtgagaacatgtgccccagcatgaacctcttcagccacggcaccaggatgcagatcatctgctgcaggaaccagagcttctgcaacaagatctag

SEQ ID NO: 142266 - DNA, 1722 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctggcagcgagagcggccgcagcacccccagcctgtctgtgctgagtgacagcaagcccccacccagcacctaccagcaggcccccaggcacttccacgtgcctgacacaggagtgaaggacaacatctacaggaagccacccatctaccggcagcacgccgcccggcggagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccgggagaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142267 - DNA, 1041 bp, Artificial Sequence
  Description of Artificial Sequence: Synthetic coding sequence
atgtttgctgagggggaggagatgtacctgcagggcagcagcatctggcacccagcctgccggcaggccgccaggacagaagatagaaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagagcccccagctgctgagccccacccccacagaaggagaccaggatgacaggagctacaagcagtgcaggaccagcagccccagcagcacaggctctgtgtccctgggccgctacacccccaccagccgcagcccccagcactacagcaggccagacacaggagtgaaggacaacatctacaggaagccacccatctaccggcagcacgccgcccggcggagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccgcttcccctacagcaagagtgaccccctgcccggccacggcaagaatggcctggaccagagaaatgccaacctggccccctgtggggctgaccctgatgcctcctggggcatgagggagtacaagatctacccctatgacagcctcatcgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142268 - DNA, 1836 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctggcagcgagagcggccgcagcacccccagcctgtctgtgctgagtgacagcaagcccccacccagcacctaccagcaggcccccaggcacttccacgtgcctgacacaggagtgaaggacaacatctacaggaagccacccatctaccggcagcacgccgcccggcggagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccgcttcccctacagcaagagtgaccccctgcccggccacggcaagaatggcctggaccagagaaatgccaacctggccccctgtggggctgaccctgatgcctcctggggcatgagggagtacaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142269 - DNA, 1719 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctggcagcgagagcggccgcagcacccccagcctgtctgtgctgagtgacagcaagcccccacccagcacctaccagcaggcccccaggcacttccacgtgcctgacacaggagtgaaggacaacatctacaggaagccacccatctaccggcagcacgccgcccggcggagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccagtacaagatctacccctatgacagcctcatcgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142270 - DNA, 1596 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagagcccccagctgctgagccccacccccacagaaggagaccaggatgacaggagctacaagcagtgcaggaccagcagccccagcagcactggatctgtgtccctgggccgctacacccccaccagccgcagcccccagcactacagcaggcctgctgccaggagaagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccagtacaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142271 - DNA, 1935 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctgctggcaccgtgtctgtgggcaccagcagctgcctgagcctgagccagcaccccagccccacctctgtgttccgccaccactacatcccctacttccggggcagcgagagcggccgcagcacccccagcctgtctgtgctgagtgacagcaagcccccacctccacccaccagccgccacctggccacccacgtgcctgacacaggagtgaaggacaacatctacaggaagccacccatctaccggcagcacgccgcccggcggagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccgcttcccctacagcaagagtgaccccctgcccggccacggcaagaatggcctggaccagagaaatgccaacctggccccctgtggggctgaccctgatgcctcctggggcatgagggagtacaagatctacccctatgacagcctcatcgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142272 - DNA, 1566 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctgctgcccggcggagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccagtacaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142273 - DNA, 1413 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagagcccccagctgctgagccccacccccacagaaggagaccaggatgacaggagctacaagcagtgcaggaccagcagccccagcagcactggatctgtgtccctgggccgctacacccccaccagccgcagcccccagcactacagcaggcctgctgccaggagaagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccgggagtggttcttctag

SEQ ID NO: 142274 - DNA, 1938 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctgctggcaccgtgtctgtgggcaccagcagctgcctgagcctgagccagcaccccagccccacctctgtgttccgccaccactacatcccctacttccggggcagcgagagcggccgcagcacccccagcctgtctgtgctgagtgacagcaagcccccacccagcacctaccagcaggcccccaggcacttccacgtgcctgacaccggggtgaaggacaacatctacaggaagccacccatctaccggcagcacgccgccaggagaagtgatggagaagatggcagcctggaccaggacaacaggaagcagaagagctcctggctgatgctgaagggagatgctgacaccaggaccaacagcccagacctggacacccagagcctgagccacagcagcggcacagaccgggaccccctgcagaggatggccggggacagcttccacagccgcttcccctacagcaagagtgaccccctgcccggccacggcaagaatggcctggaccagagaaatgccaacctggccccctgtggggctgaccctgatgcctcctggggcatgagggagtacaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142275 - DNA, 1680 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctgctgcccggcggagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccgcttcccctacagcaagagtgaccccctgcccggccacggcaagaatggcctggaccagagaaatgccaacctggccccctgtggggctgaccctgatgcctcctggggcatgagggagtacaagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142276 - DNA, 1041 bp, Artificial Sequence; identical to SEQ ID NO: 142267
  Description of Artificial Sequence: Synthetic coding sequence

SEQ ID NO: 142277 - DNA, 1716 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagggggaccaggatgacaggagctacaagcagtgcaggaccagcagccccagcagcacaggctctgtgtccctgggccgctacacccccaccagccgcagcccccagcactacagcaggcctggcagcgagagcggccgcagcacccccagcctgtctgtgctgagtgacagcaagcccccacccagcacctaccagcaggcccccaggcacttccacgtgcctgacacaggagtgaaggacaacatctacaggaagccacccatctaccggcagcacgccgcccggcggagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccagcagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142278 - DNA, 1596 bp, Artificial Sequence
  Description of Artificial Sequence: Synthetic coding sequence
atgtctgctgtgtcccagccccaggccgcccccagccccctggagaagagccccagcacagccatcctgtgcaacacctgtggaaatgtgtgcaagggggaggtgctgcgggtgcaggacaagtacttccacatcaagtgctttgtgtgcaaggcctgtggctgtgacctggccgagggcggcttctttgtgcggcagggcgagtacatctgcaccctggactaccagaggctgtatggcacccgctgcttcagctgtgaccagttcatcgagggggaggtggtgtctgccctgggcaagacctaccacccagactgctttgtgtgtgctgtgtgccgcctgcccttccccccaggggacagagtgaccttcaacgggaaggagtgcatgtgccagaagtgcagcctgcctgtgtctgtgggcagcagcgcccacctgagccagggcctgcggagctgtggcggctgcggcacagagatcaagaatggccaggccctggtggccctggacaagcactggcacctgggctgcttcaagtgcaagagctgtgggaagctgctgaatgctgagtacatcagcaaggatggcctgccctactgtgaggccgactaccacgccaagtttggcatccgctgtgacagctgtgagaagtacatcaccggccgggtgctggaggccggggagaagcactaccaccccagctgtgccctgtgtgtgcgctgtggccagatgtttgctgagggggaggagatgtacctgcagggcagcagcatctggcacccagcctgccggcaggccgccaggacagaggacaggaacaaggagaccaggaccagcagcgagagcatcatctctgtgcctgccagcagcaccagcggcagccccagcagggtcatctatgccaagctgggcggggagatcctggactacagagacctggccgccctgcccaagagcaaggccatctatgacatcgacagaccagacatgatctcctacagcccctacatcagccacagcgctggggaccggcagagctatggagagagcccccagctgctgagccccacccccacagaaggagaccaggatgacaggagctacaagcagtgcaggaccagcagccccagcagcactggatctgtgtccctgggccgctacacccccaccagccgcagcccccagcactacagcaggcctgctgccaggagaagtgatggagaagatggcagcctggaccaggacaacaggaagaagagctcctggctgatgctgaagggagatgctgacaccaggaccaacagcccagacctggacacccagagcctgagccacagcagcggcacagaccgggaccccctgcagaggatggccggggacagcttccacagccgggagcagatctacccctatgacagcctgattgtgaccaaccgcatccgggtgaagctgcccaaggatgtggacaggacccggctggagcggcacctgagccctgaggagttccaggaggtgtttggcatgagcattgaggagtttgaccggctggccctgtggaagagaaatgacctgaagaagaaggccctgctcttctag

SEQ ID NO: 142279 - DNA, 2193 bp, Artificial Sequence
  Description of Artificial Sequence: Synthetic coding sequence
atggaggagctgattgtggagctgcggctcttcctggagctgctggaccacgagtacctgaccagcacagtgcgggagaagaaggctgtgatcaccaacatcctgctgcgcatccagagcagcaagggctttgatgtgaaggaccacgcccagaagcaggagacagccaacagcctgcctgccccaccccagatgcccctgcctgagatcccccagccctggctgcccccagattctggccccccacccctgcccaccagcagcctgcctgagggctactatgaggaggccgtgcccctgagccctgggaaggcccctgagtacatcaccagcaactatgacagtgatgccatgagcagcagctatgagagctatgatgaggaggaggaggatggcaagggcaagaagaccaggcaccagtggcccagcgaggaggcctccatggacctggtgaaggatgccaagatctgtgccttcctgctgaggaagaagcgcttcggccagtggaccaagctgctgtgtgtgatcaaggacaccaagctgctgtgctacaagagcagcaaggaccagcagccccagatggagctgcccctgcagggctgcaacatcacctacatccccaaggacagcaagaagaagaagcatgagctgaagatcacccagcagggcacagaccccctggtgctggccgtgcagagcaaggagcaggccgagcagtggctgaaggtgatcaaggaggcctacagcggctgcagcggccctgtggacagcgagtgccccccaccacccagcagccctgtgcacaaggccgagctggagaagaagctgagcagcgagcggcccagcagtgatggagaaggagtggtggagaatggcatcaccacctgcaatggcaaggagcaggtgaagaggaagaagagcagcaagtctgaggccaagggcaccgtgtccaaggtgacaggcaagaagatcaccaagatcatcagcctgggcaagaagaagcccagcacagatgagcagaccagcagcgctgaggaggatgtgcccacctgtggctacctgaatgtgctgagcaacagccgctggagggagcgctggtgccgggtgaaggacaacaagctgatcttccacaaggacagaacagacctgaagacccacatcgtgtccatccccctgcggggctgtgaggtgattcctggcctggacagcaagcaccccctgaccttccggctgctgagaaatggccaggaggtggccgtgctggaggccagcagcagcgaggacatgggccgctggattggcatcctgctggccgagaccggcagcagcacagatcctgaggccctgcactatgactacattgatgtggagatgtctgccagcgtcatccagacagccaagcagaccttctgcttcatgaacagaagagtcatcagcgccaacccctacctgggcggcaccagcaatggctacgcccaccccagcggcacagccctgcactatgatgatgtgccctgcatcaatggcagcctgaagggcaagaagccccctgtggccagcaatggagtgacaggcaagggcaagaccctgagcagccagcccaagaaggctgaccctgctgctgtggtgaagaggacaggcagcaatgctgcccagtacaagtatggcaagaacagagtggaggctgatgccaagaggctgcagaccaaggaggaggagctgctgaagaggaaggaggccctgaggaaccggctggcccagctgaggaaggagaggaaggacctgcgggccgccatcgaggtgaatgccggcaggaagccccaggccatcctggaggagaagctgaagcagctggaggaggagtgccggcagaaggaggccgagcgggtgtccctggagctggagctgacagaggtgaaggagagcctgaagaaggccctggccggcggcgtgaccctgggcctggccatcgagcccaagagcggcaccagcagcccccagagccctgtgttccgccacaggaccctggagaacagccccatcagcagctgtgacaccagtgacacagagggccctgtgcctgtgaacagcgctgctgtgctgaagaagagccaggccgcccctggcagcagcccctgccggggccacgtgctgaggaaggccaaggagtgggagctgaagaatggcacctag

SEQ ID NO: 142280 - DNA, 2193 bp, Artificial Sequence; identical to SEQ ID NO: 142279
  Description of Artificial Sequence: Synthetic coding sequence

SEQ ID NO: 142281 - DNA, 2445 bp, Artificial Sequence
  Description of Artificial Sequence: Synthetic coding sequence
atggaggagctgattgtggagctgcggctcttcctggagctgctggaccacgagtacctgaccagcacagtgcgggagaagaaggctgtgatcaccaacatcctgctgcgcatccagagcagcaagggctttgatgtgaaggaccacgcccagaagcaggagacagccaacagcctgcctgccccaccccagatgcccctgcctgagatcccccagccctggctgcccccagattctggccccccacccctgcccaccagcagcctgcctgagggctactatgaggaggccgtgcccctgagccctgggaaggcccctgagtacatcaccagcaactatgacagtgatgccatgagcagcagctatgagagctatgatgaggaggaggaggatggcaagggcaagaagaccaggcaccagtggcccagcgaggaggcctccatggacctggtgaaggatgccaagatctgtgccttcctgctgaggaagaagcgcttcggccagtggaccaagctgctgtgtgtgatcaaggacaccaagctgctgtgctacaagagcagcaaggaccagcagccccagatggagctgcccctgcagggctgcaacatcacctacatccccaaggacagcaagaagaagaagcatgagctgaagatcacccagcagggcacagaccccctggtgctggccgtgcagagcaaggagcaggccgagcagtggctgaaggtgatcaaggaggcctacagcggctgcagcggccctgtggacagcgagtgccccccaccacccagcagccctgtgcacaaggccgagctggagaagaagctgagcagcgagcggcccagcagtgatggagaaggagtggtggagaatggcatcaccacctgcaatggcaaggagcaggtgaagaggaagaagagcagcaagtctgaggccaagggcaccgtgtccaaggtgacaggcaagaagatcaccaagatcatcagcctgggcaagaagaagcccagcacagatgagcagaccagcagcgctgaggaggatgtgcccacctgtggctacctgaatgtgctgagcaacagccgctggagggagcgctggtgccgggtgaaggacaacaagctgatcttccacaaggacagaacagacctgaagacccacatcgtgtccatccccctgcggggctgtgaggtgattcctggcctggacagcaagcaccccctgaccttccggctgctgagaaatggccaggaggtggccgtgctggaggccagcagcagcgaggacatgggccgctggattggcatcctgctggccgagaccggcagcagcacagatcctgaggccctgcactatgactacattgatgtggagatgtctgccagcgtcatccagacagccaagcagaccttctgcttcatgaacagaagagtcatcagcgccaacccctacctgggcggcaccagcaatggctacgcccaccccagcggcacagccctgcactatgatgatgtgccctgcatcaatggctcctgggagccagaagatggcttccctgccagctgcagccggggcctgggggaggaggtgctgtatgacaatgccggcctgtatgacaacctgcccccaccccacatctttgcccgctacagccctgctgacaggaaggccagccggctgtctgctgacaagctgagcagcaaccactacaagtacccagccagcgcccagagcgtgaccaacaccagctctgtgggccgggccagcctgggcctgaacagccagctgaagggcaagaagccccctgtggccagcaatggagtgacaggcaagggcaagaccctgagcagccagcccaagaaggctgaccctgctgctgtggtgaagaggacaggcagcaatgctgcccagtacaagtatggcaagaacagagtggaggctgatgccaagaggctgcagaccaaggaggaggagctgctgaagaggaaggaggccctgaggaaccggctggcccagctgaggaaggagaggaaggacctgcgggccgccatcgaggtgaatgccggcaggaagccccaggccatcctggaggagaagctgaagcagctggaggaggagtgccggcagaaggaggccgagcgggtgtccctggagctggagctgacagaggtgaaggagagcctgaagaaggccctggccggcggcgtgaccctgggcctggccatcgagcccaagagcggcaccagcagcccccagagccctgtgttccgccacaggaccctggagaacagccccatcagcagctgtgacaccagtgacacagagggccctgtgcctgtgaacagcgctgctgtgctgaagaagagccaggccgcccctggcagcagcccctgccggggccacgtgctgaggaaggccaaggagtgggagctgaagaatggcacctag

SEQ ID NO: 142282 - DNA, 2307 bp, Artificial Sequence
  Description of Artificial Sequence: Synthetic coding sequence
atggaccggggccaggtgctggagcagctgctgcctgagctgaccggcctgctgagcctgctggaccacgagtacctgagtgacaccaccctggagaagaagatggctgtggccagcatcctgcagagcctgcagcccctgcctgccaaggaggtgtcctacctgtatgtgaacacagctgacctgcacagcggccccagctttgtggagagcctgtttgaggagtttgactgtgacctgagtgacctgcgggacatgccagaagatgatggagagcccagcaaaggagccagccctgagctggccaagagcccccggctgagaaatgctgctgacctgcccccacccctgcccaacaagcccccacctgaggactactatgaggaggccctgcccctgggccctgggaagagccctgagtacatcagcagccacaacggctgcagccccagccacagcatcgtggatggctactatgaagatgctgacagcagctacccagccaccagggtgaatggagagctgaagagcagctacaatgacagtgatgccatgagcagcagctatgagagctatgatgaggaggaggaggagggcaagagcccccagcccaggcaccagtggcccagcgaggaggcctccatgcacctggtgcgggagtgccgcatctgtgccttcctgctgaggaagaagagatttggccagtgggccaagcagctgaccgtcatccgggaggaccagctgctgtgctacaagagcagcaaggaccggcagccccacctgcggctggccctggacacctgcagcatcatctacgtgcccaaggacagccgccacaagagacatgagctgcgcttcacccagggcgccacagaggtgctggtgctggccctgcagagccgggagcaggccgaggagtggctgaaggtgatccgggaggtgtccaagcctgtgggcggcgctgagggcgtggaggtgcccaggagccctgtgctgctgtgcaagctggacctggacaagaggctgagccaggagaagcagaccagtgacagcgacagcgtgggcgtgggggacaactgcagcaccctgggcagaagagagacctgtgaccacggcaagggcaagaagagcagcctggccgagctgaagggctccatgagcagagctgctggcaggaagatcacccgcatcatcggcttcagcaagaagaagaccctggctgatgacctgcagaccagcagcacagaggaggaggtgccctgctgcggctacctgaatgtgctggtgaaccagggctggaaggagcgctggtgccgcctgaagtgcaacaccctgtacttccacaaggaccacatggacctgcggacccacgtgaatgccatcgccctgcagggctgtgaggtggcccctggcttcggccccaggcacccctttgccttccgcatcctgaggaaccggcaggaggtggccatcctggaggccagctgcagcgaggacatgggccgctggctgggcctgctgctggtggagatgggcagccgggtgaccccagaggccctgcactatgactatgtggatgtggagaccctgaccagcatcgtgtctgctggcaggaacagcttcctgtatgcccggagctgccagaaccagtggccagagccccgggtgtatgatgatgtgccctatgagaagatgcaggatgaggagcctgagcggcccaccggggcccaggtgaagagacatgccagcagctgcagcgagaagagccaccgggtggacccccaggtgaaggtgaagagacatgccagcagcgccaaccagtacaagtatggcaagaacagagcagaagaagatgcccggcgctacctggtggagaaggagaagctggagaaggagaaggagaccatcagaacagagctgattgccctgcggcaggagaagcgggagctgaaggaggccatccgcagcagccctggggccaagctgaaggccctggaggaggccgtggccaccctggaggcccagtgccgggccaaggaggagaggagaattgacctggagctgaagctggtggccgtgaaggagcggctgcagcagagcctggccggcggccctgccctgggcctgtctgtgagcagcaagcccaagtctggagaaacagccaacaagccccagaacagcgtgcctgagcagcccctgcctgtgaactgtgtgtctgagctgaggaagaggagccccagcatcgtggccagcaaccagggccgggtgctgcagaaggccaaggagtgggagatgaagaagacctag

SEQ ID NO: 142283 - DNA, 2178 bp, Artificial Sequence
  Description of Artificial Sequence: Synthetic coding sequence
atggaccggggccaggtgctggagcagctgctgcctgagctgaccggcctgctgagcctgctggaccacgagtacctgagtgacaccaccctggagaagaagatggctgtggccagcatcctgcagagcctgcagcccctgcctgccaaggaggtgtcctacctgtatgtgaacacagctgacctgcacagcggccccagctttgtggagagcctgtttgaggagtttgactgtgacctgagtgacctgcgggacatgccagaagatgatggagagcccagcaaaggagccagccctgagctggccaagagcccccggctgagaaatgctgctgacctgcccccacccctgcccaacaagcccccacctgaggactactatgaggaggccctgcccctgggccctgggaagagccctgagtacatcagcagccacaacggctgcagccccagccacagcatcgtggatggctactatgaagatgctgacagcagctacccagccaccagggtgaatggagagctgaagagcagctacaatgacagtgatgccatgagcagcagctatgagagctatgatgaggaggaggaggagggcaagagcccccagcccaggcaccagtggcccagcgaggaggcctccatgcacctggtgcgggagtgccgcatctgtgccttcctgctgaggaagaagagatttggccagtgggccaagcagctgaccgtcatccgggaggaccagctgctgtgctacaagagcagcaaggaccggcagccccacctgcggctggccctggacacctgcagcatcatctacgtgcccaaggacagccgccacaagagacatgagctgcgcttcacccagggcgccacagaggtgctggtgctggccctgcagagccgggagcaggccgaggagtggctgaaggtgatccgggaggtgtccaagcctgtgggcggcgctgagggcgtggaggtgcccaggagccctgtgctgctgtgcaagctggacctggacaagaggctgagccaggagaagcagaccagtgacagcgacagcgtgggcgtgggggacaactgcagcaccctgggcagaagagagacctgtgaccacggcaagggcaagaagagcagcctggccgagctgaagggctccatgagcagagctgctggcaggaagatcacccgcatcatcggcttcagcaagaagaagaccctggctgatgacctgcagaccagcagcacagaggaggaggtgccctgctgcggctacctgaatgtgctggtgaaccagggctggaaggagcgctggtgccgcctgaagtgcaacaccctgtacttccacaaggaccacatggacctgcggacccacgtgaatgccatcgccctgcagggctgtgaggtggcccctggcttcggccccaggcacccctttgccttccgcatcctgaggaaccggcaggaggtggccatcctggaggccagctgcagcgaggacatgggccgctggctgggcctgctgctggtggagatgggcagccgggtgaccccagaggccctgcactatgactatgtggatgtggagaccctgaccagcatcgtgtctgctggcaggaacagcttcctgtatgcccggagctgccagaaccagtggccagagccccgggtgtatgatgatgtgccctatgagaagatgcaggatgaggagcctgagcggcccaccggggcccaggtgaagagacatgccagcagctgcagcgagaagagccaccgggtggacccccaggtgaaggtgaagagacatgccagcagcgccaaccagtacaagtatggcaagaacagagcagaagaagatgcccggcgctacctggtggagaaggagaagctggagaaggagaaggagaccatcagaacagagctgattgccctgcggcaggagaagcgggagctgaaggaggccatccgcagcagccctggggccaagctgaaggccctggaggaggccgtggccaccctggaggcccagtgccgggccaaggaggagaggagaattgacctggagctgaagctggtggccgtgaaggagcggctgcagcagagcctggccggcggccctgccctgggcctgtctgtgagcagcaagcccaagtctggagagtgggagatgaagaagacctag

SEQ ID NO: 142284 - DNA, 2457 bp, Artificial Sequence
  Description of Artificial Sequence: Synthetic coding sequence
atggagcgctacaaggccctggagcagctgctgacagagctggatgacttcctgaagatcctggaccaggagaacctgagcagcacagccctggtgaagaagagctgcctggccgagctgctgcggctgtacaccaagagcagcagcagtgatgaggagtacatctacatgaacaaggtgaccatcaacaagcagcagaatgctgagagccagggcaaggcccctgaggagcagggcctgctgcccaatggagagcccagccagcacagcagcgccccccagaagagcctgcctgacctgcccccacccaagatgatccctgagaggaagcagctggccatccccaagacagagagccctgagggctactatgaggaggccgagccctatgacaccagcctgaatgaagatggagaggccgtgagcagcagctatgagagctatgatgaagaagatggcagcaagggcaagagcgccccctaccagtggcccagccctgaggccggcatcgagctgatgagagatgcccgcatctgtgccttcctgtggaggaagaagtggctgggccagtgggccaagcagctgtgtgtgatcaaggacaaccggctgctgtgctacaagagcagcaaggaccacagcccccagctggatgtgaacctgctgggcagcagcgtcatccacaaggagaagcaggtgaggaagaaggagcacaagctgaagatcacccccatgaatgctgatgtgattgtgctgggcctgcagagcaaggaccaggccgagcagtggctgcgggtcatccaggaggtgtctggcctgcccagcgagggcgccagcgagggcaaccagtacaccccagatgcccagcgcttcaactgccagaagccagacattgctgagaagtacctgagcgcctctgaatatggcagctctgtggatggccaccctgaggtgcctgagaccaaggatgtgaagaagaagtgcagcgctggcctgaagctgagcaacctgatgaacctgggcaggaagaagagcaccagcctggagcctgtggagaggagcctggagaccagcagctacctgaatgtgctggtgaacagccagtggaagagccgctggtgcagcgtgcgggacaaccacctgcacttctaccaggacaggaacagaagcaaggtggcccagcagcccctgagcctggtgggctgtgaggtggtgcctgaccccagcccagaccacctgtacagcttccgcatcctgcacaagggggaggagctggccaagctggaggccaagagcagcgaggagatgggccactggctgggcctgctgctgtctgagagcggcagcaagacagatcctgaggagttcacctatgactatgtggatgctgacagagtgtcctgcatcgtgtctgctgccaagaacagcctgctgctgatgcagaggaagttcagcgagcccaacacctacattgatggcctgcccagccaggaccggcaggaggagctgtatgatgatgtggacctgtctgagctgacagctgctgtggagcccacagaggaggccacccctgtggctgatgaccccaatgaaagagaaagtgacagagtgtacctggacctgacccctgtgaagagcttcctgcacggccccagcagcgcccaggcccaggccagcagccccaccctgagctgcctggacaatgccacagaggccctgcctgctgacagcggccctggccccaccccagatgagccctgcatcaagtgcccagagaacctgggggagcagcagctggagagcctggagcctgaggaccccagcctgcgcatcaccaccgtgaagatccagacagagcagcagaggatctccttcccccccagctgcccagatgctgtggtggccaccccacctggggccagcccccctgtgaaggaccggctgcgggtgaccagcgctgagatcaagctgggcaagaacagaacagaagctgaggtgaagcgctacacagaggagaaggagcggctggagaagaagaaggaggagatccggggccacctggcccagctgaggaaggagaagcgggagctgaaggagaccctgctgaagtgcacagacaaggaggtgctggccagcctggagcagaagctgaaggagattgatgaggagtgccgcggggaggagagcagaagagtggacctggagctgagcatcatggaggtgaaggacaacctgaagaaggccgaggccggccctgtgaccctgggcaccaccgtggacaccacccacctggagaatgtgagcccccggcccaaggctgtgaccccagccagcgccccagactgcacccctgtgaacagcgccaccaccctgaagaaccggcccctgtctgtggtggtgacaggcaagggcaccgtgctgcagaaggccaaggagtgggagaagaagggggccagctag

SEQ ID NO: 142285 - DNA, 2445 bp, Artificial Sequence
  Description of Artificial Sequence: Synthetic coding sequence
atggagcgctacaaggccctggagcagctgctgacagagctggatgacttcctgaagatcctggaccaggagaacctgagcagcacagccctggtgaagaagagctgcctggccgagctgctgcggctgtacaccaagagcagcagcagtgatgaggagtacatctacatgaacaaggtgaccatcaacaagcagcagaatgctgagagccagggcaaggcccctgaggagcagggcctgctgcccaatggagagcccagccagcacagcagcgccccccagaagagcctgcctgacctgcccccacccaagatgatccctgagaggaagcagctggccatccccaagacagagagccctgagggctactatgaggaggccgagccctatgacaccagcctgaatgaagatggagaggccgtgagcagcagctatgagagctatgatgaagaagatggcagcaagggcaagagcgccccctaccagtggcccagccctgaggccggcatcgagctgatgagagatgcccgcatctgtgccttcctgtggaggaagaagtggctgggccagtgggccaagcagctgtgtgtgatcaaggacaaccggctgctgtgctacaagagcagcaaggaccacagcccccagctggatgtgaacctgctgggcagcagcgtcatccacaaggagaagcaggtgaggaagaaggagcacaagctgaagatcacccccatgaatgctgatgtgattgtgctgggcctgcagagcaaggaccaggccgagcagtggctgcgggtcatccaggaggtgtctggcctgcccagcgagggcgccagcgagggcaaccagtacaccccagatgcccagcgcttcaactgccagaagccagacattgctgagaagtacctgagcgcctctgaatatggcagctctgtggatggccaccctgaggtgcctgagaccaaggatgtgaagaagaagtgcagcgctggcctgaagctgagcaacctgatgaacctgggcaggaagaagagcaccagcctggagcctgtggagaggagcctggagaccagcagctacctgaatgtgctggtgaacagccagtggaagagccgctggtgcagcgtgcgggacaaccacctgcacttctaccaggacaggaacagaagcaaggtggcccagcagcccctgagcctggtgggctgtgaggtggtgcctgaccccagcccagaccacctgtacagcttccgcatcctgcacaagggggaggagctggccaagctggaggccaagagcagcgaggagatgggccactggctgggcctgctgctgtctgagagcggcagcaagacagatcctgaggagttcacctatgactatgtggatgctgacagagtgtcctgcatcgtgtctgctgccaagaacagcctgctgctgatgcagaggaagttcagcgagcccaacacctacattgatggcctgcccagccaggaccggcaggaggagctgtatgatgatgtggacctgtctgagctgacagctgctgtggagcccacagaggaggccacccctgtggctgatgaccccaatgaaagagaaagtgacagagtgtacctggacctgacccctgtgaagagcttcctgcacggccccagcagcgcccaggcccaggccagcagccccaccctgagctgcctggacaatgccacagaggccctgcctgctgacagcggccctggccccaccccagatgagccctgcatcaagtgcccagagaacctgggggagcagcagctggagagcctggagcctgaggaccccagcctgcgcatcaccaccgtgaagatccagacagagcagcagaggatctccttcccccccagctgcccagatgctgtggtggccaccccacctggggccagcccccctgtgaaggaccggctgcgggtgaccagcgctgagatcaagctgggcaagaacagaacagaagctgaggtgaagcgctacacagaggagaaggagcggctggagaagaagaaggaggagatccggggccacctggcccagctgaggaaggagaagcgggagctgaaggagaccctgctgaagtgcacagacaaggaggtgctggccagcctggagcagaagctgaaggagattgatgaggagtgccgcggggaggagagcagaagagtggacctggagctgagcatcatggaggtgaaggacaacctgaagaaggccgaggccggccctgtgaccctgggcaccaccgtggacaccacccacctggagaaccccaaggctgtgaccccagccagcgccccagactgcacccctgtgaacagcgccaccaccctgaagaaccggcccctgtctgtggtggtgacaggcaagggcaccgtgctgcagaaggccaaggagtgggagaagaagggggccagctag

SEQ ID NO: 142286 - DNA, 2526 bp, Artificial Sequence
  Description of Artificial Sequence: Synthetic coding sequence
cagagggtgcgggccctggagcagctgctgacagagctggatgacttcctgaagatcctggaccaggagaacctgagcagcacagccctggtgaagaagagctgcctggccgagctgctgcggctgtacaccaagagcagcagcagtgatgaggagtacatctacatgaacaaggtgaccatcaacaagcagcagaatgctgagagccagggcaaggcccctgaggagcagggcctgctgcccaacggggagcccagccagcacagcagcgccccccagaagagcctgcctgacctgcccccacccaagatgatccctgagaggaagcagctggccatccccaagacagagagccctgagggctactatgaggaggccgagccctatgacaccagcctgaatggccacagcggcggcttcctgcccactggagtgccccgctgggtgcaggtgcctgagggcgtcatctatgccaccatcaccctggaggatggagaggccgtgagcagcagctatgagagctatgatgaggaggatggcagcaagggcaagagcgccccctaccagtggcccagccctgaggccggcatcgagctgatgagagatgcccgcatctgtgccttcctgtggaggaagaagtggctgggccagtgggccaagcagctgtgtgtgatcaaggacaaccggctgctgtgctacaagagcagcaaggaccacagcccccagctggatgtgaacctgctgggcagcagcgtcatccacaaggagaagcaggtgaggaagaaggagcacaagctgaagatcacccccatgaatgctgatgtgattgtgctgggcctgcagagcaaggaccaggccgagcagtggctgcgggtcatccaggaggtgtctggcctgcccagcgagggcgccagcgagggcaaccagtacaccccagatgcccagcgcttcaactgccagaagccagacattgctgagaagtacctgagcgcctctgaatatggcagctctgtggatggccaccctgaggtgcctgagaccaaggatgtgaagaagaagtgcagcgctggcctgaagctgagcaacctgatgaacctgggcaggaagaagagcaccagcctggagcctgtggagaggagcctggagaccagcagctacctgaatgtgctggtgaacagccagtggaagagccgctggtgcagcgtgcgggacaaccacctgcacttctaccaggacaggaacagaagcaaggtggcccagcagcccctgagcctggtgggctgtgaggtggtgcctgaccccagcccagaccacctgtacagcttccgcatcctgcacaagggggaggagctggccaagctggaggccaagagcagcgaggagatgggccactggctgggcctgctgctgtctgagagcggcagcaagacagatcctgaggagttcacctatgactatgtggatgctgacagagtgtcctgcatcgtgtctgctgccaagaacagcctgctgctgatgcagaggaagttcagcgagcccaacacctacattgatggcctgcccagccaggaccggcaggaggagctgtatgatgatgtggacctgtctgagctgacagctgctgtggagcccacagaggaggccacccctgtggctgatgaccccaatgaaagagaaagtgacagagtgtacctggacctgacccctgtgaagagcttcctgcacggccccagcagcgcccaggcccaggccagcagccccaccctgagctgcctggacaatgccacagaggccctgcctgctgacagcggccctggccccaccccagatgagccctgcatcaagtgcccagagaacctgggggagcagcagctggagagcctggagcctgaggaccccagcctgcgcatcaccaccgtgaagatccagacagagcagcagaggatctccttcccccccagctgcccagatgctgtggtggccaccccacctggggccagcccccctgtgaaggaccggctgcgggtgaccagcgctgagatcaagctgggcaagaacagaacagaggccgaggtgaagcgctacacagaggagaaggagcggctggagaagaagaaggaggagatccggggccacctggcccagctgaggaaggagaagcgggagctgaaggagaccctgctgaagtgcacagacaaggaggtgctggccagcctggagcagaagctgaaggagattgatgaagaatgtagaggagaggagagccggcgggtggacctggagctgagcatcatggaggtgaaggacaacctgaagaaggccgaggccggccctgtgaccctgggcaccaccgtggacaccacccacctggagaaccccaaggctgtgaccccagccagcgccccagactgcacccctgtgaacagcgccaccaccctgaagaaccggcccctgtctgtggtggtgactggaaaaggaacagtgctgcagaaggccaaggagtgggagaagaagggggccagctag

SEQ ID NO: 142287 - DNA, 939 bp, Artificial Sequence
  Description of Artificial Sequence: Synthetic coding sequence
atggagcgctacaaggcccagggctgctgctgcctggtggtgcagaggcgcatccggcaggtgtctgccagcctggagcagctgctgacagagctggatgacttcctgaagatcctggaccaggagaacctgagcagcacagccctggtgaagaagagctgcctggccgagctgctgcggctgtacaccaagagcagcagcagtgatgaggagtacatctacatgaacaaggtgaccatcaacaagcagcagaatgctgagagccagggcaaggcccctgaggagcagggcctgctgcccaatggagagcccagccagcacagcagcgccccccagaagagcctgcctgacctgcccccacccaagatgatccctgagaggaagcagctggccatccccaagacagagagccctgagggctactatgaggaggccgagccctatgacaccagcctgaatgaagatggagaggccgtgagcagcagctatgagagctatgatgaagaagatggcagcaagggcaagagcgccccctaccagtggcccagccctgaggccggcatcgagctgatgagagatgcccgcatctgtgccttcctgtggaggaagaagtggctgggccagtgggccaagcagctgtgtgtgatcaaggacaaccggctgctgtgctacaagagcagcaaggaccacagcccccagctggatgtgaacctgctgggcagcagcgtcatccacaaggagaagcaggtgaggaagaaggagcacaagctgaagatcacccccatgaatgctgatgtgattgtgctgggcctgcagagcaaggaccaggccgagcagtggctgcgggtcatccaggaggtgtctggcctgcccagcgagggcgccagcgagggcaaccagtacaccccagatgcccagcgcttcaactgccagaagtag

SEQ ID NO: 142288 - DNA, 939 bp, Artificial Sequence; identical to SEQ ID NO: 142287
  Description of Artificial Sequence: Synthetic coding sequence

SEQ ID NO: 142289 - DNA, 2616 bp, Artificial Sequence
  Description of Artificial Sequence: Synthetic coding sequence
atggagcgctacaaggccctggagcagctgctgacagagctggatgacttcctgaagatcctggaccaggagaacctgagcagcacagccctggtgaagaagagctgcctggccgagctgctgcggctgtacaccaagagcagcagcagtgatgaggagtacatctacatgaacaaggtgaccatcaacaagcagcagaatgctgagagccagggcaaggcccctgaggagcagggcctgctgcccaatggagagcccagccagcacagcagcgccccccagaagagcctgcctgacctgcccccacccaagatgaggatcctgaccctgggccagatcagcggggcccagagcttctccccagatggcacccacctgactggaacagagttcctgggcggctggagctggaggcccagccagatccggctgatgagccctggcacccactggggagacctgacagccacagagatccctgagaggaagcagctggccatccccaagacagagagccctgagggctactatgaggaggccgagccctatgacaccagcctgaatgaagatggagaggccgtgagcagcagctatgagagctatgatgaggaggatggcagcaagggcaagagcgccccctaccagtggcccagccctgaggccggcatcgagctgatgagagatgcccgcatctgtgccttcctgtggaggaagaagtggctgggccagtgggccaagcagctgtgtgtgatcaaggacaaccggctgctgtgctacaagagcagcaaggaccacagcccccagctggatgtgaacctgctgggcagcagcgtcatccacaaggagaagcaggtgaggaagaaggagcacaagctgaagatcacccccatgaatgctgatgtgattgtgctgggcctgcagagcaaggaccaggccgagcagtggctgcgggtcatccaggaggtgtctggcctgcccagcgagggcgccagcgagggcaaccagtacaccccagatgcccagcgcttcaactgccagaagccagacattgctgagaagtacctgagcgcctctgaatatggcagctctgtggatggccaccctgaggtgcctgagaccaaggatgtgaagaagaagtgcagcgctggcctgaagctgagcaacctgatgaacctgggcaggaagaagagcaccagcctggagcctgtggagaggagcctggagaccagcagctacctgaatgtgctggtgaacagccagtggaagagccgctggtgcagcgtgcgggacaaccacctgcacttctaccaggacaggaacagaagcaaggtggcccagcagcccctgagcctggtgggctgtgaggtggtgcctgaccccagcccagaccacctgtacagcttccgcatcctgcacaagggggaggagctggccaagctggaggccaagagcagcgaggagatgggccactggctgggcctgctgctgtctgagagcggcagcaagacagatcctgaggagttcacctatgactatgtggatgctgacagagtgtcctgcatcgtgtctgctgccaagaacagcctgctgctgatgcagaggaagttcagcgagcccaacacctacattgatggcctgcccagccaggaccggcaggaggagctgtatgatgatgtggacctgtctgagctgacagctgctgtggagcccacagaggaggccacccctgtggctgatgaccccaatgaaagagaaagtgacagagtgtacctggacctgacccctgtgaagagcttcctgcacggccccagcagcgcccaggcccaggccagcagccccaccctgagctgcctggacaatgccacagaggccctgcctgctgacagcggccctggccccaccccagatgagccctgcatcaagtgcccagagaacctgggggagcagcagctggagagcctggagcctgaggaccccagcctgcgcatcaccaccgtgaagatccagacagagcagcagaggatctccttcccccccagctgcccagatgctgtggtggccaccccacctggggccagcccccctgtgaaggaccggctgcgggtgaccagcgctgagatcaagctgggcaagaacagaacagaggccgaggtgaagcgctacacagaggagaaggagcggctggagaagaagaaggaggagatccggggccacctggcccagctgaggaaggagaagcgggagctgaaggagaccctgctgaagtgcacagacaaggaggtgctggccagcctggagcagaagctgaaggagattgatgaagaatgtagaggagaggagagccggcgggtggacctggagctgagcatcatggaggtgaaggacaacctgaagaaggccgaggccggccctgtgaccctgggcaccaccgtggacaccacccacctggagaatgtgagcccccggcccaaggctgtgaccccagccagcgccccagactgcacccctgtgaacagcgccaccaccctgaagaaccggcccctgtctgtggtggtgactggaaaaggaacagtgctgcagaaggccaaggagtgggagaagaagggggccagctag

SEQ ID NO: 142290 - DNA, 1002 bp, Artificial Sequence
  Description of Artificial Sequence: Synthetic coding sequence
atgtgtgaggaggagaccacagccctggtgtgtgacaatggaagtggcctgtgcaaggccggctttgctggagatgatgcccccagggctgtgttccccagcatcgtgggccggcccaggcaccagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagccagaatatgatgaagctggccccagcatcgtgcacaggaagtgcttctag

SEQ ID NO: 142291 - DNA, 1113 bp, Artificial Sequence
  Description of Artificial Sequence: Synthetic coding sequence
atgagcctgcaccagttcctgctggagcccatcacctgccacgcctggaacagagacaggacccagatcgccctgagccccaacaaccacgaggtgcacatctacaagaagaatggcagccagtgggtgaaggcccacgagctgaaggagcacaacggccacatcaccggcatcgactgggcccccaagagtgacagaattgtgacctgtggggctgacagaaatgcctacgtgtggagccagaaggatggagtgtggaagcccaccctggtgatcctgcgcatcaacagagctgccacctttgtgaagtggagccccctggagaacaagtttgctgtgggcagcggggcccggctcatctctgtgtgctactttgaaagtgaaaatgactggtgggtgtccaagcacatcaagaagcccatccgcagcacagtgctgagcctggactggcaccccaacaacgtgctgctggccgccggcagctgtgacttcaagtgcagggtcttcagcgcctacatcaaggaggtggatgagaagccagccagcaccccctggggcagcaagatgcccttcggccagctgatgtctgaatttggaggcagcggcactggaggctgggtgcacggcgtgtccttcagcgccagcggcagccggctggcctgggtgtcccatgacagcacagtgtctgtggctgatgccagcaagtctgtgcaggtgtccaccctgaagacagagttcctgcccctgctgtctgtgtcctttgtgtctgaaaattctgtggtggccgccggccatgactgctgccccatgctgttcaactatgatgaccggggctgcctgacctttgtgtccaagctggacatccccaagcagagcatccagaggaacatgtctgccatggagcgcttcaggaacatggacaagagggccaccacagaagatagaaacacagccctggagaccctgcaccagaacagcatcacccaggtgtccatctatgaggtggacaagcaggactgcaggaagttctgcaccaccggcattgatggagccatgaccatctgggacttcaagaccctggagagcagcatccagggcctgcgcatcatgtag

SEQ ID NO: 142292 - DNA, 1038 bp, Artificial Sequence
  Description of Artificial Sequence: Synthetic coding sequence
atgcatgagcgcttcatccactgcttctgcatcgactgggcccccaagagtgaccgcatcgtgacctgtggggctgacagaaatgcctacgtgtggagccagaaggatggagtgtggaagcccaccctggtgatcctgcgcatcaacagagctgccacctttgtgaagtggagccccctggagaacaagtttgctgtgggcagcggggcccggctcatctctgtgtgctactttgaaagtgaaaatgactggtgggtgtccaagcacatcaagaagcccatccgcagcacagtgctgagcctggactggcaccccaacaacgtgctgctggccgccggcagctgtgacttcaagtgcagggtcttcagcgcctacatcaaggaggtggatgagaagccagccagcaccccctggggcagcaagatgcccttcggccagctgatgtctgaatttggaggcagcggcaccggcggctgggtgcatggagtgtccttcagcgccagcggcagccggctggcctgggtgtcccatgacagcacagtgtctgtggctgatgccagcaagtctgtgcaggtgtccaccctgaagacagagttcctgcccctgctgtctgtgtcctttgtgtctgagaacagcgtggtggccgccggccatgactgctgccccatgctgttcaactatgatgaccggggctgcctgacctttgtgtccaagctggacatccccaagcagagcatccagaggaacatgtctgccatggagcgcttcaggaacatggacaagagggccaccacagaggacaggaacacagccctggagaccctgcaccagaacagcatcacccaggtgtccatctatgaggtggacaagcaggactgcaggaagttctgcaccactggaattgatggagccatgaccatctgggacttcaaggagcccagccgccacggcctgccccagctgcccggcggggcccaccagctgccccggctggagcagggcccccacccagactgccacctgccccagcagccctag

SEQ ID NO: 142293 - DNA, 1119 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgcgctgggccccaaatgaaaacaagtttgctgtgggcagcggcagcagggtcatcagcatctgctactttgagcaggagaatgactggtgggtgtgcaagcacatcaagaagcccatccgcagcacagtgctgagcctggactggcaccccaacaacgtgctgctggccgccggcagctgtgacttcaagtgccgcatcttcagcgcctacatcaaggaggtggaggagaggcctgcccccaccccctggggcagcaagatgccctttggagagctgatgtttgagagcagcagcagctgtggctgggtgcacggcgtgtgcttcagcgccagcggcagccgggtggcctgggtgtcccatgacagcacagtgtgcctggctgatgctgacaagaagatggctgtggccaccctggccagcgagaccctgcccctgctggccctgaccttcatcacagacaacagcctggtggccgccggccatgactgcttccctgtgctcttcacctatgatgctgctgctggcatgctgagctttggaggccgcctggatgtgcccaagcagagcagccagaggggcctgacagcccgggagcgcttccagaacctggacaagaaggccagcagcgagggcggcacagctgctggagctggcctggacagcctgcacaagaacagcgtgtcccagatctctgtgctgagcggcggcaaggccaagtgcagccagttctgcaccaccggcatggatggcggcatgagcatctgggatgtgaagagcctggagagcgccctgaaggacctgaagatcaagtag

SEQ ID NO: 142294 - DNA, 309 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgtag

SEQ ID NO: 142295 - DNA, 393 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgcgctgggccccaaatgaaaacaagtttgctgtgggcagcggcagcagggtcatcagcatctgctactttgagcaggagaatgactag

SEQ ID NO: 142296 - DNA, 252 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggctag

SEQ ID NO: 142297 - DNA, 402 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgcgctgggccccaaatgaaaacaagtttgctgtgggcagcggcagcagggtcatcagcatctgctactttgagcaggagaatgactggtgggtgtag

SEQ ID NO: 142298 - DNA, 66 bp, Artificial Sequence
  Description of Artificial Sequence: Synthetic coding sequence
atggcctaccacagcttcctggtggagcccatcagctgccacgcctggaacaaggacagaacatag

SEQ ID NO: 142299 - DNA, 402 bp, Artificial Sequence; identical to SEQ ID NO: 142297
  Description of Artificial Sequence: Synthetic coding sequence

SEQ ID NO: 142300 - DNA, 327 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgcgctgggccccaaatgaatag

SEQ ID NO: 142301 - DNA, 1119 bp, Artificial Sequence; identical to SEQ ID NO: 142293
  Description of Artificial Sequence: Synthetic coding sequence

SEQ ID NO: 142302 - DNA, 387 bp, Artificial Sequence
  Description of Artificial Sequence: Synthetic coding sequence
atggcctaccacagcttcctggtggagcccatcagctgccacgcctggaacaaggacaggacccagatcgccatctgccccaacaaccacgaggtgcacatctatgagaagagcggggccaagtggaccaaggtgcatgagctgaaggagcacaacggccaggtgacaggcatcgactgggcccctgagagcaacagaattgtgacctgtggcacagacagaaatgcctacgtgtggaccctgaagggccgcacctggaagcccaccctggtgatcctgcgcatcaacagagctgcccgctgtgtgcgctgggccccaaatgaaaacaagtttgctgtgggcagcggcagcagggtcatcagcatctgctactttgagcaggagtag

SEQ ID NO: 142303 - DNA, 402 bp, Artificial Sequence; identical to SEQ ID NO: 142297
  Description of Artificial Sequence: Synthetic coding sequence

SEQ ID NO: 142304 - DNA, 903 bp, Artificial Sequence
  Description of Artificial Sequence: Synthetic coding sequence
atgatcctgctggaggtgaacaaccgcatcatcgaggagaccctggccctgaagtttgaaaatgctgctgctggcaacaagccagaggccgtggaggtgacctttgctgactttgatggagtgctgtaccacatcagcaaccccaatggagacaagaccaaggtgatggtgtccatcagcctgaagttctacaaggagctgcaggcccacggggctgatgagctgctgaagagggtgtatggcagcttcctggtgaaccctgagagcggctacaacgtgtccctgctgtatgacctggagaacctgcctgccagcaaggacagcatcgtgcaccaggccggcatgctgaagaggaactgctttgcctctgtgtttgagaagtacttccagttccaggaggagggcaaggagggagaaaatagagctgtgatccactacagagatgatgagaccatgtatgtggagagcaagaaggacagagtgacagtggtgttcagcacagtgttcaaggatgatgatgatgtggtgattggcaaggtgttcatgcaggagttcaaggagggcagaagagccagccacacagccccccaggtgctcttcagccaccgggagccccccctggagctgaaggacacagatgctgctgtgggggacaacatcggctacatcacctttgtgctcttccccaggcacaccaatgccagcgcccgggacaacaccatcaacctgatccacaccttccgggactacctgcactaccacatcaagtgcagcaaggcctacatccacaccaggatgagggccaagaccagtgacttcctgaaggtgctgaacagagcccggccagatgctgagaagaaggagatgaagaccatcaccgggaagaccttcagcagcaggtag

SEQ ID NO: 142305 - DNA, 903 bp, Artificial Sequence; identical to SEQ ID NO: 142304
  Description of Artificial Sequence: Synthetic coding sequence

SEQ ID NO: 142306 - DNA, 273 bp, Artificial Sequence
  Description of Artificial Sequence: Synthetic coding sequence
atgatcctgctggaggtgaacaaccgcatcatcgaggagaccctggccctgaagtttgaaaatgctgctgctggcaacaagccagaggccgtggaggtgacctttgctgactttgatggagtgctgtaccacatcagcaaccccaatggagacaagaccaaggtgatggtgtccatcagcctgaagttctacaaggagctgcaggcccacggggctgatgagctgctgaagagggtgtatggcagcttcctggtgaaccctgagagcggctag

SEQ ID NO: 142307 - DNA, 864 bp, Artificial Sequence
  Description of Artificial Sequence: Synthetic coding sequence
atgtgtgatgaagatgagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacaccttctacaatgagctgcgggtggcccctgaggagcaccccaccctgctgacagaggcccccctgaaccccaaggccaaccgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgatgtctgggggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcaccaagcaggagtatgatgaagctggccccagcatcgtgcacaggaagtgcttctag

SEQ ID NO: 142308 - DNA, 765 bp, Artificial Sequence
  Description of Artificial Sequence: Synthetic coding sequence
atgtgtgatgaagatgagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacaccttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggcatcatgaagtgtgacatcgacatcaggaaggacctgtatgccaacaacgtgatgtctgggggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcaccaagcaggagtatgatgaggccggccccagcatcgtgcacaggaagtgcttctag

SEQ ID NO: 142309 - DNA, 1029 bp, Artificial Sequence
  Description of Artificial Sequence: Synthetic coding sequence
atgtgtgatgaagatgagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaaggccaaccgggagaagatgacccagatcatgtttgagaccttcaacgtgcctgccatgtatgtggccatccaggccgtgctgagcctgtatgccagcggccgcaccaccggcatcgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgatgtctgggggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcaccaagcaggagtatgatgaggccggccccagcatcgtgcacaggaagtgcttctag

SEQ ID NO: 142310 - DNA, 870 bp, Artificial Sequence
  Description of Artificial Sequence: Synthetic coding sequence
atgtgtgatgaagatgagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacaccttctacaatgagctgcgggtggcccctgaggagcaccccaccctgctgacagaggcccccctgaaccccaaggccaaccctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgatgtctgggggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcaccaagcaggagtatgatgaagctggccccagcatcgtgcacaggaagtgcttctag

SEQ ID NO: 142311 - DNA, 1134 bp, Artificial Sequence
  Description of Artificial Sequence: Synthetic coding sequence
atgtgtgatgaagatgagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacaccttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgatgtctgggggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcaccaagcaggagtatgatgaagctggccccagcatcgtgcacaggaagtgcttctag

SEQ ID NO: 142312 - DNA, 1146 bp, Artificial Sequence
  Description of Artificial Sequence: Synthetic coding sequence
atggcccctggagagaaggagagcggggagggccctgccaagagcgccctgaggaagatcagaacagccaccctggtgatcagcctggcccggggctggcagcagtgggccaatgaaaattccatccggcaggcccaggagcccaccggctggctgcccggcggcacccaggacagcccccaggcccccaagcccatcaccccacccaccagccaccagaaggcccagagcgcccccaagagccccccccggctgcctgagggccatggagatggccagagcagcgagaaggcccctgaggtgagccacatcaagaagaaggaggtgtccaagacagtggtgtccaagacctatgaaagaggaggagatgtgagccacctgagccacagatatgaaagagatgctggggtgctggagcccggccagccagaaaatgacatcgaccgcatcctgcacagccacggcagccccaccaggaggaggaaatgtgccaacctggtgtctgagctgaccaagggctggagggtgatggagcaggaggagcccacctggaggagtgacagcgtggacacagaggacagcggctacggcggggaggccgaggagaggcctgagcaggatggagtgcaggtggccgtggtgcgcatcaagaggcccctgcccagccaggtgaaccgcttcacagagaagctgaactgcaaggcccagcagaagtacagccctgtgggcaacctgaagggccgctggcagcagtgggcagatgagcacatccagagccagaagctgaaccccttcagcgaggagtttgattatgagctggccatgagcacccggctgcacaagggagatgagggctacggccggcccaaggagggcaccaagacagctgagcgggccaagagagctgaggagcacatctaccgggagatgatggacatgtgcttcatcatctgcaccatggcccggcacagaagagatggcaagatccaggtgacctttggagacctgtttgaccgctacgtgcgcatcagtgacaaggtggtgggcatcctgatgagggccaggaagcacggcctggtggactttgaaggagagatgctgtggcagggcagagatgaccacgtggtgatcaccctgctgaagtag

SEQ ID NO: 142313 - DNA, 2685 bp, Artificial Sequence
  Description of Artificial Sequence: Synthetic coding sequence
atgaaccagatcgagcccggggtgcagtacaactacgtgtatgatgaagatgagtacatgatccaggaggaggagtgggaccgggacctgctgctggaccctgcctgggagaagcagcagaggaagaccttcaccgcctggtgcaacagccacctgaggaaggccggcacccagatcgagaacatcgaggaggacttcagaaatggcctgaagctgatgctgctgctggaggtgatcagcggggagcggctgcccaagccagaccggggcaagatgaggttccacaagatcgccaacgtgaacaaggccctggactacatcgccagcaagggcgtgaagctggtgtccattggagctgaggagatcgtggatggaaatgtgaagatgaccctgggcatgatctggaccatcatcctgcgctttgccatccaggacatctctgtggaggagaccagcgccaaggagggcctgctgctgtggtgccagaggaagacagccccctacagaaatgtgaacatccagaacttccacacctcctggaaggatggcctgggcctgtgtgccctgatccaccgccacaggccagacctgattgactacagcaagctgaacaaggatgaccccatcggcaacatcaacctggccatggagattgctgagaagcacctggacatccccaagatgctggatgctgaggacatcgtgaacacccccaagccagatgagcgggccatcatgacctacgtgtcctgcttctaccacgcctttgctggagctgagcaggccgagacagctgccaaccgcatctgcaaggtgctggccgtgaaccaggagaatgaaaggctgatggaggagtatgaaaggctggccagcgagctgctggagtggatccggaggaccatcccctggctggagaacagaacacctgagaagaccatgcaggccatgcagaagaagctggaggacttccgggactacagaaggaagcacaagccacccaaggtgcaggagaagtgccagctggagatcaacttcaacaccctgcagaccaagctgcgcatcagcaacagacctgccttcatgcccagcgagggcaagatggtgtctgacattgctggggcctggcagaggctggagcaggccgagaagggctatgaggagtggctgctgaatgagatccggcggctggagcggctggagcacctggccgagaagttccggcagaaggccagcacccatgagacctgggcctacggcaaggagcagatcctgctgcagaaggactatgaaagtgccagcctgacagaggtgcgggccctgctgaggaagcatgaggcctttgaaagtgacctggccgcccaccaggacagagtggagcagattgctgccatcgcccaggagctgaatgagctggactaccatgatgctgtgaatgtgaatgaccgctgccagaagatctgtgaccagtgggaccggctgggcaccctgacccagaagaggcgggaggccctggagaggatggagaagctgctggagaccatcgaccagctgcacctggagtttgccaagagagctgcccccttcaacaactggatggagggcgccatggaggacctgcaggacatgttcatcgtgcacagcattgaggagatccagagcctcatcacagcccacgagcagttcaaggccaccctgcctgaggctgatggagagcggcagagcatcatggccatccagaatgaggtggagaaggtgatccagagctacaacatccgcatcagcagcagcaacccctacagcacagtgaccatggatgagctgcggaccaagtgggacaaggtgaagcagctggtgcccatccgggaccagagcctgcaggaggagctggcccggcagcacgccaatgaaaggctgcggcggcagtttgctgcccaggccaatgccatcggcccctggatccagaacaagatggaggagatcgcccggagcagcatccagatcaccggggccctggaggaccagatgaaccagctgaagcagtatgagcacaacatcatcaactacaagaacaacatcgacaagctggagggggaccaccagctgatccaggaggccctggtgtttgacaacaagcacaccaactacaccatggagcacatccgggtgggctgggagctgctgctgaccaccatcgcccggaccatcaatgaggtggagacccagatcctgaccagagatgccaagggcatcacccaggagcagatgaatgagttccgggccagcttcaaccactttgacaggaggaagaatggcctgatggaccacgaggacttccgggcctgcctgatctccatgggctatgacctgggggaggccgagtttgcccgcatcatgaccctggtggaccccaacggccagggcaccgtgaccttccagagcttcatcgacttcatgacccgggagacagctgacacagacacagctgagcaggtgattgccagcttccgcatcctggccagtgacaagccctacatcctggccgaggagctgcggcgggagctgcccccagaccaggcccagtactgcatcaagaggatgcctgcctacagcggccctggctctgtgcctggggccctggactatgctgccttcagcagcgccctgtatggagagagtgacctgtag

SEQ ID NO: 142314 - DNA, 2685 bp, Artificial Sequence
  Description of Artificial Sequence: Synthetic coding sequence
atgaaccagatcgagcccggggtgcagtacaactacgtgtatgatgaagatgagtacatgatccaggaggaggagtgggaccgggacctgctgctggaccctgcctgggagaagcagcagaggaagaccttcaccgcctggtgcaacagccacctgaggaaggccggcacccagatcgagaacatcgaggaggacttcagaaatggcctgaagctgatgctgctgctggaggtgatcagcggggagcggctgcccaagccagaccggggcaagatgaggttccacaagatcgccaacgtgaacaaggccctggactacatcgccagcaagggcgtgaagctggtgtccattggagctgaggagatcgtggatggaaatgtgaagatgaccctgggcatgatctggaccatcatcctgcgctttgccatccaggacatctctgtggaggagaccagcgccaaggagggcctgctgctgtggtgccagaggaagacagccccctacagaaatgtgaacatccagaacttccacacctcctggaaggatggcctgggcctgtgtgccctgatccaccgccacaggccagacctgattgactacagcaagctgaacaaggatgaccccatcggcaacatcaacctggccatggagattgctgagaagcacctggacatccccaagatgctggatgctgaggacctggtgtacacagcccggccagatgagcgggccatcatgacctacgtgtcctgctactaccacgcctttgctggggcccagaaggccgagacagctgccaaccgcatctgcaaggtgctggccgtgaaccaggagaatgaaaggctgatggaggagtatgaaaggctggccagcgagctgctggagtggatccggaggaccatcccctggctggagaacagaacacctgagaagaccatgcaggccatgcagaagaagctggaggacttccgggactacagaaggaagcacaagccacccaaggtgcaggagaagtgccagctggagatcaacttcaacaccctgcagaccaagctgcgcatcagcaacagacctgccttcatgcccagcgagggcaagatggtgtctgacattgctggggcctggcagaggctggagcaggccgagaagggctatgaggagtggctgctgaatgagatccggcggctggagcggctggagcacctggccgagaagttccggcagaaggccagcacccatgagacctgggcctacggcaaggagcagatcctgctgcagaaggactatgaaagtgccagcctgacagaggtgcgggccctgctgaggaagcatgaggcctttgaaagtgacctggccgcccaccaggacagagtggagcagattgctgccatcgcccaggagctgaatgagctggactaccatgatgctgtgaatgtgaatgaccgctgccagaagatctgtgaccagtgggaccggctgggcaccctgacccagaagaggcgggaggccctggagaggatggagaagctgctggagaccatcgaccagctgcacctggagtttgccaagagagctgcccccttcaacaactggatggagggcgccatggaggacctgcaggacatgttcatcgtgcacagcattgaggagatccagagcctcatcacagcccacgagcagttcaaggccaccctgcctgaggctgatggagagcggcagagcatcatggccatccagaatgaggtggagaaggtgatccagagctacaacatccgcatcagcagcagcaacccctacagcacagtgaccatggatgagctgcggaccaagtgggacaaggtgaagcagctggtgcccatccgggaccagagcctgcaggaggagctggcccggcagcacgccaatgaaaggctgcggcggcagtttgctgcccaggccaatgccatcggcccctggatccagaacaagatggaggagatcgcccggagcagcatccagatcaccggggccctggaggaccagatgaaccagctgaagcagtatgagcacaacatcatcaactacaagaacaacatcgacaagctggagggggaccaccagctgatccaggaggccctggtgtttgacaacaagcacaccaactacaccatggagcacatccgggtgggctgggagctgctgctgaccaccatcgcccggaccatcaatgaggtggagacccagatcctgaccagagatgccaagggcatcacccaggagcagatgaatgagttccgggccagcttcaaccactttgacaggaggaagaatggcctgatggaccacgaggacttccgggcctgcctgatctccatgggctatgacctgggggaggccgagtttgcccgcatcatgaccctggtggaccccaacggccagggcaccgtgaccttccagagcttcatcgacttcatgacccgggagacagctgacacagacacagctgagcaggtgattgccagcttccgcatcctggccagtgacaagccctacatcctggccgaggagctgcggcgggagctgcccccagaccaggcccagtactgcatcaagaggatgcctgcctacagcggccctggctctgtgcctggggccctggactatgctgccttcagcagcgccctgtatggagagagtgacctgtag

SEQ ID NO: 142315 - DNA, 1992 bp, Artificial Sequence
  Description of Artificial Sequence: Synthetic coding sequence
agcaccctgagctctgtggagggccccccagagagcagcacctgcagctaccaggagatgagaagaagctctgtgaacagcagcgccatggccgagacagctgccaaccgcatctgcaaggtgctggccgtgaaccaggagaatgaaaggctgatggaggagtatgagcggctggccagcgagctgctggagtggatccggaggaccatcccctggctggagaacagaacacctgagaagaccatgcaggccatgcagaagaagctggaggacttccgggactacagaaggaagcacaagccacccaaggtgcaggagaagtgccagctggagatcaacttcaacaccctgcagaccaagctgcgcatcagcaacagacctgccttcatgcccagcgagggcaagatggtgtctgacattgctggggcctggcagaggctggagcaggccgagaagggctatgaggagtggctgctgaatgagatccggcggctggagcggctggagcacctggccgagaagttccggcagaaggccagcacccatgagacctgggcctacggcaaggagcagatcctgctgcagaaggactatgagagcgccagcctgacagaggtgcgggccctgctgaggaagcatgaggcctttgaaagtgacctggccgcccaccaggacagagtggagcagattgctgccatcgcccaggagctgaatgagctggactaccatgatgctgtgaatgtgaatgaccgctgccagaagatctgtgaccagtgggaccggctgggcaccctgacccagaagagaagagaggccctggagaggatggagaagctgctggagaccatcgaccagctgcacctggagtttgccaagagagctgcccccttcaacaactggatggagggcgccatggaggacctgcaggacatgtttattgtgcacagcattgaggagatccagagcctcatcacagcccacgagcagttcaaggccaccctgcctgaggctgatggagagcggcagagcatcatggccatccagaatgaggtggagaaggtgatccagagctacaacatccgcatcagcagcagcaacccctacagcacagtgaccatggatgagctgcggaccaagtgggacaaggtgaagcagctggtgcccatccgggaccagagcctgcaggaggagctggcccggcagcacgccaatgaaaggctgcggcggcagtttgctgcccaggccaatgccatcggcccctggatccagaacaagatggaggagatcgcccggagcagcatccagatcactggagccctggaggaccagatgaaccagctgaagcagtatgagcacaacatcatcaactacaagaacaacatcgacaagctggagggggaccaccagctgatccaggaggccctggtgtttgacaacaagcacaccaactacaccatggagcacatccgggtgggctgggagctgctgctgaccaccatcgcccggaccatcaatgaggtggagacccagatcctgaccagagatgccaagggcatcacccaggagcagatgaatgagttccgggccagcttcaaccactttgacaggaggaagaatggcctgatggaccacgaggacttccgggcctgcctgatctccatgggctatgacctgggggaggccgagtttgcccgcatcatgaccctggtggaccccaacggccagggcaccgtgaccttccagagcttcatcgacttcatgacccgggagacagctgacacagacacagctgagcaggtgattgccagcttccgcatcctggccagtgacaagccctacatcctggccgaggagctgcggcgggagctgcccccagaccaggcccagtactgcatcaagaggatgcctgcctacagcggccctggctctgtgcctggggccctggactatgctgccttcagcagcgccctgtatggagagagtgacctgtag

SEQ ID NO: 142316 - DNA, 1167 bp, Artificial Sequence
  Description of Artificial Sequence: Synthetic coding sequence
atggagaagctgctggagaccatcgaccagctgcacctggagtttgccaagagagctgcccccttcaacaactggatggagggcgccatggaggacctgcaggacatgttcatcgtgcacagcattgaggagatccagagcctcatcacagcccacgagcagttcaaggccaccctgcctgaggctgatggagagcggcagagcatcatggccatccagaatgaggtggagaaggtgatccagagctacaacatccgcatcagcagcagcaacccctacagcacagtgaccatggatgagctgcggaccaagtgggacaaggtgaagcagctggtgcccatccgggaccagagcctgcaggaggagctggcccggcagcacgccaatgaaaggctgcggcggcagtttgctgcccaggccaatgccatcggcccctggatccagaacaagatggaggagatcgcccggagcagcatccagatcaccggggccctggaggaccagatgaaccagctgaagcagtatgagcacaacatcatcaactacaagaacaacatcgacaagctggagggggaccaccagctgatccaggaggccctggtgtttgacaacaagcacaccaactacaccatggagcacatccgggtgggctgggagctgctgctgaccaccatcgcccggaccatcaatgaggtggagacccagatcctgaccagagatgccaagggcatcacccaggagcagatgaatgagttccgggccagcttcaaccactttgacaggaggaagaatggcctgatggaccacgaggacttccgggcctgcctgatctccatgggctatgacctgggggaggccgagtttgcccgcatcatgaccctggtggaccccaacggccagggcaccgtgaccttccagagcttcatcgacttcatgacccgggagacagctgacacagacacagctgagcaggtgattgccagcttccgcatcctggccagtgacaagccctacatcctggccgaggagctgcggcgggagctgcccccagaccaggcccagtactgcatcaagaggatgcctgcctacagcggccctggctctgtgcctggggccctggactatgctgccttcagcagcgccctgtatggagagagtgacctgtag

SEQ ID NO: 142317 - DNA, 1131 bp, Artificial Sequence
  Description of Artificial Sequence: Synthetic coding sequence
atgttcaacccccacgccctggatgtgcctgctgtgatctttgacaatggcagcggcctgtgcaaggccggcctgagcggggagatcggccccaggcatgtgatcagctctgtgctgggccactgcaagttcaacgtgcccctggcccggctgaaccagaagtactttgtgggccaggaggccctgtacaagtatgaggccctgcacctgcactaccccatcgagcggggcctggtgacaggctgggatgacatggagaagctgtggaagcacctgtttgagcgggagctgggcgtgaagcccagccagcagcctgtgctgatgacagagcccagcctgaacccccgggagatccgggagaagctggccgagatgatgtttgagaccttctctgtgcccggcttctacctgagcaaccacgctgtggccgccctgtatgccagcgcctgtgtgacaggcctggtggtggacagcggagatggagtgacctgcaccgtgcccatctttgagggctacagcctgccccatgctgtgaccaagctgtgcatggccggccgggacatcacagagcacctgacccggctgctgtttgccagcggcttcaacttcccctgcatcctgaacaaggctgtggtgaacaacatcaaggagaagctgtgctacatcgccctggagcctgagaaggagctgaggaagagcagaggagaggtgctgggcgcctaccgcctgcctgatggccacgtgatccactttggagatgagctgtaccaggtgcctgaggtgctgtttgccccagaccagctgggcatccacagccctggcctgagcaagatggtgagcagcagcatcatgaagtgtgacacagacatccagaacaagctgtatgctgacatcgtgctgagcggcggcaccaccctgctgcccggcctggaggagcggctgatgaaggaggtggagcagctggccagcaagggcacccccatcaagatcacagccagcccagaccgctgcttcagcgcctggattggagccagcatcatgacctccatgagcagcttcaagcagatgtgggtgaccagcgctgacttcaaggagtatggcacctctgtggtgcagaggcgctgcttctag

SEQ ID NO: 142318 - DNA, 1134 bp, Artificial Sequence
  Description of Artificial Sequence: Synthetic coding sequence
atgttcaacccccacgccctggacagccctgctgtgatctttgacaatggcagcggcttctgcaaggccggcctgagcggggagtttggccccaggcacatggtgagcagcatcgtgggccacctgaagttccaggcccccagcgctgaggccaaccagaagaagtactttgtgggggaggaggccctgtacaagcaggaggccctgcagctgcacagcccctttgagcggggcctcatcaccggctgggatgatgtggagcggctgtggaagcacctgtttgagtgggagctgggcgtgaagcccagcgaccagcccctgctggccacagagcccagcctgaacccccgggagaaccgggagaagatggccgaggtgatgtttgaaaattttggagtgcctgccttctacctgagtgaccaggccgtgctggccctgtatgccagcgcctgtgtgacaggcctggtggtggacagcggagatgctgtgacctgcaccgtgcccatctttgagggctacagcctgccccatgctgtgaccaagctgcacgtggccggccgggacatcacagagctgctgatgcagctgctgctggccagcggccacaccttcccctgccagctggacaagggcctggtggatgacatcaagaagaagctgtgctacgtggccctggagcctgagaaggagctgagcagaagacctgaggaggtgctgcgggagtacaagctgcctgatggcaacatcatcagcctgggggaccccctgcaccaggcccctgaggccctgtttgtgccccagcagctgggcagccagagccctggcctgagcaacatggtgagcagcagcatcaccaagtgtgacacagacatccagaagatcctgtttggagaaattgtgctgagcggcggcaccaccctcttccacggcctggatgaccggctgctgaaggagctggagcagctggccagcaaggacacccccatcaagatcacagcccccccagaccgctggttcagcacctggattggagccagcatcgtgaccagcctgagcagcttcaagcagatgtgggtgacagctgctgacttcaaggagtttggcacctctgtggtgcagaggcgctgcttctag

SEQ ID NO: 142319 - DNA, 987 bp, Artificial Sequence
  Description of Artificial Sequence: Synthetic coding sequence
atgttcaacccccacgccctggacagccctgctgtgatctttgacaatggcagcggcttctgcaaggccggcctgagcggggagtttggccccaggcacatggtgagcagcatcgtgggccacctgaagttccaggcccccagcgctgaggccaaccagaagaagtactttgtgggggaggaggccctgtacaagcaggaggccctgcagctgcacagcccctttgagcggggcctcatcaccggctgggatgatgtggagcggctgtggaagcacctgtttgagtgggagctgggcgtgaagcccagcgaccagcccctgctggccacagagcccagcctgaacccccgggagaaccgggagaagatggccgaggtgatgtttgaaaattttggagtgcctgccttctacctgagtgaccaggccgtgctggccctgtatgccagcgcctgtgtgacaggcctggtggtggacagcggagatgctgtgacctgcaccgtgcccatctttgagggctacagcctgccccatgctgtgaccaagctgcacgtggccggccgggacatcacagagctgctgatgcagctgctgctggccagcggccacaccttcccctgccagctggacaagggcctggtggatgacatcaagaagaagctgtgctacgtggccctggagcctgagaaggagctgagcagaagacctgaggaggtgctgcgggagtacaagctgcctgatggcaacatcatcagcctgggggaccccctgcaccaggcccctgaggccctgtttgtgccccagcagctgggcagccagagccctggcctgagcaacatggtgagcagcagcatcaccaagtgtgacacagacatccagaagatcctgtttggagaaattgtgctgagcggcggcaccaccctcttccacggcctggatgaccggctgctgcacctggactggagcctgcaccgccacctgtctgagtag

SEQ ID NO: 142320 - DNA, 1752 bp, Artificial Sequence
  Description of Artificial Sequence: Synthetic coding sequence
atggagagcaagggggccagcagctgccgcctgctcttctgcctgctgatcagcgccaccgtcttccggcccggcctgggctggtacacagtgaacagcgcctatggagacaccatcatcatcccctgccgcctggatgtgccccagaacctgatgtttgggaagtggaagtatgagaagccagatggcagccctgtgttcatcgccttccgcagcagcaccaagaagtctgtgcagtatgatgatgtgcctgagtacaaggaccggctgaacctgtctgagaactacaccctgagcatcagcaatgcccgcatcagtgatgagaagagatttgtgtgcatgctggtgacagaggacaacgtgtttgaggcccccaccatcgtgaaggtgttcaagcagcccagcaagccagaaattgtgtccaaggccctcttcctggagacagagcagctgaagaagctgggggactgcatcagcgaggacagctacccagatggcaacatcacctggtacagaaatggcaaggtgctgcaccccctggagggcgctgtggtgatcatcttcaagaaggagatggaccctgtgacccagctgtacaccatgaccagcaccctggagtacaagaccaccaaggctgacatccagatgcccttcacctgcagcgtgacctactacggccccagcggccagaagaccatccacagcgagcaggccgtgtttgacatctactaccccacagagcaggtgaccatccaggtgctgccccccaagaatgccatcaaggagggggacaacatcaccctgaagtgcctgggcaatggaaaccccccacctgaggagttcctgttctacctgcccggccagcctgagggcatccgcagcagcaacacctacaccctgacagatgtgagaagaaatgccaccggggactacaagtgcagcctgattgacaagaagtccatgattgccagcacagccatcaccgtgcactacctggacctgagcctgaaccccagcggggaggtgacccggcagattggagatgccctgcctgtgtcctgcaccatcagcgccagcagaaatgccaccgtggtgtggatgaaggacaacatccggctgcggagcagccccagcttcagcagcctgcactaccaggatgctggcaactacgtgtgtgaaacagccctgcaggaggtggagggcctgaagaagcgggagagcctgaccctgattgtggagggcaagccccagatcaagatgaccaagaagacagaccccagcggcctgagcaagaccatcatctgccacgtggagggcttccccaagccagccatccagtggaccatcaccggcagcggcagcgtcatcaaccagacagaggagagcccctacatcaatggccgctactacagcaagatcatcatcagcccagaagaaaatgtgaccctgacctgcacagctgagaaccagctggagaggacagtgaacagcctgaatgtgtctgccatcagcatccctgagcatgatgaagcagatgagatcagtgatgaaaatcgggagaaggtgaatgaccaggccaagctgattgtgggcatcgtggtgggcctgctgctggccgccctggtggccggcgtggtgtactggctgtacatgaagaagagcaagacagccagcaagcacgtgaacaaggacctgggcaacatggaggagaacaagaagctggaggagaacaaccacaagacagaggcctag

SEQ ID NO: 142321 - DNA, 918 bp, Artificial Sequence
  Description of Artificial Sequence: Synthetic coding sequence
atggaccctgtgacccagctgtacaccatgaccagcaccctggagtacaagaccaccaaggctgacatccagatgcccttcacctgcagcgtgacctactacggccccagcggccagaagaccatccacagcgagcaggccgtgtttgacatctactacctggacctgagcctgaaccccagcggggaggtgacccggcagattggagatgccctgcctgtgtcctgcaccatcagcgccagcagaaatgccaccgtggtgtggatgaaggacaacatccggctgcggagcagccccagcttcagcagcctgcactaccaggatgctggcaactacgtgtgtgaaacagccctgcaggaggtggagggcctgaagaagcgggagagcctgaccctgattgtggagggcaagccccagatcaagatgaccaagaagacagaccccagcggcctgagcaagaccatcatctgccacgtggagggcttccccaagccagccatccagtggaccatcaccggcagcggcagcgtcatcaaccagacagaggagagcccctacatcaatggccgctactacagcaagatcatcatcagcccagaagaaaatgtgaccctgacctgcacagctgagaaccagctggagaggacagtgaacagcctgaatgtgtctgccatcagcatccctgagcatgatgaagcagatgagatcagtgatgaaaatcgggagaaggtgaatgaccaggccaagctgattgtgggcatcgtggtgggcctgctgctggccgccctggtggccggcgtggtgtactggctgtacatgaagaagagcaagacagccagcaagcacgtgaacaaggacctgggcaacatggaggagaacaagaagctggaggagaacaaccacaagacagaggcctag

SEQ ID NO: 142322 - DNA, 1035 bp, Artificial Sequence
  Description of Artificial Sequence: Synthetic coding sequence
tgactgggggactgcatcagcgaggacagctacccagatggcaacatcacctggtacagaaatggcaaggtgctgcaccccctggagggcgctgtggtgatcatcttcaagaaggagatggaccctgtgacccagctgtacaccatgaccagcaccctggagtacaagaccaccaaggctgacatccagatgcccttcacctgcagcgtgacctactacggccccagcggccagaagaccatccacagcgagcaggccgtgtttgacatctactacctggacctgagcctgaaccccagcggggaggtgacccggcagattggagatgccctgcctgtgtcctgcaccatcagcgccagcagaaatgccaccgtggtgtggatgaaggacaacatccggctgcggagcagccccagcttcagcagcctgcactaccaggatgctggcaactacgtgtgtgaaacagccctgcaggaggtggagggcctgaagaagcgggagagcctgaccctcatcgtggagggcaagccccagatcaagatgaccaagaagacagaccccagcggcctgagcaagaccatcatctgccacgtggagggcttccccaagccagccatccagtggaccatcactggaagtggcagcgtcatcaaccagacagaggagagcccctacatcaatggccgctactacagcaagatcatcatcagccctgaggagaatgtgaccctgacctgcacagctgagaaccagctggagaggacagtgaacagcctgaatgtgtctgccatcagcatccctgagcatgatgaagcagatgagatcagtgatgagaaccgggagaaggtgaatgaccaggccaagctgattgtgggcatcgtggtgggcctgctgctggccgccctggtggccggcgtggtgtactggctgtacatgaagaagagcaagacagccagcaagcacgtgaacaaggacctgggcaacatggaggagaacaagaagctggaggagaacaaccacaagacagaggcctag

SEQ ID NO: 142323 - DNA, 1713 bp, Artificial Sequence
  Description of Artificial Sequence: Synthetic coding sequence
atggagagcaagggggccagcagctgccgcctgctcttctgcctgctgatcagcgccaccgtcttccggcccggcctgggctggtacacagtgaacagcgcctatggagacaccatcatcatcccctgccgcctggatgtgccccagaacctgatgtttgggaagtggaagtatgagaagccagatggcagccctgtgttcatcgccttccgcagcagcaccaagaagtctgtgcagtatgatgatgtgcctgagtacaaggaccggctgaacctgtctgagaactacaccctgagcatcagcaatgcccgcatcagtgatgagaagagatttgtgtgcatgctggtgacagaggacaacgtgtttgaggcccccaccatcgtgaaggtgttcaagcagcccagcaagccagaaattgtgtccaaggccctcttcctggagacagagcagctgaagaagctgggggactgcatcagcgaggacagctacccagatggcaacatcacctggtacagaaatggcaaggtgctgcaccccctggagggcgctgtggtgatcatcttcaagaaggagatggaccctgtgacccagctgtacaccatgaccagcaccctggagtacaagaccaccaaggctgacatccagatgcccttcacctgcagcgtgacctactacggccccagcggccagaagaccatccacagcgagcaggccgtgtttgacatctactaccccacagagcaggtgaccatccaggtgctgccccccaagaatgccatcaaggagggggacaacatcaccctgaagtgcctgggcaatggaaaccccccacctgaggagttcctgttctacctgcccggccagcctgagggcatccgcagcagcaacacctacaccctgacagatgtgagaagaaatgccaccggggactacaagtgcagcctgattgacaagaagtccatgattgccagcacagccatcaccgtgcactacctggacctgagcctgaaccccagcggggaggtgacccggcagattggagatgccctgcctgtgtcctgcaccatcagcgccagcagaaatgccaccgtggtgtggatgaaggacaacatccggctgcggagcagccccagcttcagcagcctgcactaccaggatgctggcaactacgtgtgtgaaacagccctgcaggaggtggagggcctgaagaagcgggagagcctgaccctgattgtggagggcaagccccagatcaagatgaccaagaagacagaccccagcggcctgagcaagaccatcatctgccacgtggagggcttccccaagccagccatccagtggaccatcaccggcagcggcagcgtcatcaaccagacagaggagagcccctacatcaatggccgctactacagcaagatcatcatcagcccagaagaaaatgtgaccctgacctgcacagctgagaaccagctggagaggacagtgaacagcctgaatgtgtctgccaatgaaaatcgggagaaggtgaatgaccaggccaagctgattgtgggcatcgtggtgggcctgctgctggccgccctggtggccggcgtggtgtactggctgtacatgaagaagagcaagacagccagcaagcacgtgaacaaggacctgggcaacatggaggagaacaagaagctggaggagaacaaccacaagacagaggcctag

SEQ ID NO: 142324 - DNA, 1074 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaagcacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgcgcttccaggaggaggtgctggccaagtgcagcatggaccatggagtggacagcagcatcttccagaaccccaagaagctgcacctgaccatcggcatgctggtgctgctgtctgaggaggagatccagcagacctgtgagatgctgcagcagtgcaaggaggagttcatcaatgacatcagcggcggcaagcccctggaggtggagatggccggcatcgagtacatgaatgatgatcctggcatggtggatgtgctgtatgccaaggtgcacatgaaggatggcagcaaccggctgcaggagctggtggacagagtgctggagcgcttccaggccagcggcctgattgtgaaggagtggaacagcgtgaagctgcacgccaccgtgatgaacaccctcttcaggaaggaccccaatgctgagggccgctacaacctgtacacagctgagggcaagtacatcttcaaggagcgggagagctttgatggaagaaacatcctgaagctgtttgagaacttctacttcggcagcctgaagctgaacagcatccacatcagccagcgcttcaccgtggacagctttggaaattatgccagctgtggccagattgacttctcctag

SEQ ID NO: 142325 - DNA, 1074 bp, Artificial Sequence; identical to SEQ ID NO: 142324
  Description of Artificial Sequence: Synthetic coding sequence

SEQ ID NO: 142326 - DNA, 1203 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaacctgatccacctgaacaccagcaatgactgtggcttccagaagatcaccctggactgccagaacatctacacctggaagagccgccacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgcgcttccaggaggaggtgctggccaagtgcagcatggaccatggagtggacagcagcatcttccagaaccccaagaagctgcacctgaccatcggcatgctggtgctgctgtctgaggaggagatccagcagacctgtgagatgctgcagcagtgcaaggaggagttcatcaatgacatcagcggcggcaagcccctggaggtggagatggccggcatcgagtacatgaatgatgatcctggcatggtggatgtgctgtatgccaaggtgcacatgaaggatggcagcaaccggctgcaggagctggtggacagagtgctggagcgcttccaggccagcggcctgattgtgaaggagtggaacagcgtgaagctgcacgccaccgtgatgaacaccctcttcaggaaggaccccaatgctgagggccgctacaacctgtacacagctgagggcaagtacatcttcaaggagcgggagagctttgatggaagaaacatcctgaagagctttgccctgctgccccggctggagtacaatgatgccatcagcgcccactgcaacctgtgcctgcccggcagcagtgacagccctgccagcgccagccaggtggccggcatcaccggggtgtctgatgcctacagccagagcctgcccgggaagagctag

SEQ ID NO: 142327 - DNA, 1074 bp, Artificial Sequence; identical to SEQ ID NO: 142324
  Description of Artificial Sequence: Synthetic coding sequence

SEQ ID NO: 142328 - DNA, 1203 bp, Artificial Sequence; identical to SEQ ID NO: 142326
  Description of Artificial Sequence: Synthetic coding sequence

SEQ ID NO: 142329 - DNA, 1074 bp, Artificial Sequence; identical to SEQ ID NO: 142324
  Description of Artificial Sequence: Synthetic coding sequence

SEQ ID NO: 142330 - DNA, 879 bp, Artificial Sequence
  Description of Artificial Sequence: Synthetic coding sequence
tgatacaagcacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgcgcttccaggaggaggtgctggccaagtgcagcatggaccatggagtggacagcagcatcttccagaaccccaagaagctgcacctgaccatcggcatgctggtgctgctgtctgaggaggagatccagcagacctgtgagatgctgcagcagtgcaaggaggagttcatcaatgacatcagcggcggcaagcccctggaggtggagatggccggcatcgagtacatgaatgatgatcctggcatggtggatgtgctgtatgccaaggtgcacatgaaggatggcagcaaccggctgcaggagctggtggacagagtgctggagcgcttccaggccagcggcctgattgtgaaggagtggaacagcgtgaagctgcacgccaccgtgatgaacaccctcttcaggaaggaccccaatgctgagggccgctacaacctgtacacagctgagggcaagtacatcttcaaggagcgggagagctttgatggaagaaacatcctgaagagctttgccctgctgccccggctggagtacaatgatgccatcagcgcccactgcaacctgtgcctgcccggcagcagtgacagccctgccagcgccagccaggtggccggcatcaccgtggtgtag

SEQ ID NO: 142331 - DNA, 828 bp, Artificial Sequence
  Description of Artificial Sequence: Synthetic coding sequence
atggagaccaagaccagcatcagcatccccaagccaggccaggatggagagatcgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgcgcttccaggaggaggtgctggccaagtgcagcatggaccacggcgtggacagcagcatcttccagaaccccaagaagctgcacctgaccatcggcatgctggtgctgctgtctgaggaggagatccagcagacctgtgagatgctgcagcagtgcaaggaggagttcatcaatgacatcagcggcggcaagcccctggaggtggagatggccggcatcgagtacatgaatgatgaccccggcatggtggatgtgctgtatgccaaggtgcacatgaaggatggcagcaaccggctgcaggagctggtggacagagtgctggagcgcttccaggccagcggcctcatcgtgaaggagtggaacagcgtgaagctgcacgccaccgtgatgaacaccctcttcaggaaggaccccaatgctgagggccgctacaacctgtacacagctgagggcaagtacatcttcaaggagcgggagagctttgatggcaggaacatcctgaagagctttgccctgctgccccggctggagtacaatgatgccatcagcgcccactgcaacctgtgcctgcccggcagcagtgacagccctgccagcgccagccaggtggccggcatcaccgtggtgtag

SEQ ID NO: 142332 - DNA, 372 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaagcacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgtag

SEQ ID NO: 142333 - DNA, 312 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaagcacatcgtgggcaagagaggagacaccaggaagaagattgagatggagaccaagaccagcatcagcatccccaagccaggccaggatggagagatctag

SEQ ID NO: 142334 - DNA, 459 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaagcacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgaggtag

SEQ ID NO: 142335 - DNA, 171 bp, Artificial Sequence
  Description of Artificial Sequence: Synthetic coding sequence
atggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccctag

SEQ ID NO: 142336 - DNA, 1140 bp, Artificial Sequence
  Description of Artificial Sequence: Synthetic coding sequence
atgatgaagtacccaggcacctggccctgccagggcatcatcggcatcagctttggagagagcgtgatggaggtgctgcggccccagctgatcagaattgatggcaggaactacaggaagaaccctgtgcaggagcagacctaccagcacgaggaggatgaggaggacttctaccagggctccatggagtgtgctgatgagccctgtgatgcctatgaggtggagcagaccccccagggcttccgcagcaccctgcgggcccccagcctgctgtacaagcacatcgtgggcaagagaggagacaccaggaagaagattgagatggagaccaagaccagcatcagcatccccaagccaggccaggatggagaaattgtcatcaccggccagcacagaaatggagtcatcagcgcccggaccagaattgatgtgctgctggacaccttccggaggaagcagcccttcacccacttcctggccttcttcctgaatgaggtggaggtgcaggagggcttcctgcgcttccaggaggaggtgctggccaagtgcagcatggaccatggagtggacagcagcatcttccagaaccccaagaagctgcacctgaccatcggcatgctggtgctgctgtctgaggaggagatccagcagacctgtgagatgctgcagcagtgcaaggaggagttcatcaatgacatcagcggcggcaagcccctggaggtggagatggccggcatcgagtacatgaatgatgatcctggcatggtggatgtgctgtatgccaaggtgcacatgaaggatggcagcaaccggctgcaggagctggtggacagagtgctggagcgcttccaggccagcggcctgattgtgaaggagtggaacagcgtgaagctgcacgccaccgtgatgaacaccctcttcaggaaggaccccaatgctgagggccgctacaacctgtacacagctgagggcaagtacatcttcaaggagcgggagagctttgatggaagaaacatcctgaagctgtttgagaacttctacttcggcagcctgaagctgaacagcatccacatcagccagcgcttcaccgtggacagctttggaaattatgccagctgtggccagattgacttctcctag

SEQ ID NO: 142337 - DNA, 2274 bp, Artificial Sequence
  Description of Artificial Sequence: Synthetic coding sequence
atgcctgccctgcccctggaccagctgcagatcacccacaaggaccccaagacaggcaagctgcggaccagccctgccctgcaccctgagcagaaggctgaccgctactttgtgctgtacaagcccccacccaaggacaacatcccagccctggtggaggagtacctggagcgggccacctttgtggccaatgacctggactggctgctggccctgccccatgacaagttctggtgccaggtgatctttgatgagaccctgcagaagtgcctggacagctacctgcgctacgtgcccaggaagtttgatgaaggagtggccagcgcccctgaggtggtggacatgcagaagaggctgcacaggagcgtcttcctgaccttcctgaggatgagcacccacaaggagagcaaggaccacttcatcagccccagcgccttcggggagatcctgtacaacaacttcctgtttgacatccccaagatcctggacctgtgtgtgctgtttgggaagggcaacagccccctgctgcagaagatgattggcaacatcttcacccagcagcccagctactacagcgacctggatgagaccctgcccaccatcctgcaggtgttcagcaacatcctgcagcactgcggcctgcagggagatggagccaacaccaccccccagaagctggaggagcggggccgcctgacccccagcgacatgcccctgctggagctgaaggacatcgtgctgtacctgtgtgacacctgcaccaccctgtgggccttcctggacatcttccccctggcctgccagaccttccagaagcatgacttctgctaccgcctggccagcttctatgaagctgccatccctgagatggagagcgccatcaagaagaggcggctggaggacagcaagctgctgggggacctgtggcagaggctgagccacagcaggaagaagctgatggagatcttccacatcatcctgaaccagatctgcctgctgcccatcctggagagcagctgtgacaacatccagggcttcatcgaggagttcctgcagatcttcagcagcctgctgcaggagaagcgcttcctgcgggactatgatgccctcttccctgtggccgaggacatcagcctgctgcagcaggccagctctgtgctggatgagaccaggacagcctacatcctgcaggccgtggagagcgcctgggagggcgtggacaggaggaaggccacagatgccaaggaccccagcgtcatcgaggagcccaacggggagcccaacggggtgacagtgacagctgaggccgtgtcccaggccagcagccacccagaaaattctgaggaggaggagtgcatgggcgctgctgctgctgtgggccctgccatgtgtggggtggagctggacagcctcatcagccaggtgaaggacctgctgcctgacctgggggagggcttcatcctggcctgcctggagtactaccactatgaccctgagcaggtgatcaacaacatcctggaggagcggctggcccccaccctgagccagctggacaggaacctggaccgggagatgaagccagaccccacccccctgctgaccagccgccacaacgtgttccagaatgatgaatttgatgtgttcagccgggacagcgtggacctgagccgggtgcacaagggcaagagcaccaggaaggaggagaacaccaggagcctgctgaatgacaagagagctgtggccgcccagaggcagagatatgagcagtacagcgtggtggtggaggaggtgcccctgcagcctggagagagcctgccctaccacagcgtgtactatgaagatgaatatgatgacacctatgatggcaaccaggtgggcgccaatgatgctgacagtgatgatgagctgatcagcagaagacccttcaccatcccccaggtgctgcggaccaaggtgccccgggagggccaggaggaggatgatgatgatgaagaagatgatgctgatgaggaggcccccaagccagaccactttgtgcaggaccctgctgtgctgcgggagaaggccgaggcccggaggatggccttcctggccaagaagggctacagacatgacagcagcacagctgtggccggcagcccccggggccacggccagagccgggagaccacccaggagaggaggaagaaggaggccaacaaggccacccgggccaaccacaacagaaggaccatggctgacaggaagaggagcaagggcatgatccccagctag

SEQ ID NO: 142338 - DNA, 2274 bp, Artificial Sequence; identical to SEQ ID NO: 142337
  Description of Artificial Sequence: Synthetic coding sequence

SEQ ID NO: 142339 - DNA, 723 bp, Artificial Sequence
  Description of Artificial Sequence: Synthetic coding sequence
atgcctgccctgcccctggaccagctgcagatcacccacaaggaccccaagacaggcaagctgcggaccagccctgccctgcaccctgagcagaaggctgaccgctactttgtgctgtacaagcccccacccaaggacaacatcccagccctggtggaggagtacctggagcgggccacctttgtggccaatgacctggactggctgctggccctgccccatgacaagttctggtgccaggtgatctttgatgagaccctgcagaagtgcctggacagctacctgcgctacgtgcccaggaagtttgatgaaggagtggccagcgcccctgaggtggtggacatgcagaagaggctgcacaggagcgtcttcctgaccttcctgaggatgagcacccacaaggagagcaaggaccacttcatcagccccagcgccttcggggagatcctgtacaacaacttcctgtttgacatccccaagatcctggacctgtgtgtgctgtttgggaagggcaacagccccctgctgcagaagatgattggcaacatcttcacccagcagcccagctactacagcgacctggatgagaccctgcccaccatcctgcaggtgttcagcaacatcctgcagcactgcggcctgcagggagatggagccaacaccaccccccagaagctggaggagcggggccgcctgacccccagcgacatgcccctgctgtag

SEQ ID NO: 142340 - DNA, 2046 bp, Artificial Sequence
  Description of Artificial Sequence: Synthetic coding sequence
atgcctgccctgcccctggaccagctgcagatcacccacaaggaccccaagacaggcaagctgcggaccagccctgccctggtgatctttgatgagaccctgcagaagtgcctggacagctacctgcgctacgtgcccaggaagtttgatgagggcgtggccagcgcccctgaggtggtggacatgcagaagaggctgcacaggtctgtgttcctgaccttcctgaggatgagcacccacaaggagagcaagatcctggacctgtgtgtgctgtttgggaagggcaacagccccctgctgcagaagatgattggcaacatcttcacccagcagcccagctactacagcgacctggatgagaccctgcccaccatcctgcaggtgttcagcaacatcctgcagcactgcggcctgcagggagatggagccaacaccaccccccagaagctggaggagcggggccgcctgacccccagcgacatgcccctgctggagctgaaggacatcgtgctgtacctgtgtgacacctgcaccaccctgtgggccttcctggacatcttccccctggcctgccagaccttccagaagcatgacttctgctaccgcctggccagcttctatgaagctgccatccctgagatggagagcgccatcaagaagaggcggctggaggacagcaagctgctgggggacctgtggcagaggctgagccacagcaggaagaagctgatggagatcttccacatcatcctgaaccagatctgcctgctgcccatcctggagagcagctgtgacaacatccagggcttcatcgaggagttcctgcagatcttcagcagcctgctgcaggagaagcgcttcctgcgggactatgatgccctcttccctgtggccgaggacatcagcctgctgcagcaggccagctctgtgctggatgagaccaggacagcctacatcctgcaggccgtggagagcgcctgggagggcgtggacaggaggaaggccacagatgccaaggaccccagcgtcatcgaggagcccaacggggagcccaacggggtgacagtgacagctgaggccgtgtcccaggccagcagccacccagaaaattctgaggaggaggagtgcatgggcgctgctgctgctgtgggccctgccatgtgtggggtggagctggacagcctcatcagccaggtgaaggacctgctgcctgacctgggggagggcttcatcctggcctgcctggagtactaccactatgaccctgagcaggtgatcaacaacatcctggaggagcggctggcccccaccctgagccagctggacaggaacctggaccgggagatgaagccagaccccacccccctgctgaccagccgccacaacgtgttccagaatgatgaatttgatgtgttcagccgggacagcgtggacctgagccgggtgcacaagggcaagagcaccaggaaggaggagaacaccaggagcctgctgaatgacaagagagctgtggccgcccagaggcagagatatgagcagtacagcgtggtggtggaggaggtgcccctgcagcctggagagagcctgccctaccacagcgtgtactatgaagatgaatatgatgacacctatgatggcaaccaggtgggcgccaatgatgctgacagtgatgatgagctgatcagcagaagacccttcaccatcccccaggtgctgcggaccaaggtgccccgggagggccaggaggaggatgatgatgatgaagaagatgatgctgatgaggaggcccccaagccagaccactttgtgcaggaccctgctgtgctgcgggagaaggccgaggcccggaggatggccttcctggccaagaagggctacagacatgacagcagcacagctgtggccggcagcccccggggccacggccagagccgggagaccacccaggagaggaggaagaaggaggccaacaaggccacccgggccaaccacaacagaaggaccatggctgacaggaagaggagcaagggcatgatccccagctag

SEQ ID NO: 142341 - DNA, 531 bp, Artificial Sequence
  Description of Artificial Sequence: Synthetic coding sequence
atggccctgccccggctgactggagccctgcggagcttcagcaatgtgaccaagcaggacaactacaatgaggaggtggccgacctgaagatcaagaggagcaagctgcacgagcaggtgctggacctgggcctgacctggaagaagatcatcaagttcctgaatgagaagctggagaagagcaagatgcagagcatcaatgaagacctgaaggacatcctgcacgccgccaagcagatcgtgggcacagacaatggccgggaggccatcgagagcggggccgccttcctgttcatgaccttccacctgaaggacagcgtgggccacaaggagaccaaggccatcaagcagatgtttggccccttccccagcagcagcgccacagctgcctgcaatgccaccaaccgcatcatcagccacttcagccaggatgacctgacagccctggtgcagatgacagagaaggagcacggggacagagtcttcttcggcaagaacctggccttctcctttgacatgcatgacctgtag

SEQ ID NO: 142342 - DNA, 336 bp, Artificial Sequence
  Description of Artificial Sequence: Synthetic coding sequence
atggccctgccccggctgactggagccctgcggagcttcagcaatgtgaccaagcaggacaactacaatgaggaggtggccgacctgaagatcaagaggagcaagctgcacgagcaggtgctggacctgggcctgacctggaagaagatcatcaagttcctgaatgagaagctggagaagagcaagatgcagagcatcaatgaagacctgaaggacatcctgcacgccgccaagcagatcgaggtgaactgccccttccagaagaggcggctggatggcaaggaggaggatgagaagatgagccgggccagtgaccgcttccggggcctgaggtag

SEQ ID NO: 142343 - DNA, 6609 bp, Artificial Sequence
  Description of Artificial Sequence: Synthetic coding sequence
atggccctgccccggctgactggagccctgcggagcttcagcaatgtgaccaagcaggacaactacaatgaggaggtggccgacctgaagatcaagaggagcaagctgcacgagcaggtgctggacctgggcctgacctggaagaagatcatcaagttcctgaatgagaagctggagaagagcaagatgcagagcatcaatgaagacctgaaggacatcctgcacgccgccaagcagatcgtgggcacagacaatggccgggaggccatcgagagcggggccgccttcctgttcatgaccttccacctgaaggacagcgtgggccacaaggagaccaaggccatcaagcagatgtttggccccttccccagcagcagcgccacagctgcctgcaatgccaccaaccgcatcatcagccacttcagccaggatgacctgacagccctggtgcagatgacagagaaggagcacggggacagagtcttcttcggcaagaacctggccttctcctttgacatgcatgacctggaccactttgatgagctgcccatcaatggagagacccagaagaccatcagcctggactacaagaagttcctgaatgagcacctgcaggaggcctgcaccccagagctgaagcctgtggagaagaccaacggcagcttcctgtggtgtgaggtggagaagtacctgaacagcaccctgaaggagatgacagaggtgccccgggtggaggacctgtgctgcaccctgtatgacatgctggccagcatcaagtctggagatgagctgcaggatgagctgtttgagctgctgggccctgagggcctggagctgattgagaagctgctgcagaaccgcatcaccatcgtggaccgcttcctgaacagcagcaatgaccaccgcttccaggccctgcaggacaactgcaagaagatcctgggggagaatgccaagcccaactacggctgccaggtgaccatccagagcgagcaggagaagcagctgatgaagcagtacagaagagaggagaagagaattgcccggcgggagaagaaggccggggaggacctggaggtgtctgagggcctgatgtgctttgaccccaaggagctgcgcatccagcgggagcaggccctgctgaatgcccggtctgtgcccatcctgagccggcagagagatgctgatgtggagaagatccactacccccacgtgtatgacagccaggccgaggccatgaagaccagcgccttcatcgccggggccaagatgatcctgcctgagggcatccagcgggagaacaacaagctgtatgaggaggtgcgcatcccctacagcgagcccatgcccctgagctttgaggagaagcctgtgtacatccaggacctggatgagatcggccagctggccttcaagggcatgaagaggctgaaccgcatccagagcatcgtgtttgaaacagcctacaacaccaatgaaaacatgctgatctgtgcccccactggagctgggaagaccaacatcgccatgctgactgtgctgcacgagatccggcagcacttccagcagggcgtcatcaagaagaatgagttcaagatcgtgtatgtggcccccatgaaggccctggccgctgagatgacagactacttcagccggcggctggagcccctgggcatcatcgtgaaggagctgactggagacatgcagctgagcaagtctgagatcctgcggacccagatgctggtgaccaccccagagaagtgggatgtggtgaccaggaagtctgtgggagatgtggccctgagccagatcgtgcggctgctgatcctggatgaggtgcacctgctgcacgaggaccggggccctgtgctggagagcatcgtggcccggaccctgcggcaggtggagagcacccagagcatgatccgcatcctgggcctgagcgccaccctgcccaactacctggatgtggccaccttcctgcacgtgaacccctacatcggcctcttcttctttgatggccgcttccggcctgtgcccctgggccagaccttcctgggcatcaagtgtgccaacaagatgcagcagctgaacaacatggatgaggtgtgctatgaaaatgtgctgaagcaggtgaaggccggccaccaggtgatggtgtttgtgcacgccagaaatgccaccgtgaggacagccatgagcctcatcgagcgggccaagaactgtggccacatccccttcttcttccccacccagggccatgactatgtgctggccgagaagcaggtgcagaggagcaggaacaagcaggtgcgggagctgttcccagatggcttcagcatccaccacgccggcatgctgcggcaggacaggaacctggtggagaacctcttcagcaatggccacatcaaggtgctggtgtgcacagccaccctggcctggggcgtgaacctgcctgcccacgccgtcatcatcaagggcacccagatctatgctgccaagaggggcagctttgtggacctgggcatcctggatgtgatgcagatcttcggccgggccggccggccccagtttgacaagtttggagagggcatcatcatcaccacccatgacaagctgagccactacctgaccctgctgacccagaggaaccccatcgagagccagttcctggagagcctggccgacaacctgaatgctgagatcgccctgggcaccgtgaccaacgtggaggaggccgtgaagtggatctcctacacctacctgtatgtgaggatgagggccaaccccctggcctacggcatcagccacaaggcctaccagattgaccccaccctgaggaagcaccgggagcagctggtgattgaggtgggcaggaagctggacaaggcccagatgatccgctttgaggagaggacaggctacttcagcagcacagacctgggccgcacagccagccactactacatcaagtacaacaccatcgagaccttcaatgagctgtttgatgcccacaagacagaaggagacatctttgccatcgtgtccaaggccgaggagtttgaccagatcaaggtgcgggaggaggagattgaggagctggacaccctgctgagcaacttctgtgagctgagcaccccaggaggagtggagaacagctatggcaagatcaacatcctgctgcagacctacatcagcagaggagagatggacagcttcagcctcatcagtgacagcgcctacgtggcccagaatgctgccagaattgtgcgggccctgtttgagatcgccctgaggaagcgctggcccaccatgacctaccgcctgctgaacctgagcaaggtgattgacaagaggctgtggggctgggccagccccctgcggcagttcagcatcctgcccccccacatcctgacccggctggaggagaagaagctgactgtggacaagctgaaggacatgaggaaggatgaaattggccacatcctgcaccacgtgaacatcggcctgaaggtgaagcagtgtgtgcaccagatccccagcgtgatgatggaggccagcatccagcccatcaccaggacagtgctgcgggtgaccctgagcatctatgctgacttcacctggaatgaccaggtgcatggaacagtgggggagccctggtggatctgggtggaggaccccaccaatgaccacatctaccacagcgagtacttcctggccctgaagaagcaggtgatcagcaaggaggcccagctgctggtgttcaccatccccatctttgagcccctgcccagccagtactacatccgggctgtgtctgaccgctggctgggcgctgaggccgtgtgcatcatcaacttccagcacctgatcctgcctgagcggcaccccccccacacagagctgctggacctgcagcccctgcccatcacagccctgggctgcaaggcctatgaggccctgtacaacttcagccacttcaaccctgtgcagacccagatcttccacaccctgtaccacacagactgcaatgtgctgctgggcgcccccactggaagtggcaagacagtggccgctgagctggccatcttccgggtcttcaacaagtaccccaccagcaaggctgtgtacatcgcccccctgaaggccctggtgcgggagaggatggatgactggaaggtgcgcatcgaggagaagctgggcaagaaggtgattgagctgactggagatgtgaccccagacatgaagagcatcgccaaggctgacctgattgtgaccaccccagagaagtgggatggagtgagccgctcctggcagaacagaaattatgtgcagcaggtgaccatcctgatcattgatgagatccacctgctgggggaggagcggggccctgtgctggaggtgattgtgtccaggaccaacttcatcagcagccacacagagaagcctgtgcgcatcgtgggcctgagcacagccctggccaatgcccgggacctggccgactggctgaacatcaagcagatgggcctcttcaacttccggcccagcgtgcggcctgtgcccctggaggtgcacatccagggcttccctggccagcactactgccccaggatggcctccatgaacaagccagccttccaggccatccgcagccacagccctgccaagcctgtgctgatctttgtgagcagccggcggcagacccggctgacagccctggagctgattgccttcctggccacagaggaggaccccaagcagtggctgaacatggatgagcgggagatggagaacatcatcgccaccgtgcgggacagcaacctgaagctgaccctggccttcggcatcggcatgcaccacgccggcctgcacgagcgggacaggaagacagtggaggagctgtttgtgaactgcaaggtgcaggtgctgattgccaccagcaccctggcctggggcgtgaacttccctgcccacctggtgatcatcaagggcacagagtactatgatggcaagaccaggagatatgtggacttccccatcacagatgtgctgcagatgatgggccgggccggccggccccagtttgatgaccagggcaaggctgtgatcctggtgcatgacatcaagaaggacttctacaagaagttcctgtatgagcccttccctgtggagagcagcctgctgggcgtgctgagtgaccacctgaatgctgagattgctgggggcaccatcaccagcaagcaggatgccctggactacatcacctggacctacttcttcagaagactcatcatgaaccccagctactacaacctgggagatgtgtcccatgattctgtgaacaagttcctgagccacctgattgagaagagcctgattgagctggagctgagctactgcattgaaattggagaggacaacagaagcattgagcccctgacctacggccgcatcgccagctactactacctgaagcaccagacagtgaagatgttcaaggaccggctgaagccagaatgttccacagaggagctgctgagcatcctgagtgatgctgaggagtacacagacctgcctgtgcgccacaatgaagaccacatgaacagcgagctggccaagtgcctgcccatcgagagcaacccccacagctttgacagcccccacaccaaggcccacctgctgctgcaggcccacctgagccgggccatgctgccctgcccagactatgacacagacaccaagacagtgctggaccaggccctgcgggtgtgccaggccatgctggatgtggccgccaaccagggctggctggtgacagtgctgaacatcaccaacctgatccagatggtgatccagggccgctggctgaaggacagcagcctgctgaccctgcccaacatcgagaaccaccacctgcacctgttcaagaagtggaagcccatcatgaagggcccccacgcccggggccgcaccagcattgagagcctgcctgagctgattcatgcctgtggcggcaaggaccacgtgttcagctccatggtggagagcgagctgcacgccgccaagaccaagcaggcctggaacttcctgagccacctgcccgtcatcaacgtgggcatctctgtgaagggctcctgggatgacctggtggagggccacaatgagctgtctgtgtccaccctgacagctgacaagagagatgacaacaagtggatcaagctgcacgccgaccaggagtatgtgctgcaggtgtccctgcagagggtgcacttcggcttccacaagggcaagccagagagctgtgctgtgaccccccgcttccccaagagcaaggatgagggctggttcctgatcctgggggaggtggacaagcgggagctgattgccctgaagagggtgggctacatccggaaccaccacgtggccagcctgtccttctacaccccagagatccctggccgctacatctacaccctgtacttcatgtctgactgctacctgggcctggaccagcagtatgacatctacctgaatgtgacccaggccagcctgagcgcccaggtgaacaccaaggtgtctgacagcctgacagacctggccctgaagtag

SEQ ID NO: 142344 - DNA, 816 bp, Artificial Sequence
  Description of Artificial Sequence: Synthetic coding sequence
atggaggacagccacaagagcaccaccagcgagacagccccccagcccggcagcgctgtgcagggcgcccacatcagccacatcgcccagcaggtgagcagcctgtctgagagcgaggagagccaggacagcagtgacagcatcggcagcagccagaaggcccacggcatcctggcccggcggcccagctacaggaagatcctgaaggacctgagcagcgaggacacccggggcaggaaaggagatggagagaacagcggcgtgtctgctgctgtgacctccatgtctgtgcccacccccatctaccagaccagcagcggccagtacatcgccatcgccccaaatggagccctgcagctggccagccctggaacagatggagtgcagggcctgcagaccctgaccatgaccaacagcggcagcacccagcagggcaccaccatcctgcagtatgcccagaccagtgatggccagcagatcctggtgcccagcaaccaggtggtggtgcagacagccagcggggacatgcagacctaccagatccgcaccacccccagcgccaccagcctgccccagacagtggtgatgaccagccctgtgaccctgaccagccagaccaccaagacagatgacccccagctgaagcgggagatccggctgatgaagaaccgggaggccgccagagaatgtagaaggaagaagaaggagtatgtgaagtgcctggagaacagagtggccgtgctggagaaccagaacaagaccctcatcgaggagctgaagaccctgaaggacctgtacagcaacaagtctgtgtag

SEQ ID NO: 142345 - DNA, 411 bp, Artificial Sequence
  Description of Artificial Sequence: Synthetic coding sequence
atgaccaacagcggcagcacccagcagggcaccaccatcctgcagtatgcccagaccagtgatggccagcagatcctggtgcccagcaaccaggtggtggtgcagacagccagcggggacatgcagacctaccagatccgcaccaccccatctgccaccagcctgccccagacagtggtgatgaccagccctgtgaccctgaccagccagaccaccaagacagatgacccccagctgaagcgggagatccggctgatgaagaaccgggaggccgcccgggagtgcaggaggaagaagaaggagtatgtgaagtgcctggagaacagagtggccgtgctggagaaccagaacaagaccctgattgaggagctgaagaccctgaaggacctgtacagcaacaagtctgtgtag

SEQ ID NO: 142346 - DNA, 603 bp, Artificial Sequence
  Description of Artificial Sequence: Synthetic coding sequence
atggaggacagccacaagagcaccaccagcgagacagccccccagcccggcagcgctgtgcagggcgcccacatcagccacatcgcccagcaggtgagcagcctgtctgagagcgaggagagccaggacagcagtgacagcatcggcagcagccagaaggcccacggcatcctggcccggcggcccagctacaggaagatcctgaaggacctgagcagcgaggacacccggggcaggaaaggagatggagagaacagcggcgtgtctgctgctgtgacctccatgtctgtgcccacccccatctaccagaccagcagcggccagtacatcgccatcgccccaaatggagccctgcagctggccagccctggaacagatggagtgcagggcctgcagaccctgaccatgaccaacagcggcagcacccagcagggcaccaccatcctgcagtatgcccagaccagtgatggccagcagatcctggtgcccagcaaccaggtggtggtgcagacagccagcggggacatgcagacctaccagatccgcaccacccccagcgccaccagcctgccccagacagtggtgatgaccagccctgtgtag

SEQ ID NO: 142347 - DNA, 513 bp, Artificial Sequence
  Description of Artificial Sequence: Synthetic coding sequence
atggaggacagccacaagagcaccaccagcgagacagccccccagcccggcagcgctgtgcagggcgcccacatcagccacatcgcccagcaggtgagcagcctgtctgagagcgaggagagccaggacagcagtgacagcatcggcagcagccagaaggcccacggcatcctggcccggcggcccagctacaggaagatcctgaaggacctgagcagcgaggacacccggggcaggaaaggagatggagagaacagcggcgtgtctgctgctgtgacctccatgtctgtgcccacccccatctaccagaccagcagcggccagtacatcgccatcgccccaaatggagccctgcagctggccagccctggaacagatggagtgcagggcctgcagaccctgaccatgaccaacagcggcagcacccagcagggcaccaccatcctgcagtatgcccagaccagtgatggccagcagatcctggtgcccagcaaccaggtggtggtgcagtag

SEQ ID NO: 142348 - DNA, 321 bp, Artificial Sequence
  Description of Artificial Sequence: Synthetic coding sequence
atgatgctgcagcaccctggccaggtgtctgccagcgaggaggagctgcgctttgccatccagaacaagcacctgtgccacaggatgagcagcgccctggagagcgtgacagtgtctgaccggcccctgggcgtgtccatcaccaaggccgaggtggcccctgaggaggatgagaggaagaagagaagaagagagaggaacaagattgctgctgccaagtgcaggaacaagaagaaggagaagacagaatgtctgcagaagctgccccggcccttctgggtgcagaagacctgcatctgggccgtggacagctgcaagtag

SEQ ID NO: 142349 - DNA, 546 bp, Artificial Sequence
  Description of Artificial Sequence: Synthetic coding sequence
atgatgctgcagcaccctggccaggtgtctgccagcgaggtgtctgccagcgccatcgtgccctgcctgagccccccaggcagcctggtgtttgaggactttgccaacctgaccccatttgtgaaggaggagctgcgctttgccatccagaacaagcacctgtgccacaggatgagcagcgccctggagagcgtgacagtgtctgaccggcccctgggcgtgtccatcaccaaggccgaggtggccccagaagaagatgagaggaagaagagaagaagagaaagaaacaagattgctgctgccaagtgcaggaacaagaagaaggagaagacagagtgcctgcagaaggagagcgagaagctggagagcgtgaatgctgagctgaaggcccagatcgaggagctgaagaatgagaagcagcacctgatctacatgctgaacctgcaccggcccacctgcatcgtgcgggcccagaatggaagaacaccagaagatgaaagaaacctcttcatccagcagatcaaggagggcaccctgcagagctag

SEQ ID NO: 142350 - DNA, 528 bp, Artificial Sequence
  Description of Artificial Sequence: Synthetic coding sequence
atgatgctgcagcaccctggccaggtgtctgccagcgaggtgtctgccagcgccatcgtgccctgcctgagccccccaggcagcctggtgtttgaggactttgccaacctgaccccatttgtgaaggaggagctgcgctttgccatccagaacaagcacctgtgccacaggatgagcagcgccctggagagcgtgacagtgtctgaccggcccctgggcgtgtccatcaccaaggccgaggtggccccagaagaagatgagaggaagaagagaagaagagaaagaaacaagattgctgctgccaagtgcaggaacaagaagaaggagaagacagagtgcctgcagaaggagagcgagaagctggagagcgtgaatgctgagctgaaggcccagatcgaggagctgaagaatgagaagcagcacctgatctacatgctgaacctgcaccggcccacctgcatcgtgcgggcccagaatggaagaacaccagaagatgaaagaaacctcttcatccagcagatcaagtag

SEQ ID NO: 142351 - DNA, 408 bp, Artificial Sequence
  Description of Artificial Sequence: Synthetic coding sequence
atgatgctgcagcaccctggccaggtgtctgccagcgaggtgtctgccagcgccatcgtgccctgcctgagccccccaggcagcctggtgtttgaggactttgccaacctgaccccatttgtgaaggaggagctgcgctttgccatccagaacaagcacctgtgccacaggatgagcagcgccctggagagcgtgacagtgtctgaccggcccctgggcgtgtccatcaccaaggccgaggtggccccagaagaagatgagaggaagaagagaagaagagaaagaaacaagattgctgctgccaagtgcaggaacaagaagaaggagaagacagagtgcctgcagaagctgccccggcccttctgggtgcagaagacctgcatctgggccgtggacagctgcaagtag

SEQ ID NO: 142352 - DNA, 375 bp, Artificial Sequence
  Description of Artificial Sequence: Synthetic coding sequence
atgagcagcgccctggagagcgtgacagtgtctgaccggcccctgggcgtgtccatcaccaaggccgaggtggcccctgaggaggatgagaggaagaagagaagaagagagaggaacaagattgctgctgccaagtgcaggaacaagaagaaggagaagacagaatgtctgcagaaggagagcgagaagctggagagcgtgaatgctgagctgaaggcccagatcgaggagctgaagaatgagaagcagcacctgatctacatgctgaacctgcaccggcccacctgcatcgtgcgggcccagaatggccgcaccccagaagatgagaggaacctcttcatccagcagatcaaggagggcaccctgcagagctag

SEQ ID NO: 142353 - DNA, 546 bp, Artificial Sequence; identical to SEQ ID NO: 142349
  Description of Artificial Sequence: Synthetic coding sequence

SEQ ID NO: 142354 - DNA, 408 bp, Artificial Sequence; identical to SEQ ID NO: 142351
  Description of Artificial Sequence: Synthetic coding sequence

SEQ ID NO: 142355 - DNA, 1056 bp, Artificial Sequence
  Description of Artificial Sequence: Synthetic coding sequence
atgacagagatgtccttcctgagcagcgaggtgctggtgggggacctgatgagcccctttgaccagagcggcctgggcgctgaggagagcctgggcctgctggatgactacctggaggtggccaagcacttcaagccccacggcttcagcagtgacaaggccaaggccggcagcagcgagtggctggccgtggatggcctggtgagccccagcaacaacagcaaggaggatgccttcagcggcacagactggatgctggagaagatggacctgaaggagtttgacctggatgccctgctgggcattgatgacctggagaccatgccagatgacctgctgaccaccctggatgacacctgtgacctgtttgcccccctggtgcaggagaccaacaagcagcccccccagacagtgaaccccatcggccacctgcctgagagcctgaccaagccagaccaggtggcccccttcaccttcctgcagcccctgcccctgagccctggggtgctgagcagcaccccagaccacagcttcagcctggagctgggcagcgaggtggacatcacagaaggagacaggaagccagactacacagcctacgtggccatgatcccccagtgcatcaaggaggaggacacccccagcgacaatgattctggcatctgcatgagccctgagagctacctgggcagcccccagcacagccccagcacccggggcagccccaacagaagcctgcccagccctggggtgctgtgtggcagcgcccggcccaagccctatgaccccccaggagagaagatggtggccgccaaggtgaagggggagaagctggacaagaagctgaagaagatggagcagaacaagacagctgccacccgctaccggcagaagaagagagctgagcaggaggccctgactggagagtgcaaggagctggagaagaagaatgaggccctgaaggagagagctgacagcctggccaaggagatccagtacctgaaggacctgattgaggaggtgaggaaggcccggggcaagaagagggtgccctag

SEQ ID NO: 142356 - DNA, 1056 bp, Artificial Sequence; identical to SEQ ID NO: 142355
  Description of Artificial Sequence: Synthetic coding sequence

SEQ ID NO: 142357 - DNA, 1056 bp, Artificial Sequence; identical to SEQ ID NO: 142355
  Description of Artificial Sequence: Synthetic coding sequence

SEQ ID NO: 142358 - DNA, 849 bp, Artificial Sequence
  Description of Artificial Sequence: Synthetic coding sequence
atgagcctgctggccaccctgggcctggagctggaccgggccctgctgcctgccagcggcctgggctggctggtggactatggcaagctgcccccagccccagcccccctggccccctatgaggtgctgggcggggccctggagggcggcctgcctgtgggcggggagcccctggccggagatggcttcagtgactggatgacagagcgggtggacttcaccgccctgctgcccctggagccccccctgcccccaggcaccctgccccagcccagccccaccccaccagacctggaggccatggccagcctgctgaagaaggagctggagcagatggaggacttcttcctggatgccccacccctgcccccacccagccccccacccctgcccccaccacccctgcccccagcccccagcctgcccctgagcctgcccagctttgacctgccccagccccctgtgctggacaccctggacctgctggccatctactgcagaaatgaggccggccaggaggaggtgggcatgccacccctgcccccaccccagcagcccccaccacccagccccccccagcccagccggctggccccctacccccacccagccaccaccaggggggacaggaagcagaagaagagggaccagaacaagtctgctgccctgcgctaccggcagaggaagagagctgagggggaggccctggagggggagtgccagggcctggaggccaggaaccgggagctgaaggagcgggcagagagcgtggagcgggagatccagtatgtgaaggacctgctgattgaggtgtacaaggcccggagccagaggaccaggagctgctag

SEQ ID NO: 142359 - DNA, 2013 bp, Artificial Sequence
  Description of Artificial Sequence: Synthetic coding sequence
atgggagagcctgctggggtggccggcaccatggagagccccttcagccctggcctcttccaccggctggatgaggactgggacagcgccctgtttgctgagctgggctacttcacagacacagatgagctgcagctggaggccgccaatgagacctatgagaacaactttgacaacctggactttgacctggacctgatgccctgggagagtgacatctgggacatcaacaaccagatctgcaccgtgaaggacatcaaggccgagccccagcccctgagccctgccagcagcagctacagcgtgagcagccccaggtctgtggacagctacagcagcacccagcacgtgcctgaggagctggacctgagcagcagcagccagatgagccccctgagcctgtatggagagaacagcaacagcctgagcagcgctgagcccctgaaggaggacaagcctgtgacaggccccaggaacaagacagaaaatggcctgacccccaagaagaagatccaggtgaacagcaagcccagcatccagcccaagcccctgctgctgcctgctgcccccaagacccagaccaacagctctgtgcctgccaagaccatcatcatccagacagtgcccaccctgatgcccctggccaagcagcagcccatcatcagcctgcagcctgcccccaccaagggccagacagtgctgctgagccagcccaccgtggtgcagctgcaggcccctggggtgctgcccagcgcccagcctgtgctggccgtggccggcggcgtgacccagctgcccaaccacgtggtgaatgtggtgcctgcccccagcgccaacagccctgtgaatggcaagctgtctgtgaccaagcctgtgctgcagagcaccatgagaaatgtgggcagtgacattgctgtgctgcggcggcagcagaggatgatcaagaaccgggagagcgcctgccagagcaggaagaagaagaaggagtacatgctgggcctggaggcccggctgaaggccgccctgtctgaaaatgagcagctgaagaaggaaaatggcaccctgaagaggcagctggatgaggtggtgtctgagaaccagaggctgaaggtgcccagccccaagagaagagtggtgtgtgtgatgattgtgctggccttcatcatcctgaactacggccccatgtccatgctggagcaggacagcaggaggatgaaccccagcgtgtccccagccaaccagaggaggcacctgctgggcttcagcgccaaggaggcccaggacaccagtgatggcatcatccagaagaacagctaccgctatgaccacagcgtgtccaatgacaaggccctgatggtgctgacagaggagcccctgctgtacatccccccaccaccctgccagcccctcatcaacaccacagagagcctgcggctgaaccacgagctgcggggctgggtgcacagacatgaggtggagaggaccaagagcaggaggatgaccaacaaccagcagaagacccgcatcctgcagggcgccctggagcagggcagcaacagccagctgatggctgtgcagtacacagagaccaccagcagcatcagcaggaacagcggcagcgagctgcaggtgtactatgccagccccaggagctaccaggacttctttgaggccatcagaagaagaggagacaccttctacgtggtgtccttccggcgggaccacctgctgctgcctgccaccacccacaacaagaccacccggcccaagatgagcatcgtgctgcctgccatcaacatcaatgaaaatgtcatcaatggccaggactatgaggtgatgatgcagattgactgccaggtgatggacacccgcatcctgcacatcaagagcagctctgtgcccccctacctgcgggaccagcagaggaaccagaccaacaccttcttcggcagccccccagctgccacagaggccacccacgtggtgtccaccatccctgagagcctgcagtag

SEQ ID NO: 142360 - DNA, 2112 bp, Artificial Sequence
  Description of Artificial Sequence: Synthetic coding sequence
atggccgagctgatgctgctgtctgaaattgctgaccccacccgcttcttcacagacaacctgctgagccctgaggactggggcctgcagaacagcaccctgtacagcggcctggatgaggtggccgaggagcagacccagctgttccgctgcccagagcaggatgtgccctttgatggcagcagcctggatgtgggcatggatgtgagccccagcgagcccccctgggagctgctgcccatcttcccagacctgcaggtgaagtctgagcccagcagcccctgcagcagcagcagcctgagcagcgagagcagccggctgagcacagagcccagcagcgaggccctgggcgtgggggaggtgctgcacgtgaagacagagagcctggccccacccctgtgcctgctgggagatgaccccaccagcagctttgagaccgtgcagatcaacgtcatccccaccagtgatgacagcagtgatgtgcagaccaagattgagcctgtgagcccctgcagctctgtgaacagcgaggccagcctgctgtctgctgacagcagcagccaggccttcatcggggaggaggtgctggaggtgaagacagagagcctgagccccagcggctgcctgctgtgggatgtgcctgcccccagcctgggcgctgtgcagatctccatgggccccagcctggatggcagcagcggcaaggccctgcccaccaggaagccacccctgcagcccaagcctgtggtgctgaccaccgtgcccatgcccagcagagctgtgccccccagcaccaccgtgctgctgcagagcctggtgcagcccccacctgtgtcccctgtggtgctgatccagggcgccatccgggtgcagcctgagggccctgcccccagcctgcccaggcctgagaggaagagcatcgtgcctgcccccatgcctggcaacagctgccccccagaggtggatgccaagctgctgaagaggcagcagaggatgatcaagaaccgggagagcgcctgccagagcaggaggaagaagaaggagtacctgcagggcctggaggcccggctgcaggccgtgctggccgacaaccagcagctgcggcgggagaatgctgccctgcggcggcggctggaggccctgctggccgagaacagcgagctgaagctgggcagcggcaacaggaaggtggtgtgcatcatggtgttcctgctcttcatcgccttcaactttggacctgtgtccatcagcgagcccccatctgcccccatcagccccaggatgaacaagggggagccccagccccggcggcacctgctgggcttcagcgagcaggagcctgtgcagggcgtggagcccctgcagggcagcagccagggccccaaggagccccagcccagccccacagaccagcccagcttcagcaacctgacagccttccctggaggagccaaggagctgctgctgcgggacctggaccagctgttcctgagcagtgactgccgccacttcaacagaacagagagcctgcggctggctgatgagctgagcggctgggtgcagaggcaccagagaggaagaaggaagatcccccagagggcccaggagcggcagaagagccagcccaggaagaagagcccccctgtgaaggctgtgcccatccagcccccaggccccccagagcgggacagcgtgggccagctgcagctgtaccgccacccagacaggagccagcctgccttcctggatgccatcgacagaagagaggacaccttctacgtggtgtccttccggcgggaccacctgctgctgcctgccatcagccacaacaagaccagccggcccaagatgagcctggtgatgcctgccatggccccaaatgagaccctgagcggccgcggggcccctggggactatgaggagatgatgcagattgaatgtgaggtgatggacaccagggtcatccacatcaagaccagcacagtgccccccagcctgaggaagcagcccagccccaccccaggaaatgccaccggcggccccctgcctgtgtctgctgccagccaggcccaccaggccagccaccagcccctgtacctgaaccacccctag

SEQ ID NO: 142361 - DNA, 669 bp, Artificial Sequence
  Description of Artificial Sequence: Synthetic coding sequence
atggccgagctgatgctgctgtctgaaattgctgaccccacccgcttcttcacagacaacctgctgagccctgaggactggggcctgcagaacagcaccctgtacagcggcctggatgaggtggccgaggagcagacccagctgttccgctgcccagagcaggatgtgccctttgatggcagcagcctggatgtgggcatggatgtgagccccacagaccagcccagcttcagcaacctgacagccttccctgggggcgccaaggagctgctgctgcgggacctggaccagctgttcctgagcagtgactgccgccacttcaacagaacagagagcctgcggctggctgatgagctgagcggctgggtgcagaggcaccagaggggccgcaggaagatcccccagagggcccaggagcggcagaagagccagcccaggaagaagagcccccctgtgaaggctgtgcccatccagcccccaggccccccagagcgggacagcgtgggccagctgcagctgtaccgccacccagacaggagccagcctgccttcctggatgccatcgaccggcgggaggacaccttctacgtggtgtccttccggaggaccacctgctgcagccagcccagcgccaccaccaggcctcctggcccccgctgcccctggtag

SEQ ID NO: 142362 - DNA, 2103 bp, Artificial Sequence
  Description of Artificial Sequence: Synthetic coding sequence
atggccgagctgatgctgctgtctgaaattgctgaccccacccgcttcttcacagacaacctgctgagccctgaggactgggacagcaccctgtacagcggcctggatgaggtggccgaggagcagacccagctgttccgctgcccagagcaggatgtgccctttgatggcagcagcctggatgtgggcatggatgtgagccccagcgagcccccctgggagctgctgcccatcttcccagacctgcaggtgaagtctgagcccagcagcccctgcagcagcagcagcctgagcagcgagagcagccggctgagcacagagcccagcagcgaggccctgggcgtgggggaggtgctgcacgtgaagacagagagcctggccccacccctgtgcctgctgggagatgaccccaccagcagctttgaaacagtgcagatcaacgtcatccccaccagtgatgacagcagtgatgtgcagaccaagattgagcctgtgagcccctgcagctctgtgaacagcgaggccagcctgctgtctgctgacagcagcagccaggccttcatcggggaggaggtgctggaggtgaagacagagagcctgagccccagcggctgcctgctgtgggatgtgcctgcccccagcctgggcgctgtgcagatctccatgggccccagcctggatggcagcagcggcaaggccctgcccaccaggaagccacccctgcagcccaagcctgtggtgctgaccaccgtgcccatgcccagcagagctgtgccccccagcaccaccgtgctgctgcagagcctggtgcagcccccacctgtgtcccctgtggtgctgatccagggcgccatccgggtgcagcctgagggccctgcccccagcctgcccaggcctgagaggaagagcatcgtgcctgcccccatgcctggcaacagctgccccccagaggtggatgccaagctgctgaagaggcagcagaggatgatcaagaaccgggagagcgcctgccagagcaggaggaagaagaaggagtacctgcagggcctggaggcccggctgcaggccgtgctggccgacaaccagcagctgcggagagaaaatgctgccctgcggcggcggctggaggccctgctggctgaaaattctgagctgaagctgggcagcggcaacaggaaggtggtgtgcatcatggtgttcctgctcttcatcgccttcaactttggacctgtgtccatcagcgagccccccagcgcccccatcagccccaggatgaacaagggggagccccagcccaggaggcacctgctgggcttcagcgagcaggagcctgtgcagggcgtggagcccctgcagggcagcagccagggccccaaggagccccagcccagccccacagaccagcccagcttcagcaacctgacagccttccctgggggcgccaaggagctgctgctgcgggacctggaccagctgttcctgagcagtgactgccgccacttcaacagaacagagagcctgcggctggctgatgagctgagcggctgggtgcagaggcaccagaggggccgcaggaagatcccccagagggcccaggagcggcagaagagccagcccaggaagaagagcccccctgtgaaggctgtgcccatccagcccccaggccccccagagcgggacagcgtgggccagctgcagctgtaccgccacccagacaggagccagcctgccttcctggatgccatcgaccggcgggaggacaccttctacgtggtgtccttcagaagagaccacctgctgctgcctgccatcagccacaacaagaccagccggcccaagatgagcctggtgatgcctgccatggccccaaatgagaccctgagcggccgcggggcccctggggactatgaggagatgatgcagattgaatgtgaggtgatggacaccagggtcatccacatcaagaccagcacagtgccccccagcctgaggaagcagcccagccccaccccaggaaatgccactggaggccccctgcctgtgtctgctgccagccaggcccaccaggccagccaccagcccctgtacctgaaccacccctag

SEQ ID NO: 142363 - DNA, 2112 bp, Artificial Sequence; identical to SEQ ID NO: 142360
  Description of Artificial Sequence: Synthetic coding sequence

SEQ ID NO: 142364 - DNA, 2103 bp, Artificial Sequence; identical to SEQ ID NO: 142362
  Description of Artificial Sequence: Synthetic coding sequence

SEQ ID NO: 142365 - DNA, 429 bp, Artificial Sequence
  Description of Artificial Sequence: Synthetic coding sequence
tgacagcccagccccacagaccagcccagcttcagcaacctgacagccttccctgggggcgccaaggagctgctgctgcgggacctggaccagctgttcctgagcagtgactgccgccacttcaacagaacagagagcctgcggctggctgatgagctgagcggctgggtgcagaggcaccagaggggccgcaggaagatcccccagagggcccaggagcggcagagcctggacaccagccccagccgcagcctgagccacggccgcagccacctgcagctgcggcagagccccagcaaccccctggacccccagaagggcatcctgtgggccagctgcaactacatcgccacccagacagtgcgcagccagcacagctggatgcagctgacagatggcaagacccacttcatgctgagcctgtcctag

SEQ ID NO: 142366 - DNA, 429 bp, Artificial Sequence; identical to SEQ ID NO: 142365
  Description of Artificial Sequence: Synthetic coding sequence

SEQ ID NO: 142367 - DNA, 2112 bp, Artificial Sequence; identical to SEQ ID NO: 142360
  Description of Artificial Sequence: Synthetic coding sequence

SEQ ID NO: 142368 - DNA, 2112 bp, Artificial Sequence; identical to SEQ ID NO: 142360
  Description of Artificial Sequence: Synthetic coding sequence

SEQ ID NO: 142369 - DNA, 2103 bp, Artificial Sequence; identical to SEQ ID NO: 142362
  Description of Artificial Sequence: Synthetic coding sequence

SEQ ID NO: 142370 - DNA, 429 bp, Artificial Sequence; identical to SEQ ID NO: 142365
  Description of Artificial Sequence: Synthetic coding sequence

SEQ ID NO: 142371 - DNA, 2103 bp, Artificial Sequence; identical to SEQ ID NO: 142362
  Description of Artificial Sequence: Synthetic coding sequence

SEQ ID NO: 142372 - DNA, 429 bp, Artificial Sequence; identical to SEQ ID NO: 142365
  Description of Artificial Sequence: Synthetic coding sequence

SEQ ID NO: 142373 - DNA, 669 bp, Artificial Sequence; identical to SEQ ID NO: 142361
  Description of Artificial Sequence: Synthetic coding sequence

SEQ ID NO: 142374 - DNA, 669 bp, Artificial Sequence; identical to SEQ ID NO: 142361
  Description of Artificial Sequence: Synthetic coding sequence

SEQ ID NO: 142375 - DNA, 669 bp, Artificial Sequence; identical to SEQ ID NO: 142361
  Description of Artificial Sequence: Synthetic coding sequence

SEQ ID NO: 142376 - DNA, 924 bp, Artificial Sequence
  Description of Artificial Sequence: Synthetic coding sequence
atgggagatgaccggccctttgtgtgcaatgcccctggctgcggccagcgcttcaccaatgaagaccacctggccgtgcacaagcacaagcatgagatgaccctgaagtttggacctgccaggacagacagcgtcatcatcgctgaccagacccccacccccacccgcttcctgaagaactgtgaggaggtgggcctcttcaatgagctggccagcagctttgagcacgagttcaagaaggccgcagatgaagatgagaagaaggctgctgctggccccctggacatgagcctgcccagcaccccagacatcaagatcaaggaggaggagcctgtggaggtggacagcagccccccagacagccctgccagcagcccctgcagcccccccctgaaggagaagagccctgcccagcccacccccagcactggaggaagaagaagaagaacagtggatgaagatcctgatgagcggcggcagcgcttcctggagaggaacagagctgctgccagccgctgccggcagaagaggaagctgtgggtgagcagcctggagaagaaggccgaggagctgaccagccagaacatccagctgagcaatgaggtgaccctgctgagaaatgaggtggcccagctgaagcagctgctgctggcccacaaggactgccctgtgacagccctgcagaagaagacccagggctacctggagagccccaaggagagcagcgagcccaccggcagccctgcccctgtgatccagcacagcagcgccacagcccccagcaatggcctgtctgtgcgctctgctgctgaggccgtggccacctctgtgctgacccagatggccagccagaggacagagctgtccatgcccatccagagccacgtgatcatgaccccccagagccagagcgctggaagatag

SEQ ID NO: 142377 - DNA, 1485 bp, Artificial Sequence
  Description of Artificial Sequence: Synthetic coding sequence
atgggagatgaccggccctttgtgtgcaatgcccctggctgcggccagcgcttcaccaatgaagaccacctggccgtgcacaagcacaagcatgagatgaccctgaagtttggacctgccaggacagacagcgtcatcatcgctgaccagacccccacccccacccgcttcctgaagaactgtgaggaggtgggcctcttcaatgagctggccagcagctttgagcacgagttcaagaaggccgcagatgaagatgagaagaaggcccggagcaggacagtggccaagaagctggtggccgccgccggccccctggacatgagcctgcccagcaccccagacatcaagatcaaggaggaggagcctgtggaggtggacagcagccccccagacagccctgccagcagcccctgcagcccccccctgaaggagaaggaggtgacccccaagcctgtgctgatcagcacccccacccccaccatcgtgcggcccggcagcctgcccctgcacctgggctatgaccccctgcaccccaccctgcccagccccaccagcgtcatcacccaggccccacccagcaaccggcagatgggcagccccaccggcagcctgcccctggtgatgcacctggccaacggccagaccatgcctgtgctgcccggcccccctgtgcagatgcccagcgtcatcagcctggcccggcctgtgtccatggtgcccaacatccctggcatccctggcccccctgtgaacagcagcggcagcatcagccccagcggccaccccatccccagcgaggccaagatgaggctgaaggccaccctgacccaccaggtgagcagcatcaatggaggctgcggcatggtggtgggcacagccagcaccatggtgacagcccggcctgagcagagccagatcctgatccagcacccagatgcccccagccctgcccagccccaggtgtccccagcccagcccacccccagcactggaggaagaagaagaagaacagtggatgaggaccctgatgaaagacggcagcgcttcctggagaggaacagagctgctgccagccgctgccggcagaagaggaagctgtgggtgagcagcctggagaagaaggccgaggagctgaccagccagaacatccagctgagcaatgaggtgaccctgctgagaaatgaggtggcccagctgaagcagctgctgctggcccacaaggactgccctgtgacagccctgcagaagaagacccagggctacctggagagccccaaggagagcagcgagcccaccggcagccctgcccctgtgatccagcacagcagcgccacagcccccagcaatggcctgtctgtgcgctctgctgctgaggccgtggccacctctgtgctgacccagatggccagccagaggacagagctgtccatgcccatccagagccacgtgatcatgaccccccagagccagagcgctggccgctag

SEQ ID NO: 142378 - DNA, 1389 bp, Artificial Sequence
  Description of Artificial Sequence: Synthetic coding sequence
atgggagatgaccggccctttgtgtgcaatgcccctggctgcggccagcgcttcaccaatgaagaccacctggccgtgcacaagcacaagcatgagatgaccctgaagtttggacctgccaggacagacagcgtcatcatcgctgaccagacccccacccccacccgcttcctgaagaactgtgaggaggtgggcctcttcaatgagctggccagcagctttgagcacgagttcaagaaggccgcagatgaagatgagaagaaggctgctgctggccccctggacatgagcctgcccagcaccccagacatcaagatcaaggaggaggagcctgtggaggaggtgacccccaagcctgtgctgatcagcacccccacccccaccatcgtgcggcccggcagcctgcccctgcacctgggctatgaccccctgcaccccaccctgcccagccccaccagcgtcatcacccaggccccacccagcaaccggcagatgggcagccccaccggcagcctgcccctggtgatgcacctggccaacggccagaccatgcctgtgctgcccggcccccctgtgcagatgcccagcgtcatcagcctggcccggcctgtgtccatggtgcccaacatccctggcatccctggcccccctgtgaacagcagcggcagcatcagccccagcggccaccccatccccagcgaggccaagatgaggctgaaggccaccctgacccaccaggtgagcagcatcaatggaggctgcggcatggtggtgggcacagccagcaccatggtgacagcccggcctgagcagagccagatcctgatccagcacccagatgcccccagccctgcccagccccaggtgtccccagcccagcccacccccagcactggaggaagaagaagaagaacagtggatgaggaccctgatgaaagacggcagcgcttcctggagaggaacagagctgctgccagccgctgccggcagaagaggaagctgtgggtgagcagcctggagaagaaggccgaggagctgaccagccagaacatccagctgagcaatgaggtgaccctgctgagaaatgaggtggcccagctgaagcagctgctgctggcccacaaggactgccctgtgacagccctgcagaagaagacccagggctacctggagagccccaaggagagcagcgagcccaccggcagccctgcccctgtgatccagcacagcagcgccacagcccccagcaatggcctgtctgtgcgctctgctgctgaggccgtggccacctctgtgctgacccagatggccagccagaggacagagctgtccatgcccatccagagccacgtgatcatgaccccccagagccagagcgctggccgctag

SEQ ID NO: 142379 - DNA, 1452 bp, Artificial Sequence
  Description of Artificial Sequence: Synthetic coding sequence
atgggagatgaccggccctttgtgtgcaatgcccctggctgcggccagcgcttcaccaatgaagaccacctggccgtgcacaagcacaagcatgagatgaccctgaagtttggacctgccaggacagacagcgtcatcatcgctgaccagacccccacccccacccgcttcctgaagaactgtgaggaggtgggcctcttcaatgagctggccagcagctttgagcacgagttcaagaaggccgcagatgaagatgagaagaaggctgctgctggccccctggacatgagcctgcccagcaccccagacatcaagatcaaggaggaggagcctgtggaggtggacagcagccccccagacagccctgccagcagcccctgcagcccccccctgaaggagaaggaggtgacccccaagcctgtgctgatcagcacccccacccccaccatcgtgcggcccggcagcctgcccctgcacctgggctatgaccccctgcaccccaccctgcccagccccaccagcgtcatcacccaggccccacccagcaaccggcagatgggcagccccaccggcagcctgcccctggtgatgcacctggccaacggccagaccatgcctgtgctgcccggcccccctgtgcagatgcccagcgtcatcagcctggcccggcctgtgtccatggtgcccaacatccctggcatccctggcccccctgtgaacagcagcggcagcatcagccccagcggccaccccatccccagcgaggccaagatgaggctgaaggccaccctgacccaccaggtgagcagcatcaatggaggctgcggcatggtggtgggcacagccagcaccatggtgacagcccggcctgagcagagccagatcctgatccagcacccagatgcccccagccctgcccagccccaggtgtccccagcccagcccacccccagcactggaggaagaagaagaagaacagtggatgaagatcctgatgagcggcggcagcgcttcctggagaggaacagagctgctgccagccgctgccggcagaagaggaagctgtgggtgagcagcctggagaagaaggccgaggagctgaccagccagaacatccagctgagcaatgaggtgaccctgctgagaaatgaggtggcccagctgaagcagctgctgctggcccacaaggactgccctgtgacagccctgcagaagaagacccagggctacctggagagccccaaggagagcagcgagcccaccggcagccctgcccctgtgatccagcacagcagcgccacagcccccagcaatggcctgtctgtgcgctctgctgctgaggccgtggccacctctgtgctgacccagatggccagccagaggacagagctgtccatgcccatccagagccacgtgatcatgaccccccagagccagagcgctggaagatag

SEQ ID NO: 142380 - DNA, 1452 bp, Artificial Sequence; identical to SEQ ID NO: 142379
  Description of Artificial Sequence: Synthetic coding sequence

SEQ ID NO: 142381 - DNA, 1485 bp, Artificial Sequence; identical to SEQ ID NO: 142377
  Description of Artificial Sequence: Synthetic coding sequence

SEQ ID NO: 142382 - DNA, 354 bp, Artificial Sequence
  Description of Artificial Sequence: Synthetic coding sequence
atgggagatgaccggccctttgtgtgcaatgcccctggctgcggccagcgcttcaccaatgaagaccacctggccgtgcacaagcacaagcatgagatgaccctgaagtttggacctgccaggacagacagcgtcatcatcgctgaccagacccccacccccacccgcttcctgaagaactgtgaggaggtgggcctcttcaatgagctggccagcagctttgagcacgagttcaagaaggccgcagatgaagatgagaagaaggcccggagcaggacagtggccaagaagctggtggtgttccggcccaggctcttcctgctgtgcttcggcatcatcttcctgattggatag

SEQ ID NO: 142383 - DNA, 354 bp, Artificial Sequence; identical to SEQ ID NO: 142382
  Description of Artificial Sequence: Synthetic coding sequence

SEQ ID NO: 142384 - DNA, 3813 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagcggagatgcccccagcggagatgtgtccccaggagatgccaccagcggagatgccacagcagatgacctgagcagcggggaccccaccagcagtgaccccatccctggagagcctgtgcctgtggagcccatcagcggggactgtgccgcagatgacatcgccagcagcgagatcacctctgtggacctggccagcggggccccagccagcacagatcctgccagtgatgacctggccagcggggacctgagcagcagcgagctggccagtgatgacctggccactggagagctggccagtgatgagctgaccagcgagagcacctttgacaggacctttgagcccaagtctgtgcctgtgtgtgagcctgtgcctgagattgacaacatcgagcccagcagcaacaaggatgatgacttcctggagaagaatggagcagatgagaagctggagcagatccagagcaaggacagcctggatgagaagaacaaggctgacaacaacattgatgccaatgaggagaccctggagacagatgacaccaccatctgcagcgaccggcccccagaaaatgagaagaaggtggaggaggacatcatcacagagctggccctgggagaagatgccatcagcagctccatggagattgaccagggcgagaagaatgaagatgagaccagcgctgacctggtggagaccatcaatgaaaatgtgattgaggacaacaagtctgagaacatcctggagaacacagacagcatggagacagatgagatcatccccatcctggagaagctggcccccagtgaagatgagctgacctgcttcagcaagaccagcctgctgcccattgatgagaccaacccagacctggaggagaagatggagagcagctttggcagccccagcaagcaggagagcagcgagagcctgcccaaggaggccttcctggtgctgagtgatgaggaggacatcagcggggagaaggatgagagcgaggtgatcagccagaatgagacctgcagccctgctgaggtggagagcaatgagaaggacaacaagccagaggaggaggagcaggtgattcatgaagatgatgagcggcccagcgagaagaatgagttcagcaggaggaagaggagcaagtctgaggacatggacaacgtgcagagcaagagaagacgctacatggaggaggagtatgaagctgagttccaggtgaagatcacagccaagggggacatcaaccagaagctgcagaaggtgatccagtggctgctggaggagaagctgtgtgccctgcagtgtgctgtgtttgacaagaccctggccgagctgaagaccagggtggagaagattgagtgcaacaagaggcacaagacagtgctgacagagctgcaggccaagatcgcccggctgaccaagagatttgaagctgccaaggaggacctgaagaagagacatgagcacccccccaacccccctgtgtcccctgggaagacagtgaatgatgtgaacagcaacaacaacatgagctacagaaatgccggcaccgtgcggcagatgctggagagcaagagaaatgtgtctgagagcgccccacccagcttccagacccctgtgaacacagtgagcagcaccaacctggtgaccccacctgctgtggtgagcagccagcccaagctgcagacccctgtgaccagcggcagcctgacagccacctctgtgctgcctgcccccaacacagccaccgtggtggccaccacccaggtgcccagcggcaacccccagcccaccatcagcctgcagcccctgcccgtcatcctgcacgtgcctgtggccgtgagcagccagccccagctgctgcagagccaccctggcaccctggtgaccaaccagcccagcggaaatgtggagttcatctctgtgcagagcccccccaccgtgtctggcctgaccaagaaccctgtgtccctgcccagcctgcccaaccccaccaagcccaacaacgtgcccagcgtgcccagccccagcatccagaggaaccccacagccagcgctgcccccctgggcaccaccctggccgtgcaggccgtgcccacagcccacagcatcgtgcaggccaccaggaccagcctgcccaccgtgggccccagcggcctgtacagccccagcaccaacagaggccccatccagatgaagatccccatcagcgccttcagcaccagcagcgctgctgagcagaacagcaacaccaccccaagaattgagaaccagaccaacaagaccattgatgcctctgtgtccaagaaggctgctgacagcaccagccagtgtgggaaggccactggaagtgacagcagcggcgtgattgacctgaccatggatgatgaggagagcggggccagccaggaccccaagaagctgaaccacacccctgtgtccaccatgagcagcagccagcctgtgtcccggcccctgcagcccatccagcctgccccacccctgcagcccagcggcgtgcccaccagcggccccagccagaccaccatccacctgctgcccacagcccccaccaccgtgaatgtgacccacaggcctgtgacccaggtgaccacccggctgcctgtgccccgggccccagccaaccaccaggtggtgtacaccaccctgcctgcccccccagcccaggcccccctgcggggcaccgtgatgcaggccccagctgtgcggcaggtgaacccccagaacagcgtgacagtgcgggtgccccagaccaccacctacgtggtgaacaacggcctgaccctgggcagcacaggcccccagctgactgtgcaccaccggcccccccaggtgcacacagagccccccaggcctgtgcacccagcccccctgcctgaggccccccagccccagaggctgcccccagaggccgccagcaccagcctgccccagaagccccacctgaagctggcccgggtgcagagccagaatggaattgtgctgtcctggagcgtgctggaggtggacaggagctgtgccaccgtggacagctaccacctgtatgcctaccacgaggagcccagcgccaccgtgcccagccagtggaagaagatcggggaggtgaaggccctgcccctgcccatggcctgcaccctgacccagtttgtgtctggcagcaagtactactttgctgtgcgggccaaggacatctacggccgcttcggccccttctgtgacccccagagcacagatgtgatcagcagcacccagagcagctag

SEQ ID NO: 142385 - DNA, 1548 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagcggagatgcccccagcggagatgtgtccccaggagatgccaccagcggagatgccacagcagatgacctgagcagcggggaccccaccagcagtgaccccatccctggagagcctgtgcctgtggagcccatcagcggggactgtgccgcagatgacatcgccagcagcgagatcacctctgtggacctggccagcggggccccagccagcacagatcctgccagtgatgacctggccagcggggacctgagcagcagcgagctggccagtgatgacctggccactggagagctggccagtgatgagctgaccagcgagagcacctttgacaggacctttgagcccaagtctgtgcctgtgtgtgagcctgtgcctgagattgacaacatcgagcccagcagcaacaaggatgatgacttcctggagaagaatggagcagatgagaagctggagcagatccagagcaaggacagcctggatgagaagaacaaggctgacaacaacattgatgccaatgaggagaccctggagacagatgacaccaccatctgcagcgaccggcccccagaaaatgagaagaaggtggaggaggacatcatcacagagctggccctgggagaagatgccatcagcagctccatggagattgaccagggcgagaagaatgaagatgagaccagcgctgacctggtggagaccatcaatgaaaatgtgattgaggacaacaagtctgagaacatcctggagaacacagacagcatggagacagatgagatcatccccatcctggagaagctggcccccagtgaagatgagctgacctgcttcagcaagaccagcctgctgcccattgatgagaccaacccagacctggaggagaagatggagagcagctttggcagccccagcaagcaggagagcagcgagagcctgcccaaggaggccttcctggtgctgagtgatgaggaggacatcagcggggagaaggatgagagcgaggtgatcagccagaatgaatag

SEQ ID NO: 142386 - DNA, 378 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgtag

SEQ ID NO: 142387 - DNA, 459 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggctag

SEQ ID NO: 142388 - DNA, 312 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcagtag

SEQ ID NO: 142389 - DNA, 270 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaagtag

SEQ ID NO: 142390 - DNA, 534 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagcggctag

SEQ ID NO: 142391 - DNA, 3813 bp, Artificial Sequence; identical to SEQ ID NO: 142384
  Description of Artificial Sequence: Synthetic coding sequence

SEQ ID NO: 142392 - DNA, 510 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgcctag

SEQ ID NO: 142393 - DNA, 99 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgtag

SEQ ID NO: 142394 - DNA, 399 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggatag

SEQ ID NO: 142395 - DNA, 531 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagctag

SEQ ID NO: 142396 - DNA, 180 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctgtag

SEQ ID NO: 142397 - DNA, 3318 bp, Artificial Sequence
  Description of Artificial Sequence: Synthetic coding sequence
atggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagcggagatgcccccagcggagatgtgtccccaggagatgccaccagcggagatgccacagcagatgacctgagcagcggggaccccaccagcagtgaccccatccctggagagcctgtgcctgtggagcccatcagcggggactgtgccgcagatgacatcgccagcagcgagatcacctctgtggacctggccagcggggccccagccagcacagatcctgccagtgatgacctggccagcggggacctgagcagcagcgagctggccagtgatgacctggccactggagagctggccagtgatgagctgaccagcgagagcacctttgacaggacctttgagcccaagtctgtgcctgtgtgtgagcctgtgcctgagattgacaacatcgagcccagcagcaacaaggatgatgacttcctggagaagaatggagcagatgagaagctggagcagatccagagcaaggacagcctggatgagaagaacaaggctgacaacaacattgatgccaatgaggagaccctggagacagatgacaccaccatctgcagcgaccggcccccagaaaatgagaagaaggtggaggaggacatcatcacagagctggccctgggagaagatgccatcagcagctccatggagattgaccagggcgagaagaatgaagatgagaccagcgctgacctggtggagaccatcaatgaaaatgtgattgaggacaacaagtctgagaacatcctggagaacacagacagcatggagacagatgagatcatccccatcctggagaagctggcccccagtgaagatgagctgacctgcttcagcaagaccagcctgctgcccattgatgagaccaacccagacctggaggagaagatggagagcagctttggcagccccagcaagcaggagagcagcgagagcctgcccaaggaggccttcctggtgctgagtgatgaggaggacatcagcggggagaaggatgagagcgaggtgatcagccagaatgagacctgcagccctgaggtggagagcaatgagaaggacaacaagccagaggaggaggagcaggtgattcatgaagatgatgagcggcccagcgagaagaatgagttcagcaggaggaagaggagcaagtctgaggacatggacaacgtgcagagcaagagaagacgctacatggaggaggagtatgaggccgagttccaggtgaagatcacagccaagggggacatcaaccagaagctgcagaaggtgatccagtggctgctggaggagaagctgtgtgccctgcagtgtgctgtgtttgacaagaccctggccgagctgaagaccagggtggagaagattgagtgcaacaagaggcacaagacagtgctgacagagctgcaggccaagatcgcccggctgaccaagagatttgaggccgccaaggaggacctgaagaagagacatgagcacccccccaacccccctgtgtccccaggcaagacagtgaatgatgtgaacagcaacaacaacatgagctacagaaatgccggcaccgtgcggcagatgctggagagcaagagaaatgtgtctgagagcgcccctccttccttccagacccctgtgaacacagtgagcagcaccaacctggtgaccccacctgctgtggtgagcagccagcccaagctgcagacccctgtgaccagcggcagcctgacagccacctctgtgctgcctgcccccaacacagccaccgtggtggccaccacccaggtgcccagcggcaacccccagcccaccatcagcctgcagcccctgcctgtgatcctgcacgtgcctgtggccgtgagcagccagccccagctgctgcagagccaccctggcaccctggtgaccaaccagcccagcggaaatgtggagttcatctctgtgcagagccccccaacagtgtctggcctgaccaagaaccctgtgtccctgcccagcctgcccaaccccaccaagcccaacaacgtgcccagcgtgcccagccccagcatccagaggaaccccacagccagcgctgcccccctgggcaccaccctggccgtgcaggccgtgcccacagcccacagcatcgtgcaggccaccaggaccagcctgcccaccgtgggccccagcggcctgtacagccccagcaccaacagaggccccatccagatgaagatccccatcagcgccttcagcaccagcagcgctgctgagcagaacagcaacaccaccccaagaattgagaaccagaccaacaagaccattgatgcctctgtgtccaagaaggctgctgacagcaccagccagtgtgggaaggccaccggcagtgacagcagtggagtcatcgacctgaccatggatgatgaggagagcggggccagccaggaccccaagaagctgaaccacacccctgtgtccaccatgagcagcagccagcctgtgtcccggcccctgcagcccatccagcctgccccacccctgcagcccagcggcgtgcccaccagcggccccagccagaccaccatccacctgctgcccacagcccccaccaccgtgaatgtgacccacaggcctgtgacccaggtgaccacccggctgcctgtgccccgggccccagccaaccaccaggtggtgtacaccaccctgcctgcccccccagcccaggcccccctgcggggcaccgtgatgcaggccccagctgtgcggcaggtgaacccccagaacagcaagcgcttcttcctgtacatggccccccgctacatgtag

SEQ ID NO: 142398 - DNA, 3837 bp, Artificial Sequence
  Description of Artificial Sequence: Synthetic coding sequence
atgcaccaggaccagcgcttcaggatggacagcctggaggagccccagaagaaggtgttcaaggccaggaagaccatgagggtgtctgaccggcagcagctggaggccgtgtacaaggtgaaggaggagctgctgaagacagatgtgaagctgctgaatggaaatcatgaaaatggagacctggaccccaccagccccctggagaacatggactacatcaaggacaaggaggaggtgaatggcatcgaggagatctgctttgatcctgagggcagcaaggccgagtggaaggagaccccctgcatcctgtctgtgaatgtgaagaacaagcaggatgatgacctgaactgtgagcccctgagcccccacaacatcaccccagagcctgtgtccaagctgcctgctgagcctgtgtctggggaccctgcccctggggacctggatgctggggaccctgccagcggcgtgctggccagcggggacagcaccagcggggaccccaccagcagcgagcccagcagcagtgatgctgccagcggagatgccaccagcggagatgcccccagcggagatgtgtccccaggagatgccaccagcggagatgccacagcagatgacctgagcagcggggaccccaccagcagtgaccccatccctggagagcctgtgcctgtggagcccatcagcggggactgtgccgcagatgacatcgccagcagcgagatcacctctgtggacctggccagcggggccccagccagcacagatcctgccagtgatgacctggccagcggggacctgagcagcagcgagctggccagtgatgacctggccactggagagctggccagtgatgagctgaccagcgagagcacctttgacaggacctttgagcccaagtctgtgcctgtgtgtgagcctgtgcctgagattgacaacatcgagcccagcagcaacaaggatgatgacttcctggagaagaatggagcagatgagaagctggagcagatccagagcaaggacagcctggatgagaagaacaaggctgacaacaacattgatgccaatgaggagaccctggagacagatgacaccaccatctgcagcgaccggcccccagaaaatgagaagaaggtggaggaggacatcatcacagagctggccctgggagaagatgccatcagcagctccatggagattgaccagggcgagaagaatgaagatgagaccagcgctgacctggtggagaccatcaatgaaaatgtgattgaggacaacaagtctgagaacatcctggagaacacagacagcatggagacagatgagatcatccccatcctggagaagctggcccccagtgaagatgagctgacctgcttcagcaagaccagcctgctgcccattgatgagaccaacccagacctggaggagaagatggagagcagctttggcagccccagcaagcaggagagcagcgagagcctgcccaaggaggccttcctggtgctgagtgatgaggaggacatcagcggggagaaggatgagagcgaggtgatcagccagaatgagacctgcagccctgctgaggtggagagcaatgagaaggacaacaagccagaggaggaggagcaggtgattcatgaagatgatgagcggcccagcgagaagaatgagttcagcaggaggaagaggagcaagtctgaggacatggacaacgtgcagagcaagagaagacgctacatggaggaggagtatgaagctgagttccaggtgaagatcacagccaagggggacatcaaccagaagctgcagaaggtgatccagtggctgctggaggagaagctgtgtgccctgcagtgtgctgtgtttgacaagaccctggccgagctgaagaccagggtggagaagattgagtgcaacaagaggcacaagacagtgctgacagagctgcaggccaagatcgcccggctgaccaagagatttgaagctgccaaggaggacctgaagaagagacatgagcacccccccaacccccctgtgtcccctgggaagacagtgaatgatgtgaacagcaacaacaacatgagctacagaaatgccggcaccgtgcggcagatgctggagagcaagagaaatgtgtctgagagcgccccacccagcttccagacccctgtgaacacagtgagcagcaccaacctggtgaccccacctgctgtggtgagcagccagcccaagctgcagacccctgtgaccagcggcagcctgacagccacctctgtgctgcctgcccccaacacagccaccgtggtggccaccacccaggtgcccagcggcaacccccagcccaccatcagcctgcagcccctgcccgtcatcctgcacgtgcctgtggccgtgagcagccagccccagctgctgcagagccaccctggcaccctggtgaccaaccagcccagcggaaatgtggagttcatctctgtgcagagcccccccaccgtgtctggcctgaccaagaaccctgtgtccctgcccagcctgcccaaccccaccaagcccaacaacgtgcccagcgtgcccagccccagcatccagaggaaccccacagccagcgctgcccccctgggcaccaccctggccgtgcaggccgtgcccacagcccacagcatcgtgcaggccaccaggaccagcctgcccaccgtgggccccagcggcctgtacagccccagcaccaacagaggccccatccagatgaagatccccatcagcgccttcagcaccagcagcgctgctgagcagaacagcaacaccaccccaagaattgagaaccagaccaacaagaccattgatgcctctgtgtccaagaaggctgctgacagcaccagccagtgtgggaaggccactggaagtgacagcagcggcgtgattgacctgaccatggatgatgaggagagcggggccagccaggaccccaagaagctgaaccacacccctgtgtccaccatgagcagcagccagcctgtgtcccggcccctgcagcccatccagcctgccccacccctgcagcccagcggcgtgcccaccagcggccccagccagaccaccatccacctgctgcccacagcccccaccaccgtgaatgtgacccacaggcctgtgacccaggtgaccacccggctgcctgtgccccgggccccagccaaccaccaggtggtgtacaccaccctgcctgcccccccagcccaggcccccctgcggggcaccgtgatgcaggccccagctgtgcggcaggtgaacccccagaacagcgtgacagtgcgggtgccccagaccaccacctacgtggtgaacaacggcctgaccctgggcagcacaggcccccagctgactgtgcaccaccggcccccccaggtgcacacagagccccccaggcctgtgcacccagcccccctgcctgaggccccccagccccagaggctgcccccagaggccgccagcaccagcctgccccagaagccccacctgaagctggcccgggtgcagagccagaatggaattgtgctgtcctggagcgtgctggaggtggacaggagctgtgccaccgtggacagctaccacctgtatgcctaccacgaggagcccagcgccaccgtgcccagccagtggaagaagatcggggaggtgaaggccctgcccctgcccatggcctgcaccctgacccagtttgtgtctggcagcaagtactactttgctgtgcgggccaaggacatctacggccgcttcggccccttctgtgacccccagagcacagatgtgatcagcagcacccagagcagctag

SEQ ID NO: 142399 - DNA, 510 bp, Artificial Sequence; identical to SEQ ID NO: 142392
  Description of Artificial Sequence: Synthetic coding sequence

SEQ ID NO: 142400 - DNA, 1632 bp, Artificial Sequence
  Description of Artificial Sequence: Synthetic coding sequence
atggccagcccagacaggagcaagaggaagatcctgaaggccaagaagaccatgcccctgagctgcaggaagcaggtggagatgctgaacaagagcagaaatgtggaggccctgaagacagccatcggcagcaatgtgcccagcggcaaccagagcttcagccccagcgtcatcaccaggaccacagagatcaccaagtgcagccccagtgaaaatggagccagcagcctggacagcaacaagaacagcatcagcgagaagagcaaggtgttcagccagaactgcatcaagcctgtggaggagatcgtgcacagcgagaccaagctggagcaggtggtgtgcagctaccagaagcccagcaggaccacagagagccccagcagggtcttcacagaggaggccaaggacagcctgaacaccagtgaaaatgattctgagcaccagaccaacgtgaccaggagcctgtttgagcacgagggcgcctgcagcctgaagagcagctgctgcccccccagcgtgctgtctggagtggtgcagatgcctgagagcacagtgaccagcacagtgggggacaagaagacagaccagatggtgttccacctggagaccaacagcaacagcgagagccatgacaagaggcagagcgacaacatcctgtgcagcgaggacagcggctttgtgcctgtggagaagacccccaacctggtgaacagcgtgaccagcaacaactgtgctgatgacatcctgaagacagatgaatgttccaggaccagcatcagcaactgtgagagcgctgacagcacctggcagagcagcctggacaccaacaacaacagccactaccagaagaagaggatgttttctgaaaatgaggagaatgtgaagaggatgaagaccagcgagcagatcaatgaaaacatctgtgtgtccctggagcggcagacagccttcctggagcaggtgcgccacctgatccagcaggagatctacagcatcaactatgagctgtttgacaagaagctgaaggagctgaaccagagaattggcaagacagagtgcaggaacaagcatgagggcattgctgacaagctgctggccaagatcgccaagctgcagaggcgcatcaagacagtgctgctcttccagaggaactgcctgaagcccaacatgctgagcagcaatggagccagcaaggtggccaacagcgaggccatgatcctggacaagaacctggagagcgtgaacagccccatcgagaagagctctgtgaactatgagcccagcaaccccagcgagaagggcagcaagaagatcaacctgagcagtgaccagaacaagtctgtgtctgagagcaacaatgatgatgtgatgctgatctctgtggagagccccaacctgaccacccccatcaccagcaaccccacagacaccaggaagatcaccagcggcaacagcagcaacagccccaatgctgaggtgatgaaggtgcagtacccaccctggagccacatcaggaagctgctgcagacccagaggaagcagccccactggcacaagatgcagagccgcttcctgagccccctgagcacctgccacctgagccagaaccaccagcaccactacctgaactag

SEQ ID NO: 142401 - DNA, 2049 bp, Artificial Sequence
  Description of Artificial Sequence: Synthetic coding sequence
atggccagcccagacaggagcaagaggaagatcctgaaggccaagaagaccatgcccctgagctgcaggaagcaggtggagatgctgaacaagagcagaaatgtggaggccctgaagacagccatcggcagcaatgtgcccagcggcaaccagagcttcagccccagcgtcatcaccaggaccacagagatcaccaagtgcagccccagtgaaaatggagccagcagcctggacagcaacaagaacagcatcagcgagaagagcaaggtgttcagccagaactgcatcaagcctgtggaggagatcgtgcacagcgagaccaagctggagcaggtggtgtgcagctaccagaagcccagcaggaccacagagagccccagcagggtcttcacagaggaggccaaggacagcctgaacaccagtgaaaatgattctgagcaccagaccaacgtgaccaggagcctgtttgagcacgagggcgcctgcagcctgaagagcagctgctgcccccccagcgtgctgtctggagtggtgcagatgcctgagagcacagtgaccagcacagtgggggacaagaagacagaccagatggtgttccacctggagaccaacagcaacagcgagagccatgacaagaggcagagcgacaacatcctgtgcagcgaggacagcggctttgtgcctgtggagaagacccccaacctggtgaacagcgtgaccagcaacaactgtgctgatgacatcctgaagacagatgaatgttccaggaccagcatcagcaactgtgagagcgctgacagcacctggcagagcagcctggacaccaacaacaacagccactaccagaagaagaggatgttttctgaaaatgaggagaatgtgaagaggatgaagaccagcgagcagatcaatgaaaacatctgtgtgtccctggagcggcagacagccttcctggagcaggtgcgccacctgatccagcaggagatctacagcatcaactatgagctgtttgacaagaagctgaaggagctgaaccagagaattggcaagacagagtgcaggaacaagcatgagggcattgctgacaagctgctggccaagatcgccaagctgcagaggcgcatcaagacagtgctgctcttccagaggaactgcctgaagcccaacatgctgagcagcaatggagccagcaaggtggccaacagcgaggccatgatcctggacaagaacctggagagcgtgaacagccccatcgagaagagctctgtgaactatgagcccagcaaccccagcgagaagggcagcaagaagatcaacctgagcagtgaccagaacaagtctgtgtctgagagcaacaatgatgatgtgatgctgatctctgtggagagccccaacctgaccacccccatcaccagcaaccccacagacaccaggaagatcaccagcggcaacagcagcaacagccccaatgctgaggtgatggctgtgcagaagaagctggacagcatcatcgacctgaccaaggagggcctgagcaactgcaacacagagagccctgtgagccccctggagagccacagcaaggccgccagcaacagcaaggagaccacccccctggcccagaatgctgtgcaggtgcctgagagctttgagcacctgccccccctgcctgagcccccagcccccctgcctgagctggtggacaagacccgggacaccctgcccccccagaagccagagctgaaggtgaagagggtcttccggcccaacggcatcgccctgacctggaacatcaccaagatcaaccccaagtgtgcccctgtggagagctaccacctgttcctgtgccacgagaacagcaacaacaagctgatctggaagaagattggagagatcaaggccctgcccctgcccatggcctgcaccctgagccagttcctggccagcaaccgctactacttcaccgtgcagagcaaggacatcttcggccgctatggccccttctgtgacatcaagagcatccctggcttcagcgagaacctgacctag

SEQ ID NO: 142402 - DNA, 1632 bp, Artificial Sequence; identical to SEQ ID NO: 142400
  Description of Artificial Sequence: Synthetic coding sequence

SEQ ID NO: 142403 - DNA, 2049 bp, Artificial Sequence; identical to SEQ ID NO: 142401
  Description of Artificial Sequence: Synthetic coding sequence

SEQ ID NO: 142404 - DNA, 1278 bp, Artificial Sequence
  Description of Artificial Sequence: Synthetic coding sequence
atggccagcccagacaggagcaagaggaagatcctgaaggccaagaagaccatgcccctgagctgcaggaagcaggtggagatgctgaacaagagcagaaatgtggaggccctgaagacagccatcggcagcaatgtgcccagcggcaaccagagcttcagccccagcgtcatcaccaggaccacagagatcaccaagtgcagccccagtgaaaatggagccagcagcctggacagcaacaagaacagcatcagcgagaagagcaaggtgttcagccagaactgcatcaagcctgtggaggagatcgtgcacagcgagaccaagctggagcaggtggtgtgcagctaccagaagcccagcaggaccacagagagccccagcagggtcttcacagaggaggccaaggacagcctgaacaccagtgaaaatgattctgagcaccagaccaacgtgaccaggagcctgtttgagcacgagggcgcctgcagcctgaagagcagctgctgcccccccagcgtgctgtctggagtggtgcagatgcctgagagcacagtgaccagcacagtgggggacaagaagacagaccagatggtgttccacctggagaccaacagcaacagcgagagccatgacaagaggcagagcgacaacatcctgtgcagcgaggacagcggctttgtgcctgtggagaagacccccaacctggtgaacagcgtgaccagcaacaactgtgctgatgacatcctgaagacagatgaatgttccaggaccagcatcagcaactgtgagagcgctgacagcacctggcagagcagcctggacaccaacaacaacagccactaccagaagaagaggatgttttctgaaaatgaggagaatgtgaagaggatgaagaccagcgagcagatcaatgaaaacatctgtgtgtccctggagcggcagacagccttcctggagcaggtgcgccacctgatccagcaggagatctacagcatcaactatgagctgtttgacaagaagctgaaggagctgaaccagagaattggcaagacagagtgcaggaacaagcatgagggcattgctgacaagctgctggccaagatcgccaagctgcagaggcgcatcaagacagtgctgctcttccagaggaactgcctgaagcccaacatgctgagcagcaatggagccagcaagatccctgagaagctgcaccaggagatcctggccatcctgcccatgctgaagctgtggctgtacagaagaaacctgatcctgtag

SEQ ID NO: 142405 - DNA, 681 bp, Artificial Sequence
  Description of Artificial Sequence: Synthetic coding sequence
atgctgatctctgtggagagccccaacctgaccacccccatcaccagcaaccccacagacaccaggaagatcaccagcggcaacagcagcaacagccccaatgctgaggtgatggctgtgcagaagaagctggacagcatcatcgacctgaccaaggagggcctgagcaactgcaacacagagagccctgtgagccccctggagagccacagcaaggccgccagcaacagcaaggagaccacccccctggcccagaatgctgtgcaggtgcctgagagctttgagcacctgccccccctgcctgagcccccagcccccctgcctgagctggtggacaagacccgggacaccctgcccccccagaagccagagctgaaggtgaagagggtcttccggcccaacggcatcgccctgacctggaacatcaccaagatcaaccccaagtgtgcccctgtggagagctaccacctgttcctgtgccacgagaacagcaacaacaagctgatctggaagaagattggagagatcaaggccctgcccctgcccatggcctgcaccctgagccagttcctggccagcaaccgctactacttcaccgtgcagagcaaggacatcttcggccgctatggccccttctgtgacatcaagagcatccctggcttcagcgagaacctgacctag

SEQ ID NO: 142406 - DNA, 714 bp, Artificial Sequence
  Description of Artificial Sequence: Synthetic coding sequence
atgaccagcgagatcacctacgccgaggtgcgcttcaagaatgagttcaagagcagcggcatcaacacagccagcagcgctgccagcaaggagaggacagccccccacaagagcaacacaggcttccccaagctgctgtgtgccagcctgctgatcttcttcctgctgctggccatctccttcttcatcgcctttgtgatcttcttccagaagtacagccagctgctggagaagaagaccaccaaggagctggtgcacaccaccctggagtgtgtgaagaagaacatgcctgtggaggagacagcctggagctgctgccccaagaactggaagagcttcagcagcaactgctacttcatcagcacagagagcgcctcctggcaggacagcgagaaggactgtgccaggatggaggcccacctgctggtgatcaacacccaggaggagcaggacttcatcttccagaacctgcaggaggagagcgcctactttgtgggcctgagtgaccctgagggccagaggcactggcagtgggtggaccagaccccctacaatgaaagcagcaccttctggcacccccgggagcccagcgaccccaatgaaagatgtgtggtgctgaacttcaggaagagccccaagcgctggggctggaatgatgtgaactgcctgggcccccagaggtctgtgtgtgagatgatgaagatccacctgtag

SEQ ID NO: 142407 - DNA, 2469 bp, Artificial Sequence
  Description of Artificial Sequence: Synthetic coding sequence
atggaggaggaggaggaggccatcggcctgctggacaaggtgctggaggatgaagatgtgttcctgctggaggagtgtgagctgggcacccccaccagccctggcagcggcagccccttcctggtggccgtgaaggtggaggccggcaagggcctggagatgaggaagctggtgctgagcggcttcctggccagcgaggagatctacatcaaccagctggaggccctgctgctgcccatgaagcccctgaaggccacagccaccaccagccagcctgtgctgaccatccagcagatcgagaccatcttctacaagatccaggacatctatgagatccacaaggagttctatgacaacctgtgccccaaggtgcagcagtgggacagccaggtgaccatgggccacctgttccagaagctggccagccagctgggcgtgtacaaggcctttgtggacaactacaaggtggccctggagacagctgagaagtgcagccagagcaacaaccagttccagaagatcagcgaggagctgaaggtgaagggccccaaggacagcaaggacagccacacctctgtgaccatggaggccctgctgtacaagcccatcgacagagtgaccaggagcaccctggtgctgcatgacctgctgaagcacacccctgtggaccacccagactaccccctgctgcaggatgccctgcgcatcagccagaacttcctgagcagcatcaatgaagacatcgaccccaggagaacagctgtgaccacccccaagggggagacccggcagctggtgaaggatggcttcctggtggaggtgtctgagagcagcaggaagctgcggcacgtgttcctgttcacagatgtgctgctgtgtgccaagctgaagaagaccagcgctgggaagcaccagcagtatgactgcaagtggtacatccccctggccgacctggtgttccccagccctgaggagagcgaggccagcccccaggtgcaccccttcccagaccacgagctggaggacatgaagatgaagatcagcgccctgaagtctgagatccagaaggagaaggccaacaagggccagagccgggccatcgagcggctgaagaagaagatgtttgaaaatgagttcctgctgctgctgaacagccccaccatccccttccgcatccacaacagaaatggcaagagctacctgttcctgctgagcagtgactatgaaagaagtgagtggagggaggccatccagaagctgcagaagaaggacctgcaggcctttgtgctgagctctgtggagctgcaggtgctgaccggcagctgcttcaagctgaggacagtgcacaacatccctgtgaccagcaacaaggatgatgatgagagccctggcctgtatggcttcctgcacgtgattgtgcacagcgccaagggcttcaagcagagcgccaacctgtactgcaccctggaggtggacagctttggctactttgtgtccaaggccaagaccagggtcttccgggacacagctgagcccaagtgggatgaggagtttgaaattgagctggagggcagccagagcctgcgcatcctgtgctatgaaaaatgttatgacaagaccaaggtgaacaaggacaacaatgaaattgtggacaagatcatgggcaagggccagatccagctggacccccagacagtggagaccaagaactggcacacagatgtgattgagatgaatggcatcaaggtggagttctccatgaagttcaccagccgggacatgagcctgaagaggacccccagcaagaagcagacaggagtgtttggagtgaagatctctgtggtgaccaagcgggagaggagcaaggtgccctacatcgtgcggcagtgtgtggaggaggtggagaagaggggcatcgaggaggtgggcatctaccgcatcagcggcgtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgtacccagccttcatggagggcatcgccctgagtgaccctgctgccaaggagaactgcatgatgcacctgctgcggagcctgcctgaccccaacctgatcaccttcctgttcctgctggagcacctgaagagggtggccgagaaggagcccatcaacaagatgagcctgcacaacctggccaccgtgtttggccccaccctgctgcggcccagcgaggtggagagcaaggcccacctgaccagcgctgctgacatctggagccatgatgtgatggcccaggtgcaggtgctgctgtactacctgcagcacccccccatcagctttgctgagctgaagaggaacaccctgtacttcagcacagatgtgtag

SEQ ID NO: 142408 - DNA, 2580 bp, Artificial Sequence
  Description of Artificial Sequence: Synthetic coding sequence
atggagcccctgagccaccggggcctgccccggctgtcctggattgacaccctgtacagcaacttctcctatggaacagatgaatatgatggagagggcaatgaggagcagaagggccccccagagggcagcgagaccatgccctacattgatgagagccccaccatgagcccccagctgagcgcccggagccagggcggcggagatggagtgagccccaccccacctgagggcctggcccctggggtggaggccggcaagggcctggagatgaggaagctggtgctgagcggcttcctggccagcgaggagatctacatcaaccagctggaggccctgctgctgcccatgaagcccctgaaggccacagccaccaccagccagcctgtgctgaccatccagcagatcgagaccatcttctacaagatccaggacatctatgagatccacaaggagttctatgacaacctgtgccccaaggtgcagcagtgggacagccaggtgaccatgggccacctgttccagaagctggccagccagctgggcgtgtacaaggcctttgtggacaactacaaggtggccctggagacagctgagaagtgcagccagagcaacaaccagttccagaagatcagcgaggagctgaaggtgaagggccccaaggacagcaaggacagccacacctctgtgaccatggaggccctgctgtacaagcccatcgacagagtgaccaggagcaccctggtgctgcatgacctgctgaagcacacccctgtggaccacccagactaccccctgctgcaggatgccctgcgcatcagccagaacttcctgagcagcatcaatgaagatattgaccccaggagaacagctgtgaccacccccaagggggagacccggcagctggtgaaggatggcttcctggtggaggtgtctgagagcagcaggaagctgcggcacgtgttcctgttcacagatgtgctgctgtgtgccaagctgaagaagaccagcgctgggaagcaccagcagtatgactgcaagtggtacatccccctggccgacctggtgttccccagccctgaggagagcgaggccagcccccaggtgcaccccttcccagaccacgagctggaggacatgaagatgaagatcagcgccctgaagtctgagatccagaaggagaaggccaacaagggccagagccgggccatcgagcggctgaagaagaagatgtttgaaaatgagttcctgctgctgctgaacagccccaccatccccttccgcatccacaacagaaatggcaagagctacctgttcctgctgagcagtgactatgaaagaagtgagtggagggaggccatccagaagctgcagaagaaggacctgcaggcctttgtgctgagctctgtggagctgcaggtgctgaccggcagctgcttcaagctgaggacagtgcacaacatccctgtgaccagcaacaaggatgatgatgagagccctggcctgtatggcttcctgcacgtgattgtgcacagcgccaagggcttcaagcagagcgccaacctgtactgcaccctggaggtggacagctttggctactttgtgtccaaggccaagaccagggtcttccgggacacagctgagcccaagtgggatgaggagtttgaaattgagctggagggcagccagagcctgcgcatcctgtgctatgagaagtgctatgacaagaccaaggtgaacaaggacaacaatgagatcgtggacaagatcatgggcaagggccagatccagctggacccccagacagtggagaccaagaactggcacacagatgtgattgagatgaatggcatcaaggtggagttctccatgaagttcaccagccgggacatgagcctgaagaggacccccagcaagaagcagacaggagtgtttggagtgaagatctctgtggtgaccaagcgggagaggagcaaggtgccctacatcgtgcggcagtgtgtggaggaggtggagaagaggggcatcgaggaggtgggcatctaccgcatctctggagtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgtacccagccttcatggagggcatcgccctgagtgaccctgctgccaaggagaactgcatgatgcacctgctgcggagcctgcctgaccccaacctgatcaccttcctgttcctgctggagcacctgaagagggtggccgagaaggagcccatcaacaagatgagcctgcacaacctggccaccgtgtttggccccaccctgctgcggcccagcgaggtggagagcaaggcccacctgaccagcgctgctgacatctggagccatgatgtgatggcccaggtgcaggtgctgctgtactacctgcagcacccccccatcagctttgctgagctgaagaggaacaccctgtacttcagcacagatgtgtag

SEQ ID NO: 142409 - DNA, 1092 bp, Artificial Sequence
  Description of Artificial Sequence: Synthetic coding sequence
atgaagcccctgaaggccacagccaccaccagccagcctgtgctgaccatccagcagatcgagaccatcttctacaagatccaggacatctatgagatccacaaggagttctatgacaacctgtgccccaaggtgcagcagtgggacagccaggtgaccatgggccacctgttccagaagctggccagccagctgggcgtgtacaaggcctttgtggacaactacaaggtggccctggagacagctgagaagtgcagccagagcaacaaccagttccagaagatcagcgaggagctgaaggtgaagggccccaaggacagcaaggacagccacacctctgtgaccatggaggccctgctgtacaagcccatcgacagagtgaccaggagcaccctggtgctgcatgacctgctgaagcacacccctgtggaccacccagactaccccctgctgcaggatgccctgcgcatcagccagaacttcctgagcagcatcaatgaagatattgaccccaggagaacagctgtgaccacccccaagggggagacccggcagctggtgaaggatggcttcctggtggaggtgtctgagagcagcaggaagctgcggcacgtgttcctgttcacagatgtgctgctgtgtgccaagctgaagaagaccagcgctgggaagcaccagcagtatgactgcaagtggtacatccccctggccgacctggtgttccccagccctgaggagagcgaggccagcccccaggtgcaccccttcccagaccacgagctggaggacatgaagatgaagatcagcgccctgaagtctgagatccagaaggaggaggtggagaagaggggcatcgaggaggtgggcatctaccgcatcagcggcgtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgagcccctgccccacccccaccagcagccccagcagcagctgctggaacacctag

SEQ ID NO: 142410 - DNA, 1926 bp, Artificial Sequence
  Description of Artificial Sequence: Synthetic coding sequence
atggagatcctgctgatcatccgcttctgctgcaactgcacctacgccctgctgtacaagcccatcgacagagtgaccaggagcaccctggtgctgcatgacctgctgaagcacacccctgtggaccacccagactaccccctgctgcaggatgccctgcgcatcagccagaacttcctgagcagcatcaatgaagatattgaccccaggagaacagctgtgaccacccccaagggggagacccggcagctggtgaaggatggcttcctggtggaggtgtctgagagcagcaggaagctgcggcacgtgttcctgttcacagatgtgctgctgtgtgccaagctgaagaagaccagcgctgggaagcaccagcagtatgactgcaagtggtacatccccctggccgacctggtgttccccagccctgaggagagcgaggccagcccccaggtgcaccccttcccagaccacgagctggaggacatgaagatgaagatcagcgccctgaagtctgagatccagaaggagaaggccaacaagggccagagccgggccatcgagcggctgaagaagaagatgtttgaaaatgagttcctgctgctgctgaacagccccaccatccccttccgcatccacaacagaaatggcaagagctacctgttcctgctgagcagtgactatgaaagaagtgagtggagggaggccatccagaagctgcagaagaaggacctgcaggcctttgtgctgagctctgtggagctgcaggtgctgaccggcagctgcttcaagctgaggacagtgcacaacatccctgtgaccagcaacaaggatgatgatgagagccctggcctgtatggcttcctgcacgtgattgtgcacagcgccaagggcttcaagcagagcgccaacctgtactgcaccctggaggtggacagctttggctactttgtgtccaaggccaagaccagggtcttccgggacacagctgagcccaagtgggatgaggagtttgaaattgagctggagggcagccagagcctgcgcatcctgtgctatgagaagtgctatgacaagaccaaggtgaacaaggacaacaatgagatcgtggacaagatcatgggcaagggccagatccagctggacccccagacagtggagaccaagaactggcacacagatgtgattgagatgaatggcatcaaggtggagttctccatgaagttcaccagccgggacatgagcctgaagaggacccccagcaagaagcagacaggagtgtttggagtgaagatctctgtggtgaccaagcgggagaggagcaaggtgccctacatcgtgcggcagtgtgtggaggaggtggagaagaggggcatcgaggaggtgggcatctaccgcatctctggagtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgtacccagccttcatggagggcatcgccctgagtgaccctgctgccaaggagaactgcatgatgcacctgctgcggagcctgcctgaccccaacctgatcaccttcctgttcctgctggagcacctgaagagggtggccgagaaggagcccatcaacaagatgagcctgcacaacctggccaccgtgtttggccccaccctgctgcggcccagcgaggtggagagcaaggcccacctgaccagcgctgctgacatctggagccatgatgtgatggcccaggtgcaggtgctgctgtactacctgcagcacccccccatcagctttgctgagctgaagaggaacaccctgtacttcagcacagatgtgtag

SEQ ID NO: 142411 - DNA, 933 bp, Artificial Sequence
  Description of Artificial Sequence: Synthetic coding sequence
atgacagatgtgctgccccagcctgactgcagccccaaggccggccgggagcccctggccctggaggagagcggcagcaagaggcctcccaacacaggagcccggctgtggggccgggtgaggaacaagctgctgaggaacaagctggacccccagacagtggagaccaagaactggcacacagatgtgattgagatgaatggcatcaaggtggagttctccatgaagttcaccagccgggacatgagcctgaagaggacccccagcaagaagcagacaggagtgtttggagtgaagatctctgtggtgaccaagcgggagaggagcaaggtgccctacatcgtgcggcagtgtgtggaggaggtggagaagaggggcatcgaggaggtgggcatctaccgcatcagcggcgtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgtacccagccttcatggagggcatcgccctgagtgaccctgctgccaaggagaactgcatgatgcacctgctgcggagcctgcctgaccccaacctgatcaccttcctgttcctgctggagcacctgaagagggtggccgagaaggagcccatcaacaagatgagcctgcacaacctggccaccgtgtttggccccaccctgctgcggcccagcgaggtggagagcaaggcccacctgaccagcgctgctgacatctggagccatgatgtgatggcccaggtgcaggtgctgctgtactacctgcagcacccccccatcagctttgctgagctgaagaggaacaccctgtacttcagcacagatgtgtag

SEQ ID NO: 142412 - DNA, 2442 bp, Artificial Sequence
  Description of Artificial Sequence: Synthetic coding sequence
atgccctacattgatgagagccccaccatgagcccccagctgagcgcccggagccagggcggcggagatggagtgagccccaccccacctgagggcctggcccctggggtggaggccggcaagggcctggagatgaggaagctggtgctgagcggcttcctggccagcgaggagatctacatcaaccagctggaggccctgctgctgcccatgaagcccctgaaggccacagccaccaccagccagcctgtgctgaccatccagcagatcgagaccatcttctacaagatccaggacatctatgagatccacaaggagttctatgacaacctgtgccccaaggtgcagcagtgggacagccaggtgaccatgggccacctgttccagaagctggccagccagctgggcgtgtacaaggcctttgtggacaactacaaggtggccctggagacagctgagaagtgcagccagagcaacaaccagttccagaagatcagcgaggagctgaaggtgaagggccccaaggacagcaaggacagccacacctctgtgaccatggaggccctgctgtacaagcccatcgacagagtgaccaggagcaccctggtgctgcatgacctgctgaagcacacccctgtggaccacccagactaccccctgctgcaggatgccctgcgcatcagccagaacttcctgagcagcatcaatgaagatattgaccccaggagaacagctgtgaccacccccaagggggagacccggcagctggtgaaggatggcttcctggtggaggtgtctgagagcagcaggaagctgcggcacgtgttcctgttcacagatgtgctgctgtgtgccaagctgaagaagaccagcgctgggaagcaccagcagtatgactgcaagtggtacatccccctggccgacctggtgttccccagccctgaggagagcgaggccagcccccaggtgcaccccttcccagaccacgagctggaggacatgaagatgaagatcagcgccctgaagtctgagatccagaaggagaaggccaacaagggccagagccgggccatcgagcggctgaagaagaagatgtttgaaaatgagttcctgctgctgctgaacagccccaccatccccttccgcatccacaacagaaatggcaagagctacctgttcctgctgagcagtgactatgaaagaagtgagtggagggaggccatccagaagctgcagaagaaggacctgcaggcctttgtgctgagctctgtggagctgcaggtgctgaccggcagctgcttcaagctgaggacagtgcacaacatccctgtgaccagcaacaaggatgatgatgagagccctggcctgtatggcttcctgcacgtgattgtgcacagcgccaagggcttcaagcagagcgccaacctgtactgcaccctggaggtggacagctttggctactttgtgtccaaggccaagaccagggtcttccgggacacagctgagcccaagtgggatgaggagtttgaaattgagctggagggcagccagagcctgcgcatcctgtgctatgagaagtgctatgacaagaccaaggtgaacaaggacaacaatgagatcgtggacaagatcatgggcaagggccagatccagctggacccccagacagtggagaccaagaactggcacacagatgtgattgagatgaatggcatcaaggtggagttctccatgaagttcaccagccgggacatgagcctgaagaggacccccagcaagaagcagacaggagtgtttggagtgaagatctctgtggtgaccaagcgggagaggagcaaggtgccctacatcgtgcggcagtgtgtggaggaggtggagaagaggggcatcgaggaggtgggcatctaccgcatctctggagtggccacagacatccaggccctgaaggctgtgtttgatgccaacaacaaggacatcctgctgatgctgagtgacatggacatcaatgccatcgccggcaccctgaagctgtacttccgggagctgcctgagcccctgctgacagaccggctgtacccagccttcatggagggcatcgccctgagtgaccctgctgccaaggagaactgcatgatgcacctgctgcggagcctgcctgaccccaacctgatcaccttcctgttcctgctggagcacctgaagagggtggccgagaaggagcccatcaacaagatgagcctgcacaacctggccaccgtgtttggccccaccctgctgcggcccagcgaggtggagagcaaggcccacctgaccagcgctgctgacatctggagccatgatgtgatggcccaggtgcaggtgctgctgtactacctgcagcacccccccatcagctttgctgagctgaagaggaacaccctgtacttcagcacagatgtgtag

SEQ ID NO: 142413 - DNA, 1332 bp, Artificial Sequence
  Description of Artificial Sequence: Synthetic coding sequence
atgctgaccaacgggaaggagcaggtgatcaagagctgtgtgtccctgcctgagctgaatgcccaggtgttctgccacagcagcaacaacgtgaccaagacagagtgctgcttcacagacttctgcaacaacatcaccctgcacctgcccacagccagccccaatgcccccaagctgggccccatggagctggccatcatcatcaccgtgcctgtgtgcctgctgagcattgctgccatgctgactgtgtgggcctgccagggccggcagtgcagctacaggaagaagaagaggcccaacgtggaggagcccctgtctgagtgcaacctggtgaatgccggcaagaccctgaaggacctgatctatgatgtgacagccagcggcagcggcagcggcctgcccctgctggtgcagaggaccatcgcccggaccatcgtgctgcaggagatcgtgggcaagggccgctttggagaggtgtggcacggccgctggtgtggagaagatgtggccgtgaagatcttcagcagcagagatgagaggtcctggttccgggaggccgagatctaccagacagtgatgctgcggcatgagaacatcctgggcttcatcgctgctgacaacaaggacaatggcacctggacccagctgtggctggtgtctgagtaccacgagcagggcagcctgtatgactacctgaacagaaacatcgtgacagtggccggcatgatcaagctggccctgagcatcgccagcggcctggcccacctgcacatggagatcgtgggcacccagggcaagccagccatcgcccaccgggacatcaagagcaagaacatcctggtgaagaagtgtgagacctgtgccatcgctgacctgggcctggccgtgaagcatgacagcatcctgaacaccatcgacatcccccagaaccccaaggtgggcaccaagcgctacatggcccctgagatgctggatgacaccatgaatgtgaacatctttgagagcttcaagagagctgacatctacagcgtgggcctggtgtactgggagatcgcccggcgctgcagcgtgggcggcatcgtggaggagtaccagctgccctactatgacatggtgcccagcgaccccagcattgaggagatgaggaaggtggtgtgtgaccagaagttccggcccagcatccccaaccagtggcagagctgtgaggccctgcgggtgatgggccgcatcatgagggagtgctggtacgccaacggggccgcccggctgacagccctgcgcatcaagaagaccatcagccagctgtgtgtgaaggaggactgcaaggcctag

SEQ ID NO: 142414 - DNA, 1512 bp, Artificial Sequence
  Description of Artificial Sequence: Synthetic coding sequence
atgaccctgggcagccccaggaagggcctgctgatgctgctgatggccctggtgacccagggcgaccctgtgaagcccagccggggccccctggtgacctgcacctgtgagagcccccactgcaagggccccacctgccgcggggcctggtgcaccgtggtgctggtgcgggaggagggccgccacccccaggagcaccggggctgcggcaacctgcaccgggagctgtgccggggccggcccacagaatttgtgaaccactactgctgtgacagccacctgtgcaaccacaacgtgtccctggtgctggaggccacccagccccccagcgagcagcctggaacagatggccagctggccctgatcctgggccctgtgctggccctgctggccctggtggccctgggcgtgctgggcctgtggcacgtgagaagacggcaggagaagcagaggggcctgcacagcgagctgggggagagcagcctcatcctgaaggccagcgagcagggcgacagcatgctgggggacctgctggacagcgactgcaccaccggcagcggcagcggcctgcccttcctggtgcagaggacagtggcccggcaggtggccctggtggagtgtgtgggcaagggccgctatggagaggtgtggaggggcctgtggcacggggagagcgtggccgtgaagatcttcagcagcagagatgagcagagctggttccgggagacagagatctacaacacagtgctgctgcggcatgacaacatcctgggcttcatcgccagtgacatgaccagcaggaacagcagcacccagctgtggctgatcacccactaccacgagcacggcagcctgtatgacttcctgcagaggcagaccctggagccccacctggccctgcggctggccgtgtctgctgcctgtggcctggcccacctgcacgtggagatcttcggcacccagggcaagccagccatcgcccaccgggacttcaagagcagaaatgtgctggtgaagagcaacctgcagtgctgcatcgctgacctgggcctggccgtgatgcacagccagggcagtgactacctggacatcggcaacaacccccgggtgggcaccaagcgctacatggcccctgaggtgctggatgagcagatcagaacagactgctttgagagctacaagtggacagacatctgggccttcggcctggtgctgtgggagatcgcccggaggaccatcgtgaatggaattgtggaggactacagaccacccttctatgatgtggtgcccaatgaccccagctttgaggacatgaagaaggtggtgtgtgtggaccagcagacccccaccatccccaaccggctggccgctgaccctgtgctgagcggcctggcccagatgatgagggagtgctggtaccccaaccccagcgcccggctgacagccctgcgcatcaagaagaccctgcagaagatcagcaacagccctgagaagcccaaggtgatccagtag

SEQ ID NO: 142415 - DNA, 1512 bp, Artificial Sequence; identical to SEQ ID NO: 142414
  Description of Artificial Sequence: Synthetic coding sequence

SEQ ID NO: 142416 - DNA, 990 bp, Artificial Sequence
  Description of Artificial Sequence: Synthetic coding sequence
atggccctgaccccacccctgctgctgctgtctgctggcaccatgaccctgggcagccccaggaagggcctgctgatgctgctgatggccctggtgacccagggcaagggccgctatggagaggtgtggaggggcctgtggcacggggagagcgtggccgtgaagatcttcagcagcagagatgagcagagctggttccgggagacagagatctacaacacagtgctgctgcggcatgacaacatcctgggcttcatcgccagtgacatgaccagcaggaacagcagcacccagctgtggctgatcacccactaccacgagcacggcagcctgtatgacttcctgcagaggcagaccctggagccccacctggccctgcggctggccgtgtctgctgcctgtggcctggcccacctgcacgtggagatcttcggcacccagggcaagccagccatcgcccaccgggacttcaagagcagaaatgtgctggtgaagagcaacctgcagtgctgcatcgctgacctgggcctggccgtgatgcacagccagggcagtgactacctggacatcggcaacaacccccgggtgggcaccaagcgctacatggcccctgaggtgctggatgagcagatcagaacagactgctttgagagctacaagtggacagacatctgggccttcggcctggtgctgtgggagatcgcccggaggaccatcgtgaatggaattgtggaggactacagaccacccttctatgatgtggtgcccaatgaccccagctttgaggacatgaagaaggtggtgtgtgtggaccagcagacccccaccatccccaaccggctggccgctgaccctgtgctgagcggcctggcccagatgatgagggagtgctggtaccccaaccccagcgcccggctgacagccctgcgcatcaagaagaccctgcagaagatcagcaacagccctgagaagcccaaggtgatccagtag

SEQ ID NO: 142417 - DNA, 480 bp, Artificial Sequence
  Description of Artificial Sequence: Synthetic coding sequence
atggccctgaccccacccctgctgctgctgtctgctggcaccatgaccctgggcagccccaggaagggcctgctgatgctgctgatggccctggtgacccagggcgaccctgtgaagcccagccggggccccctggtgacctgcacctgtgagagcccccactgcaagggccccacctgccgcggggcctggtgcaccgtggtgctggtgcgggaggagggccgccacccccaggagcaccggggctgcggcaacctgcaccgggagctgtgccggggccggcccacagaatttgtgaaccactactgctgtgacagccacctgtgcaaccacaacgtgtccctggtgctggagggcaagggccgctatggagaggtgtggaggggcctgtggcacggggagagcgtggccgtgaagatcttcagcagcagagatgagcagagctggttccgggagacagagatctacaacacagtgtag

SEQ ID NO: 142418 - DNA, 1554 bp, Artificial Sequence
  Description of Artificial Sequence: Synthetic coding sequence
atggccctgaccccacccctgctgctgctgtctgctggcaccatgaccctgggcagccccaggaagggcctgctgatgctgctgatggccctggtgacccagggcgaccctgtgaagcccagccggggccccctggtgacctgcacctgtgagagcccccactgcaagggccccacctgccgcggggcctggtgcaccgtggtgctggtgcgggaggagggccgccacccccaggagcaccggggctgcggcaacctgcaccgggagctgtgccggggccggcccacagaatttgtgaaccactactgctgtgacagccacctgtgcaaccacaacgtgtccctggtgctggaggccacccagccccccagcgagcagcctggaacagatggccagctggccctgatcctgggccctgtgctggccctgctggccctggtggccctgggcgtgctgggcctgtggcacgtgagaagacggcaggagaagcagaggggcctgcacagcgagctgggggagagcagcctcatcctgaaggccagcgagcagggcgacagcatgctgggggacctgctggacagcgactgcaccaccggcagcggcagcggcctgcccttcctggtgcagaggacagtggcccggcaggtggccctggtggagtgtgtgggcaagggccgctatggagaggtgtggaggggcctgtggcacggggagagcgtggccgtgaagatcttcagcagcagagatgagcagagctggttccgggagacagagatctacaacacagtgctgctgcggcatgacaacatcctgggcttcatcgccagtgacatgaccagcaggaacagcagcacccagctgtggctgatcacccactaccacgagcacggcagcctgtatgacttcctgcagaggcagaccctggagccccacctggccctgcggctggccgtgtctgctgcctgtggcctggcccacctgcacgtggagatcttcggcacccagggcaagccagccatcgcccaccgggacttcaagagcagaaatgtgctggtgaagagcaacctgcagtgctgcatcgctgacctgggcctggccgtgatgcacagccagggcagtgactacctggacatcggcaacaacccccgggtgggcaccaagcgctacatggcccctgaggtgctggatgagcagatcagaacagactgctttgagagctacaagtggacagacatctgggccttcggcctggtgctgtgggagatcgcccggaggaccatcgtgaatggaattgtggaggactacagaccacccttctatgatgtggtgcccaatgaccccagctttgaggacatgaagaaggtggtgtgtgtggaccagcagacccccaccatccccaaccggctggccgctgaccctgtgctgagcggcctggcccagatgatgagggagtgctggtaccccaaccccagcgcccggctgacagccctgcgcatcaagaagaccctgcagaagatcagcaacagccctgagaagcccaaggtgatccagtag

SEQ ID NO: 142419 - DNA, 1530 bp, Artificial Sequence
  Description of Artificial Sequence: Synthetic coding sequence
atggtggatggagtgatgatcctgcctgtgctgatcatgattgccctgcccagccccagcatggaggatgagaagcccaaggtgaaccccaagctgtacatgtgtgtgtgtgagggcctgagctgtggaaatgaagaccactgtgagggccagcagtgcttcagcagcctgagcatcaatgatggcttccacgtgtaccagaagggctgcttccaggtgtatgagcagggcaagatgacctgcaagaccccacccagccctggccaggccgtggagtgctgccagggcgactggtgcaacagaaacatcacagcccagctgcccaccaagggcaagagcttccctggcacccagaacttccacctggaggtgggcctcatcatcctgtctgtggtgtttgctgtgtgcctgctggcctgcctgctgggcgtggccctgaggaagttcaagagaagaaaccaggagcggctgaaccccagagatgtggagtatggcaccatcgagggcctcatcaccaccaacgtgggggacagcaccctggccgacctgctggaccacagctgcaccagcggcagcggcagcggcctgcccttcctggtgcagaggacagtggcccggcagatcaccctgctggagtgtgtgggcaagggccgctatggagaggtgtggaggggctcctggcagggagaaaatgtggccgtgaagatcttcagcagcagagatgagaagtcctggttccgggagacagagctgtacaacacagtgatgctgcggcatgagaacatcctgggcttcatcgccagtgacatgaccagccgccacagcagcacccagctgtggctgatcacccactaccacgagatgggcagcctgtatgactacctgcagctgaccaccctggacacagtgtcctgcctgcgcatcgtgctgagcatcgccagcggcctggcccacctgcacatcgagatcttcggcacccagggcaagccagccatcgcccaccgggacctgaagagcaagaacatcctggtgaagaagaatggccagtgctgcatcgctgacctgggcctggccgtgatgcacagccagagcaccaaccagctggatgtgggcaacaacccccgggtgggcaccaagcgctacatggcccctgaggtgctggatgagaccatccaggtggactgctttgacagctacaagagggtggacatctgggccttcggcctggtgctgtgggaggtggcccggaggatggtgtccaatggaattgtggaggactacaagccacccttctatgatgtggtgcccaatgaccccagctttgaggacatgaggaaggtggtgtgtgtggaccagcagaggcccaacatccccaaccgctggttcagtgaccccaccctgaccagcctggccaagctgatgaaggagtgctggtaccagaaccccagcgcccggctgacagccctgcgcatcaagaagaccctgaccaagattgacaacagcctggacaagctgaagacagactgctag

SEQ ID NO: 142420 - DNA, 1530 bp, Artificial Sequence; identical to SEQ ID NO: 142419
  Description of Artificial Sequence: Synthetic coding sequence

SEQ ID NO: 142421 - DNA, 1530 bp, Artificial Sequence; identical to SEQ ID NO: 142419
  Description of Artificial Sequence: Synthetic coding sequence

SEQ ID NO: 142422 - DNA, 264 bp, Artificial Sequence
  Description of Artificial Sequence: Synthetic coding sequence
atggtggatggagtgatgatcctgcctgtgctgatcatgattgccctgcccagccccagcatggaggatgagaagcccaaggtgaaccccaagctgtacatgtgtgtgtgtgagggcctgagctgtggaaatgaagaccactgtgagggccagcagtgcttcagcagcctgagcatcaatgatggcttccacgtgtaccagaagggctgcttccaggtgtatgagcagggcaagatgacctgcaagaccccacccagcccctag

SEQ ID NO: 142423 - DNA, 66 bp, Artificial Sequence
  Description of Artificial Sequence: Synthetic coding sequence
atggtggatggagtgatgatcctgcctgtgctgatcatgattgccctgcccagccccagcatgtag

SEQ ID NO: 142424 - DNA, 216 bp, Artificial Sequence
  Description of Artificial Sequence: Synthetic coding sequence
atggtggatggagtgatgatcctgcctgtgctgatcatgattgccctgcccagccccagcatggaggatgagaagcccaaggtgaaccccaagctgtacatgtgtgtgtgtgagggcctgagctgtggaaatgaagaccactgtgagggccagcagtgcttcagcagcctgagcatcaatgatggcttccacgtgtaccagaagggctgcttctag

SEQ ID NO: 142425 - DNA, 1530 bp, Artificial Sequence; identical to SEQ ID NO: 142419
  Description of Artificial Sequence: Synthetic coding sequence

SEQ ID NO: 142426 - DNA, 264 bp, Artificial Sequence; identical to SEQ ID NO: 142422
  Description of Artificial Sequence: Synthetic coding sequence

SEQ ID NO: 142427 - DNA, 222 bp, Artificial Sequence
  Description of Artificial Sequence: Synthetic coding sequence
atggtggatggagtgatgatcctgcctgtgctgatcatgattgccctgcccagccccagcatggaggatgagaagcccaaggtgaaccccaagctgtacatgtgtgtgtgtgagggcctgagctgtggaaatgaagaccactgtgagggccagcagtgcttcagcagcctgagcatcaatgatggcttccacgtgtaccagaagggctgcttccaggtgtag

SEQ ID NO: 142428 - DNA, 1518 bp, Artificial Sequence
  Description of Artificial Sequence: Synthetic coding sequence
atggccgagagcgctggggccagcagcttcttccccctggtggtgctgctgctggccggcagcggcggcagcggcccccggggcgtgcaggccctgctgtgtgcctgcaccagctgcctgcaggccaactacacctgtgaaacagatggagcctgcatggtgtccatcttcaacctggatggcatggagcaccacgtgaggacctgcatccccaaggtggagctggtgcctgctgggaagcccttctactgcctgagcagcgaggacctgaggaacacccactgctgctacacagactactgcaacagaattgacctgcgggtgcccagcggccacctgaaggagcctgagcaccccagcatgtggggccctgtggagctggtgggcatcatcgccggccctgtgttcctgctcttcctgatcatcatcatcgtgttcctggtgatcaactaccaccagagggtgtaccacaaccggcagaggctggacatggaggaccccagctgtgagatgtgcctgagcaaggacaagaccctgcaggacctggtgtatgacctgagcaccagcggcagcggcagcggcctgcccctgtttgtgcagaggacagtggcccggaccatcgtgctgcaggagatcatcggcaagggccgctttggagaggtgtggaggggccgctggagaggaggagatgtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgaccatcgagggcatgatcaagctggccctgtctgctgccagcggcctggcccacctgcacatggagatcgtgggcacccagggcaagccaggcatcgcccaccgggacctgaagagcaagaacatcctggtgaagaagaatggcatgtgtgccatcgctgacctgggcctggccgtgagacatgatgctgtgacagacaccattgatattgcccccaaccagagggtgggcaccaagcgctacatggcccctgaggtgctggatgagaccatcaacatgaagcactttgacagcttcaagtgtgccgacatctatgccctgggcctggtgtactgggagatcgcccggcgctgcaacagcggaggagtgcatgaggagtaccagctgccctactatgacctggtgcccagcgaccccagcattgaggagatgaggaaggtggtgtgtgaccagaagctgcggcccaacatccccaactggtggcagagctatgaggccctgcgggtgatgggcaagatgatgagggagtgctggtacgccaacggggccgcccggctgacagccctgcgcatcaagaagaccctgagccagctgtctgtgcaggaggatgtgaagatctag

SEQ ID NO: 142429 - DNA, 1464 bp, Artificial Sequence
  Description of Artificial Sequence: Synthetic coding sequence
atggccgagagcgctggggccagcagcttcttccccctggtggtgctgctgctggccggcagcggcggcagcggcccccggggcgtgcaggccctgctgtgtgcctgcaccagctgcctgcaggccaactacacctgtgaaacagatggagcctgcatggtgtccatcttcaacctggatggcatggagcaccacgtgaggacctgcatccccaaggtggagctggtgcctgctgggaagcccttctactgcctgagcagcgaggacctgaggaacacccactgctgctacacagactactgcaacagaattgacctgcgggtgcccagcggccacctgaaggagcctgagcaccccagcatgtggggccctgtggagctggtgggcatcatcgccggccctgtgttcctgctcttcctgatcatcatcatcgtgttcctggtgatcaactaccaccagagggtgtaccacaaccggcagaggctggacatggaggaccccagctgtgagatgtgcctgagcaaggacaagaccctgcaggacctggtgtatgacctgagcaccagcggcagcggcagcggcctgcccctgtttgtgcagaggacagtggcccggaccatcgtgctgcaggagatcatcggcaagggccgctttggagaggtgtggaggggccgctggagaggaggagatgtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgaccatcgagggcatgatcaagctggccctgtctgctgccagcggcctggcccacctgcacatggagatcgtgggcacccagggcaagccaggcatcgcccaccgggacctgaagagcaagaacatcctggtgaagaagaatggcatgtgtgccatcgctgacctgggcctggccgtgagacatgatgctgtgacagacaccattgatattgcccccaaccagagggtgggcaccaagcgctacatggcccctgaggtgctggatgagaccatcaacatgaagcactttgacagcttcaagtgtgccgacatctatgccctgggcctggtgtactgggagatcgcccggcgctgcaacagcggcggcaccttcctgttctgcctgtgcagctacctgcccttccaggatgctggcagccccaaggctgtgctgctgccccccttcttcctgcagcctgtgggctgcctgctgcctgagcctgagagcagcttcaaggtggccatcaagggcgtggaggtggccgtgctgcgggtgcggctcttcttccgggaccagtttgtggagtag

SEQ ID NO: 142430 - DNA, 1431 bp, Artificial Sequence
  Description of Artificial Sequence: Synthetic coding sequence
atggccgagagcgctggggccagcagcttcttccccctggtggtgctgctgctggccggcagcggcggcagcggcccccggggcgtgcaggccctgctgtgtgcctgcaccagctgcctgcaggccaactacacctgtgaaacagatggagcctgcatggtgtccatcttcaacctggatggcatggagcaccacgtgaggacctgcatccccaaggtggagctggtgcctgctgggaagcccttctactgcctgagcagcgaggacctgaggaacacccactgctgctacacagactactgcaacagaattgacctgcgggtgcccagcggccacctgaaggagcctgagcaccccagcatgtggggccctgtggagctggtgggcatcatcgccggccctgtgttcctgctcttcctgatcatcatcatcgtgttcctggtgatcaactaccaccagagggtgtaccacaaccggcagaggctggacatggaggaccccagctgtgagatgtgcctgagcaaggacaagaccctgcaggacctggtgtatgacctgagcaccagcggcagcggcagcggcctgcccctgtttgtgcagaggacagtggcccggaccatcgtgctgcaggagatcatcggcaagggccgctttggagaggtgtggaggggccgctggagaggaggagatgtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgaccatcgagggcatgatcaagctggccctgtctgctgccagcggcctggcccacctgcacatggagatcgtgggcacccagggcaagccaggcatcgcccaccgggacctgaagagcaagaacatcctggtgaagaagaatggcatgtgtgccatcgctgacctgggcctggccgtgagacatgatgctgtgacagacaccattgatattgcccccaaccagagggtgggcaccaagcgctacatggcccctgaggtgctggatgagaccatcaacatgaagcactttgacagcttcaagtgtgccgacatctatgccctgggcctggtgtactgggagatcgcccggcgctgcaacagcggaggagtgcatgaggagtaccagctgccctactatgacctggtgcccagcgaccccagcattgaggagatgaggaaggtggtgtgtgaccagaagctgcggcccaacatccccaactggtggcagagctatgaggtgcgctcctggcccccagctgccttccccagcgcctag

SEQ ID NO: 142431 - DNA, 1641 bp, Artificial Sequence
  Description of Artificial Sequence: Synthetic coding sequence
atggccgagagcgctggggccagcagcttcttccccctggtggtgctgctgctggccggcagcggcggcagcggcccccggggcgtgcaggccctgctgtgtgcctgcaccagctgcctgcaggccaactacacctgtgaaacagatggagcctgcatggtgtccatcttcaacctggatggcatggagcaccacgtgaggacctgcatccccaaggtggagctggtgcctgctgggaagcccttctactgcctgagcagcgaggacctgaggaacacccactgctgctacacagactactgcaacagaattgacctgcgggtgcccagcggccacctgaaggagcctgagcaccccagcatgtggggccctgtggagctggtgggcatcatcgccggccctgtgttcctgctcttcctgatcatcatcatcgtgttcctggtgatcaactaccaccagagggtgtaccacaaccggcagaggctggacatggaggaccccagctgtgagatgtgcctgagcaaggacaagaccctgcaggacctggtgtatgacctgagcaccagcggcagcggcagcggcctgcccctgtttgtgcagaggacagtggcccggaccatcgtgctgcaggagatcatcggcaagggccgctttggagaggtgtggaggggccgctggagaggaggagatgtggccgtgaagatcttcagcagccgggaggagaggtcctggttccgggaggccgagatctaccagacagtgatgctgcggcatgagaacatcctgggcttcatcgctgctgacaacaaggctgactgcagcttcctgaccctgccctgggaggtggtgatggtgtctgctgcccccaagctgcggagcctgcggctgcagtacaagggcggccggggccgggcccgcttcctgttccccctgaacaacggcacctggacccagctgtggctggtgtctgactaccacgagcacggcagcctgtttgactacctgaaccgctacacagtgaccatcgagggcatgatcaagctggccctgtctgctgccagcggcctggcccacctgcacatggagatcgtgggcacccagggcaagccaggcatcgcccaccgggacctgaagagcaagaacatcctggtgaagaagaatggcatgtgtgccatcgctgacctgggcctggccgtgagacatgatgctgtgacagacaccatcgacatcgcccccaaccagagggtgggcaccaagcgctacatggcccctgaggtgctggatgagaccatcaacatgaagcactttgacagcttcaagtgtgccgacatctatgccctgggcctggtgtactgggagatcgcccggcgctgcaacagcggcggcgtgcatgaggagtaccagctgccctactatgacctggtgcccagcgaccccagcattgaggagatgaggaaggtggtgtgtgaccagaagctgcggcccaacatccccaactggtggcagagctatgaggccctgcgggtgatgggcaagatgatgagggagtgctggtacgccaatggagctgcccggctgacagccctgcgcatcaagaagaccctgagccagctgtctgtgcaggaggatgtgaagatctag

SEQ ID NO: 142432 - DNA, 1362 bp, Artificial Sequence
  Description of Artificial Sequence: Synthetic coding sequence
atggtgtccatcttcaacctggatggcatggagcaccacgtgaggacctgcatccccaaggtggagctggtgcctgctgggaagcccttctactgcctgagcagcgaggacctgaggaacacccactgctgctacacagactactgcaacagaattgacctgcgggtgcccagcggccacctgaaggagcctgagcaccccagcatgtggggccctgtggagctggtgggcatcatcgccggccctgtgttcctgctcttcctgatcatcatcatcgtgttcctggtgatcaactaccaccagagggtgtaccacaaccggcagaggctggacatggaggaccccagctgtgagatgtgcctgagcaaggacaagaccctgcaggacctggtgtatgacctgagcaccagcggcagcggcagcggcctgcccctgtttgtgcagaggacagtggcccggaccatcgtgctgcaggagatcatcggcaagggccgctttggagaggtgtggaggggccgctggagaggaggagatgtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgaccatcgagggcatgatcaagctggccctgtctgctgccagcggcctggcccacctgcacatggagatcgtgggcacccagggcaagccaggcatcgcccaccgggacctgaagagcaagaacatcctggtgaagaagaatggcatgtgtgccatcgctgacctgggcctggccgtgagacatgatgctgtgacagacaccattgatattgcccccaaccagagggtgggcaccaagcgctacatggcccctgaggtgctggatgagaccatcaacatgaagcactttgacagcttcaagtgtgccgacatctatgccctgggcctggtgtactgggagatcgcccggcgctgcaacagcggaggagtgcatgaggagtaccagctgccctactatgacctggtgcccagcgaccccagcattgaggagatgaggaaggtggtgtgtgaccagaagctgcggcccaacatccccaactggtggcagagctatgaggccctgcgggtgatgggcaagatgatgagggagtgctggtacgccaacggggccgcccggctgacagccctgcgcatcaagaagaccctgagccagctgtctgtgcaggaggatgtgaagatctag

SEQ ID NO: 142433 - DNA, 1482 bp, Artificial Sequence
  Description of Artificial Sequence: Synthetic coding sequence
atgacccgggccctgtgcagcgccctgcggcaggccctgctgctgctggccgctgctgctgagctgagccctggcctgaagtgtgtgtgcctgctgtgtgacagcagcaacttcacctgccagacagagggcgcctgctgggcctctgtgatgctgaccaacgggaaggagcaggtgatcaagagctgtgtgtccctgcctgagctgaatgcccaggtgttctgccacagcagcaacaacgtgaccaagacagagtgctgcttcacagacttctgcaacaacatcaccctgcacctgcccacagccagccccaatgcccccaagctgggccccatggagctggccatcatcatcaccgtgcctgtgtgcctgctgagcattgctgccatgctgactgtgtgggcctgccagggccggcagtgcagctacaggaagaagaagaggcccaacgtggaggagcccctgtctgagtgcaacctggtgaatgccggcaagaccctgaaggacctgatctatgatgtgacagccagcggcagcggcagcggcctgcccctgctggtgcagaggaccatcgcccggaccatcgtgctgcaggagatcgtgggcaagggccgctttggagaggtgtggcacggccgctggtgtggagaagatgtggccgtgaagatcttcagcagcagagatgagaggtcctggttccgggaggccgagatctaccagacagtgatgctgcggcatgagaacatcctgggcttcatcgctgctgacaacaaggacaatggcacctggacccagctgtggctggtgtctgagtaccacgagcagggcagcctgtatgactacctgaacagaaacatcgtgacagtggccggcatgatcaagctggccctgagcatcgccagcggcctggcccacctgcacatggagatcgtgggcacccagggcaagccagccatcgcccaccgggacatcaagagcaagaacatcctggtgaagaagtgtgagacctgtgccatcgctgacctgggcctggccgtgaagcatgacagcatcctgaacaccatcgacatcccccagaaccccaaggtgggcaccaagcgctacatggcccctgagatgctggatgacaccatgaatgtgaacatctttgagagcttcaagagagctgacatctacagcgtgggcctggtgtactgggagatcgcccggcgctgcagcgtgggcggcatcgtggaggagtaccagctgccctactatgacatggtgcccagcgaccccagcattgaggagatgaggaaggtggtgtgtgaccagaagttccggcccagcatccccaaccagtggcagagctgtgaggccctgcgggtgatgggccgcatcatgagggagtgctggtacgccaacggggccgcccggctgacagccctgcgcatcaagaagaccatcagccagctgtgtgtgaaggaggactgcaaggcctag

SEQ ID NO: 142434 - DNA, 1242 bp, Artificial Sequence
  Description of Artificial Sequence: Synthetic coding sequence
atgacccgggccctgtgcagcgccctgcggcaggccctgctgctgctggccgctgctgctgagctgagccctggcctgaagtgtgtgtgcctgctgtgtgacagcagcaacttcacctgccagacagagggcgcctgctgggcctctgtgatgctgaccaacgggaaggagcaggtgatcaagagctgtgtgtccctgcctgagctgaatgcccaggtgttctgccacagcagcaacaacgtgaccaagacagagtgctgcttcacagacttctgcaacaacatcaccctgcacctgcccaccggcctgcccctgctggtgcagaggaccatcgcccggaccatcgtgctgcaggagatcgtgggcaagggccgctttggagaggtgtggcacggccgctggtgtggagaagatgtggccgtgaagatcttcagcagcagagatgagaggtcctggttccgggaggccgagatctaccagacagtgatgctgcggcatgagaacatcctgggcttcatcgctgctgacaacaaggacaatggcacctggacccagctgtggctggtgtctgagtaccacgagcagggcagcctgtatgactacctgaacagaaacatcgtgacagtggccggcatgatcaagctggccctgagcatcgccagcggcctggcccacctgcacatggagatcgtgggcacccagggcaagccagccatcgcccaccgggacatcaagagcaagaacatcctggtgaagaagtgtgagacctgtgccatcgctgacctgggcctggccgtgaagcatgacagcatcctgaacaccatcgacatcccccagaaccccaaggtgggcaccaagcgctacatggcccctgagatgctggatgacaccatgaatgtgaacatctttgagagcttcaagagagctgacatctacagcgtgggcctggtgtactgggagatcgcccggcgctgcagcgtgggcggcatcgtggaggagtaccagctgccctactatgacatggtgcccagcgaccccagcattgaggagatgaggaaggtggtgtgtgaccagaagttccggcccagcatccccaaccagtggcagagctgtgaggccctgcgggtgatgggccgcatcatgagggagtgctggtacgccaacggggccgcccggctgacagccctgcgcatcaagaagaccatcagccagctgtgtgtgaaggaggactgcaaggcctag

SEQ ID NO: 142435 - DNA, 1011 bp, Artificial Sequence
  Description of Artificial Sequence: Synthetic coding sequence
atgacccgggccctgtgcagcgccctgcggcaggccctgctgctgctggccgctgctgctgagctgagccctggcctgaagtgtgtgtgcctgctgtgtgacagcagcaacttcacctgccagacagagggcgcctgctgggcctctgtgatgctgaccaacgggaaggagcaggtgatcaagagctgtgtgtccctgcctgagctgaatgcccaggtgttctgccacagcagcaacaacgtgaccaagacagagtgctgcttcacagacttctgcaacaacatcaccctgcacctgcccacagacaatggcacctggacccagctgtggctggtgtctgagtaccacgagcagggcagcctgtatgactacctgaacagaaatattgtgacagtggccggcatgatcaagctggccctgagcatcgccagcggcctggcccacctgcacatggagatcgtgggcacccagggcaagccagccatcgcccaccgggacatcaagagcaagaacatcctggtgaagaagtgtgagacctgtgccatcgctgacctgggcctggccgtgaagcatgacagcatcctgaacaccatcgacatcccccagaaccccaaggtgggcaccaagcgctacatggcccctgagatgctggatgacaccatgaatgtgaacatctttgagagcttcaagagagctgacatctacagcgtgggcctggtgtactgggagatcgcccggcgctgcagcgtgggcggcatcgtggaggagtaccagctgccctactatgacatggtgcccagcgaccccagcattgaggagatgaggaaggtggtgtgtgaccagaagttccggcccagcatccccaaccagtggcagagctgtgaggccctgcgggtgatgggccgcatcatgagggagtgctggtacgccaatggagctgcccggctgacagccctgcgcatcaagaagaccatcagccagctgtgtgtgaaggaggactgcaaggcctag

SEQ ID NO: 142436 - DNA, 1542 bp, Artificial Sequence
  Description of Artificial Sequence: Synthetic coding sequence
atgggcgccgccgccaagctggcctttgctgtgttcctgatcagctgcagcagcggggccatcctgggccgctctgagacccaggagtgcctcttcttcaatgccaactgggagaaggacaggaccaaccagacaggagtggagccctgctatggagacaaggacaagagaagacactgctttgccacctggaagaacatcagcggcagcattgaaattgtgaagcagggctgctggctggatgacatcaactgctatgacagaacagactgtgtggagaagaaggacagccctgaggtgtacttctgctgctgtgagggcaacatgtgcaatgagaagttctcctacttccctgagatggaggtgacccagcccaccagcaaccctgtgacccccaagccaccctactacaacatcctgctgtacagcctggtgcccctgatgctgattgctggcatcgtcatctgtgccttctgggtgtaccgccaccacaagatggcctacccacctgtgctggtgcccacccaggaccccggccccccaccacccagccccctgctgggcctgaagcccctgcagctgctggaggtgaaggcccggggccgcttcggctgtgtgtggaaggcccagctgctgaatgaatatgtggccgtgaagatcttccccatccaggacaagcagagctggcagaatgaatatgaggtgtacagcctgcccggcatgaagcatgagaacatcctgcagttcatcggggctgagaagaggggcacctctgtggatgtggacctgtggctgatcacagccttccacgagaagggcagcctgagtgacttcctgaaggccaacgtggtgtcctggaatgagctgtgccacatcgccgagaccatggcccggggcctggcctacctgcacgaggacatccctggcctgaaggatggccacaagccagccatcagccaccgggacatcaagagcaagaatgtgctgctgaagaacaacctgacagcctgcatcgctgactttggcctggccctgaagtttgaagctgggaagtctgctggggacacccacggccaggtgggcacccggcgctacatggcccctgaggtgctggagggcgccatcaacttccagagagatgccttcctgagaattgacatgtatgccatgggcctggtgctgtgggagctggccagccgctgcacagctgctgatggccctgtggatgagtacatgctgccctttgaggaggagatcggccagcaccccagcctggaggacatgcaggaggtggtggtgcacaagaagaagaggcctgtgctgcgggactactggcagaagcatgctggcatggccatgctgtgtgagaccatcgaggagtgctgggaccatgatgctgaggcccggctgtctgctggctgtgtgggggagcgcatcacccagatgcagaggctgaccaacatcatcaccacagaggacatcgtgacagtggtgaccatggtgaccaacgtggacttcccccccaaggagagcagcctgtag

SEQ ID NO: 142437 - DNA, 1542 bp, Artificial Sequence; identical to SEQ ID NO: 142436
  Description of Artificial Sequence: Synthetic coding sequence

SEQ ID NO: 142438 - DNA, 1218 bp, Artificial Sequence
  Description of Artificial Sequence: Synthetic coding sequence
atgtgcaatgagaagttctcctacttccctgagatggaggtgacccagcccaccagcaaccctgtgacccccaagccaccctactacaacatcctgctgtacagcctggtgcccctgatgctgattgctggcatcgtcatctgtgccttctgggtgtaccgccaccacaagatggcctacccacctgtgctggtgcccacccaggaccccggccccccaccacccagccccctgctgggcctgaagcccctgcagctgctggaggtgaaggcccggggccgcttcggctgtgtgtggaaggcccagctgctgaatgaatatgtggccgtgaagatcttccccatccaggacaagcagagctggcagaatgaatatgaggtgtacagcctgcccggcatgaagcatgagaacatcctgcagttcatcggggctgagaagaggggcacctctgtggatgtggacctgtggctgatcacagccttccacgagaagggcagcctgagtgacttcctgaaggccaacgtggtgtcctggaatgagctgtgccacatcgccgagaccatggcccggggcctggcctacctgcacgaggacatccctggcctgaaggatggccacaagccagccatcagccaccgggacatcaagagcaagaatgtgctgctgaagaacaacctgacagcctgcatcgctgactttggcctggccctgaagtttgaagctgggaagtctgctggggacacccacggccaggtgggcacccggcgctacatggcccctgaggtgctggagggcgccatcaacttccagagagatgccttcctgagaattgacatgtatgccatgggcctggtgctgtgggagctggccagccgctgcacagctgctgatggccctgtggatgagtacatgctgccctttgaggaggagatcggccagcaccccagcctggaggacatgcaggaggtggtggtgcacaagaagaagaggcctgtgctgcgggactactggcagaagcatgctggcatggccatgctgtgtgagaccatcgaggagtgctgggaccatgatgctgaggcccggctgtctgctggctgtgtgggggagcgcatcacccagatgcagaggctgaccaacatcatcaccacagaggacatcgtgacagtggtgaccatggtgaccaacgtggacttcccccccaaggagagcagcctgtag

SEQ ID NO: 142439 - DNA, 1539 bp, Artificial Sequence
  Description of Artificial Sequence: Synthetic coding sequence
atgacagccccctgggtggccctggccctgctgtggggcagcctgtgtgccggcagcggccgcggggaggccgagacccgggagtgcatctactacaatgccaactgggagctggagaggaccaaccagagcggcctggagcgctgtgagggggagcaggacaagaggctgcactgctacgcctcctggaggaacagcagcggcaccatcgagctggtgaagaagggctgctggctggatgacttcaactgctatgaccggcaggagtgtgtggccacagaggagaacccccaggtgtacttctgctgctgtgagggcaacttctgcaatgaacgcttcacccacctgcctgaggccggcggccctgaggtgacctatgagcccccacccacagcccccaccctgctgactgtgctggcctacagcctgctgcccatcggcggcctgagcctcatcgtgctgctggccttctggatgtaccgccacaggaagccaccctacggccacgtggacatccacgaggaccccggccccccaccacccagccccctggtgggcctgaagcccctgcagctgctggagatcaaggcccggggccgcttcggctgtgtgtggaaggcccagctgatgaatgactttgtggccgtgaagatcttccccctgcaggacaagcagagctggcagagcgagcgggagatcttcagcaccccaggcatgaagcatgagaacctgctgcagttcatcgctgctgagaagaggggcagcaacctggaggtggagctgtggctgatcacagccttccatgacaagggcagcctgacagactacctgaagggcaacatcatcacctggaatgagctgtgccacgtggccgagaccatgagccggggcctgagctacctgcatgaagatgtgccctggtgccgcggggagggccacaagcccagcatcgcccaccgggacttcaagagcaagaatgtgctgctgaagagtgacctgacagctgtgctggccgactttggcctggccgtgcgctttgagcccgggaagcccccaggggacacccacggccaggtgggcacccggcgctacatggcccctgaggtgctggagggcgccatcaacttccagagagatgccttcctgagaattgacatgtatgccatgggcctggtgctgtgggagctggtgagccgctgcaaggctgctgatggccctgtggatgagtacatgctgccctttgaggaggagatcggccagcaccccagcctggaggagctgcaggaggtggtggtgcacaagaagatgaggcccaccatcaaggaccactggctgaagcaccctggcctggcccagctgtgtgtgaccatcgaggagtgctgggaccatgatgctgaggcccggctgtctgctggctgtgtggaggagcgggtgtccctcatccgccgctctgtgaatggcaccaccagtgactgcctggtgtccctggtgacctctgtgaccaacgtggacctgccccccaaggagagcagcatctag

SEQ ID NO: 142440 - DNA, 1191 bp, Artificial Sequence
  Description of Artificial Sequence: Synthetic coding sequence
atggagctggaccacaggaccagcggcggcctgcacgcctacccaggcccccggggcggccaggtggccaagcccaacgtcatcctgcagattggaaaatgtagagctgagatgctggagcacgtgcggaggacccaccgccacctgctggccgaggtgtccaagcaggtggagcgggagctgaagggcctgcacaggtctgtgggcaagctggagagcaacctggatggctacgtgcccaccagtgacagccagcgctggaagaagagcatcaaggcctgcctgtgccgctgccaggagaccatcgccaacctggagcgctgggtgaagcgggagatgcacgtgtggagggaggtgttctaccgcctggagcgctgggccgaccggctggagagcactggaggcaagtaccctgtgggcagcgagagcgcccggcacacagtgtctgtgggcgtgggcggccctgagagctactgccacgaggctgatggctatgactacacagtgagcccctatgccatcaccccacctcctgctgctggggagctgcccggccaggagcctgctgaggcccagcagtaccagccctgggtgcctggagaagatggccagcccagccctggggtggacacccagatctttgaggacccccgggagttcctgagccacctggaggagtacctgcggcaggtgggcggcagcgaggagtactggctgagccagatccagaaccacatgaatggacctgccaagaagtggtgggagttcaagcagggctctgtgaagaactgggtggagttcaagaaggagttcctgcagtacagcgagggcaccctgagccgggaggccatccagcgggagctggacctgccccagaagcagggcgagcccctggaccagttcctgtggaggaagagggacctgtaccagaccctgtatgtggatgctgatgaggaggagatcatccagtatgtggtgggcaccctgcagcccaagctgaagcgcttcctgcggcaccccctgcccaagaccctggagcagctgatccagaggggcatggaggtgcaggatgacctggagcaggccgctgagcccgccggcccccacctgcctgtggaggatgaggccgagaccctgaccccagcccccaacagcgagagcgtggccagtgacaggacccagcctgagtag

SEQ ID NO: 142441 - DNA, 1587 bp, Artificial Sequence
  Description of Artificial Sequence: Synthetic coding sequence
atggctgctgtgctgaatgctgagcggctggaggtgtctgtggatggcctgaccctgagcccagaccctgaggagaggcctggagctgagggcgcccccctgctgcccccacccctgcccccacccagccccccaggcagcggccggggccctggggccagcggggagcagcctgagcccggggaggccgctgctggaggagctgctgaggaggcccggcggctggagcagcgctggggcttcggcctggaggagctgtatggcctggccctgcgcttcttcaaggagaaggatggcaaggccttccaccccacctatgaggagaagctgaagctggtggccctgcacaagcaggtgctgatgggcccctacaacccagacacctgcccagaggtgggcttctttgatgtgctgggcaatgacagaagaagagagtgggccgccctgggcaacatgagcaaagaagatgccatggtggagtttgtgaagctgctgaaccgctgctgccacctgttcagcacctacgtggccagccacaagattgagaaggaggagcaggagaagaagaggaaggaggaggaggagaggagaagaagagaggaggaggagcgggagcggctgcagaaggaggaggagaagagaagaagagaggaggaggagcggctgcggcgggaggaggaggagcggcggcgcatcgaggaggagcggctgcggctggagcagcagaagcagcagatcatggccgccctgaacagccagacagctgtgcagttccagcagtatgctgcccagcagtacccaggcaactatgagcagcagcagatcctgatccggcagctgcaggagcagcactaccagcagtacatgcagcagctgtaccaggtgcagctggcccagcagcaggccgccctgcagaagcagcaggaggtggtggtggccggcagcagcctgcccaccagcagcaaggtgaatgccaccgtgcccagcaacatgatgtctgtgaatggccaggccaagacccacacagacagcagcgagaaggagctggagcctgaggccgctgaggaggccctggagaatggccccaaggagagcctgcctgtgattgctgcccccagcatgtggacccggccccagatcaaggacttcaaggagaagatccagcaggatgctgacagcgtcatcaccgtgggccgcggggaggtggtgacagtgcgggtgcccacccatgaggagggcagctacctgttctgggagtttgccacagacaactatgacattggatttggagtgtactttgagtggacagacagccccaacacagctgtgtctgtgcacgtgtctgagagcagtgatgatgatgaggaggaggaggagaacatcggctgtgaggagaaggccaagaagaatgccaacaagcccctgctggatgaaattgtgcctgtgtaccgccgggactgccacgaggaggtgtatgccggcagccaccagtacccaggccggggcgtgtacctgctgaagtttgacaacagctacagcctgtggaggagcaagtctgtgtactacagagtgtactacaccaggtag

SEQ ID NO: 142442 - DNA, 2343 bp, Artificial Sequence
  Description of Artificial Sequence: Synthetic coding sequence
atgaagccaggggccaccggggagagtgacctggccgaggtgctgccccagcacaagtttgacagcaagagcctggaggcctacctgaaccagcacctgagcggctttggagctgagcgggaggccaccctgaccatcgcccagtacagagctgggaagagcaaccccaccttctacctgcagaagggcttccagacctacgtgctgaggaagaagcccccaggcagcctgctgcccaaggcccaccagattgaccgggagttcaaggtgcagaaggccctcttcagcatcggcttccctgtgcccaagcccatcctgtactgcagcgacaccagcgtcatcggcacagagttctacgtgatggagcacgtgcagggccgcatcttccgggacctgaccatccctggcctgagccctgctgagaggtctgccatctacgtggccaccgtggagaccctggcccagctgcggagcctgaacatccagagcctgcagctggagggctatggaattggagctggctactgcaagaggcaggtgtccacctggaccaagcagtaccaggccgccgcccaccaggacatcccagccatgcagcagctgtctgagtggctgatgaagaacctgcctgacaatgacaatgaggagaacctgatccacggggacttccggctggacaacatcgtgttccaccccaaggagtgccgggtgattgctgtgctggactgggagctgagcaccatcggccaccccctgagtgacctggcccacttcagcctcttctacttctggcccaggacagtgcccatgatcaaccagggcagctacagcgagaacagcggcatccccagcatggaggagctgatcagcatctactgccgctgccggggcatcaacagcatcctgcccaactggaacttcttcctggccctgagctacttcaagatggccggcatcgcccagggcgtgtacagccgctacctgctgggcaacaacagcagtgaagattccttcctgtttgccaacatcgtgcagcccctggccgagaccggcctgcagctgagcaagaggaccttcagcacagtgctgccccagattgacaccaccggccagctgtttgtgcagaccaggaagggccaggaggtgctgatcaaggtgaagcacttcatgaagcagcacatcctgcctgctgagaaggaggtgacagagttctacgtgcagaatgaaaattctgtggacaagtggggcaagcccctggtgattgacaagctgaaggagatggccaaggtggagggcctgtggaacctcttcctgcctgctgtgtctggcctgagccacgtggactatgccctgattgctgaggagaccgggaagtgcttctttgccccagatgtgttcaactgccaggccccagacaccggcaacatggaggtgctgcacctgtatggcagcgaggagcagaagaagcagtggctggagcccctgctgcagggcaacatcaccagctgcttctgcatgacagagccagatgtggccagcagtgatgccaccaacatcgagtgcagcatccagagagatgaagattcctatgtgatcaatggcaagaagtggtggagcagcggggccggcaaccccaagtgcaagatcgccatcgtgctgggccgcacccagaacaccagcctgagccgccacaagcagcacagcatgatcctggtgcccatgaacaccccaggagtgaagatcatccggcccctgtctgtgtttggctacacagacaacttccatggaggccactttgagatccacttcaaccaggtgcgggtgcctgccaccaacctgatcctgggggagggccggggctttgagatcagccagggccgcctgggccctggccgcatccaccactgcatgaggacagtgggcctggccgagcgggccctgcagatcatgtgtgagcgggccacccagagaattgccttcaagaagaagctgtatgcccacgaggtggtggcccactggattgctgagagcagaattgccatcgagaagatccggctgctgaccctgaaggccgcccacagcatggacaccctgggcagcgctggggccaagaaggagatcgccatgatcaaggtggccgcccccagggctgtgtccaagatcgtggactgggccatccaggtgtgtggcggggccggcgtgtcccaggactaccccctggccaacatgtatgccatcaccagggtgctgcggctggctgatggcccagatgaggtgcacctgagcgccatcgccaccatggagctgcgggaccaggccaagaggctgacagccaagatctag

SEQ ID NO: 142443 - DNA, 2031 bp, Artificial Sequence
  Description of Artificial Sequence: Synthetic coding sequence
atgaagccaggggccaccggggagagtgacctggccgaggtgctgccccagcacaagtttgacagcaagagcctggaggcctacctgaaccagcacctgagcggctttggagctgagcgggaggccaccctgaccatcgcccagtacagagctgggaagagcaaccccaccttctacctgcagaagggcttccagacctacgtgctgaggaagaagcccccaggcagcctgctgcccaaggcccaccagattgaccgggagttcaaggtgcagaaggccctcttcagcatcggcttccctgtgcccaagcccatcctgtactgcagcgacaccagcgtcatcggcacagagttctacgtgatggagcacgtgcagggccgcatcttccgggacctgaccatccctggcctgagccctgctgagaggtctgccatctacgtggccaccgtggagaccctggcccagctgcggagcctgaacatccagagcctgcagctggagggctatggaattggagctggctactgcaagaggcaggtgtccacctggaccaagcagtaccaggccgccgcccaccaggacatcccagccatgcagcagctgtctgagtggctgatgaagaacctgcctgacaatgacaatgaggagaacctgatccacggggacttccggctggacaacatcgtgttccaccccaaggagtgccgggtgattgctgtgctggactgggagctgagcaccatcggccaccccctgagtgacctggcccacttcagcctcttctacttctggcccaggacagtgcccatgatcaaccagggcagctacagcgagaacagcggcatccccagcatggaggagctgatcagcatctactgccgctgccggggcatcaacagcatcctgcccaactggaacttcttcctggccctgagctacttcaagatggccggcatcgcccagggcgtgtacagccgctacctgctgggcaacaacagcagtgaagattccttcctgtttgccaacatcgtgcagcccctggccgagaccggcctgcagctgagcaagaggaccttcagcacagtgctgccccagattgacaccaccggccagctgtttgtgcagaccaggaagggccaggaggtgctgatcaaggtgaagcacttcatgaagcagcacatcctgcctgctgagaaggaggtgacagagttctacgtgcagaatgaaaattctgtggacaagtggggcaagcccctggtgattgacaagctgaaggagatggccaaggtggagggcctgtggaacctcttcctgcctgctgtgtctggcctgagccacgtggactatgccctgattgctgaggagaccgggaagtgcttctttgccccagatgtgttcaactgccaggccccagacaccggcaacatggaggtgctgcacctgtatggcagcgaggagcagaagaagcagtggctggagcccctgctgcagggcaacatcaccagctgcttctgcatgacagagccagatgtggccagcagtgatgccaccaacatcgagtgcagcatccagagagatgaagattcctatgtgatcaatggcaagaagtggtggagcagcggggccggcaaccccaagtgcaagatcgccatcgtgctgggccgcacccagaacaccagcctgagccgggaggtggtggcccactggattgctgagagcagaattgccatcgagaagatccggctgctgaccctgaaggccgcccacagcatggacaccctgggcagcgctggggccaagaaggagatcgccatgatcaaggtggccgcccccagggctgtgtccaagatcgtggactgggccatccaggtgtgtggcggggccggcgtgtcccaggactaccccctggccaacatgtatgccatcaccagggtgctgcggctggctgatggcccagatgaggtgcacctgagcgccatcgccaccatggagctgcgggaccaggccaagaggctgacagccaagatctag

SEQ ID NO: 142444 - DNA, 918 bp, Artificial Sequence
  Description of Artificial Sequence: Synthetic coding sequence
atggaggtgctgcacctgtatggcagcgaggagcagaagaagcagtggctggagcccctgctgcagggcaacatcaccagctgcttctgcatgacagagccagatgtggccagcagtgatgccaccaacattgaatgttccatccagagagatgaggacagctatgtgatcaacgggaagaagtggtggagcagtggagctggcaaccccaagtgcaagatcgccatcgtgctgggccgcacccagaacaccagcctgagccgccacaagcagcacagcatgatcctggtgcccatgaacaccccaggagtgaagatcatccggcccctgtctgtgtttggctacacagacaacttccacggcggccactttgagatccacttcaaccaggtgcgggtgcctgccaccaacctgatcctgggggagggccggggctttgagatcagccagggccgcctgggccctggccgcatccaccactgcatgaggacagtgggcctggccgagcgggccctgcagatcatgtgtgagcgggccacccagagaattgccttcaagaagaagctgtatgcccacgaggtggtggcccactggattgctgagagccgcatcgccatcgagaagatccggctgctgaccctgaaggccgcccacagcatggacaccctgggcagcgctggggccaagaaggagatcgccatgatcaaggtggccgcccccagggctgtgtccaagatcgtggactgggccatccaggtgtgtggcggggccggcgtgtcccaggactaccccctggccaacatgtatgccatcaccagggtgctgcggctggctgatggcccagatgaggtgcacctgagcgccatcgccaccatggagctgcgggaccaggccaagaggctgacagccaagatctag

SEQ ID NO: 142445 - DNA, 1248 bp, Artificial Sequence
  Description of Artificial Sequence: Synthetic coding sequence
atgctgtggagcggctgcagaagatttggagcccggctgggctgcctgcccggcggcctgcgggtgctggtgcagacaggccacaggagcctgaccagctgcatcgaccccagcatgggcctgaatgaggagcagaaggagttccagaaggtggcctttgattttgctgcccgggagatggcccccaacatggccgagtgggaccagaaggagctgtttcctgtggatgtgatgaggaaggccgcccagctgggctttggaggagtgtacatccagacagatgtgggcggcagcggcctgagccggctggacaccagcgtcatctttgaggccctggccaccggctgcaccagcaccacagcctacatcagcatccacaacatgtgtgcctggatgattgacagctttggaaatgaggagcagaggcacaagttctgcccccccctgtgcaccatggagaagtttgccagctactgcctgacagagcccggcagcggcagtgatgctgccagcctgctgaccagcgccaagaagcagggcgaccactacatcctgaatggcagcaaggccttcatctctggagctggggagagtgacatctacgtggtgatgtgcaggactggaggccctggccccaagggcatcagctgcatcgtggtggagaagggcaccccaggcctgagctttgggaagaaggagaagaaggtgggctggaacagccagcccaccagggctgtgatctttgaggactgtgctgtgcctgtggccaacagaattggcagcgagggccagggcttcctgattgctgtgcggggcctgaatggaggccgcatcaacatcgccagctgcagcctgggcgccgcccacgccagcgtcatcctgacccgggaccacctgaatgtgaggaagcagtttggagagcccctggccagcaaccagtacctgcagttcaccctggccgacatggccacccggctggtggccgcccggctgatggtgagaaatgctgctgtggccctgcaggaggagaggaaggatgctgtggccctgtgcagcatggccaagctgtttgccacagatgaatgttttgccatctgcaaccaggccctgcagatgcatggaggctacggctacctgaaggactatgctgtgcagcagtatgtgcgggacagccgggtgcaccagatcctggagggcagcaatgaggtgatgaggatcctgatcagccgcagcctgctgcaggagtag

SEQ ID NO: 142446 - DNA, 1074 bp, Artificial Sequence
  Description of Artificial Sequence: Synthetic coding sequence
atgaggaaggccgcccagctgggctttggaggagtgtacatccagacagatgtgggcggcagcggcctgagccggctggacaccagcgtcatctttgaggccctggccaccggctgcaccagcaccacagcctacatcagcatccacaacatgtgtgcctggatgattgacagctttggaaatgaggagcagaggcacaagttctgcccccccctgtgcaccatggagaagtttgccagctactgcctgacagagcccggcagcggcagtgatgctgccagcctgctgaccagcgccaagaagcagggcgaccactacatcctgaatggcagcaaggccttcatcagcggggccggggagagtgacatctacgtggtgatgtgcaggactggaggccctggccccaagggcatcagctgcatcgtggtggagaagggcaccccaggcctgagctttgggaagaaggagaagaaggtgggctggaacagccagcccacccgggccgtcatctttgaggactgtgctgtgcctgtggccaaccgcatcggcagcgagggccagggcttcctgattgctgtgcggggcctgaatggaggccgcatcaacatcgccagctgcagcctgggcgccgcccacgccagcgtcatcctgacccgggaccacctgaatgtgaggaagcagtttggagagcccctggccagcaaccagtacctgcagttcaccctggccgacatggccacccggctggtggccgcccggctgatggtgagaaatgctgctgtggccctgcaggaggagaggaaggatgctgtggccctgtgcagcatggccaagctgtttgccacagatgagtgctttgccatctgcaaccaggccctgcagatgcacggcggctacggctacctgaaggactatgctgtgcagcagtatgtgcgggacagccgggtgcaccagatcctggaggagctgttctggcagggccctggggtgcagagccgcagctttgtgccctttggaggcccccagatcgccctgctgctgcccttcagcagcggggacctgcgggagggctag

SEQ ID NO: 142447 - DNA, 819 bp, Artificial Sequence
  Description of Artificial Sequence: Synthetic coding sequence
atgggcctgaatgaggagcagaaggagttccagaaggtggcctttgattttgctgcccgggagatggcccccaacatggccgagtgggaccagaaggagctgtttcctgtggatgtgatgaggaaggccgcccagctgggctttggaggagtgtacatccagacagatgtgggcggcagcggcctgagccggctggacaccagcgtcatctttgaggccctggccaccggctgcaccagcaccacagcctacatcagcatccacaacatgtgtgcctggatgattgacagctttggaaatgaggagcagaggcacaagttctgcccccccctgtgcaccatggagaagtttgccagctactgcctgacagagcccggcagcggcagtgatgctgccagcctgctgaccagcgccaagaagcagggcgaccactacatcctgaatggcagcaaggccttcatctctggagctggggagagtgacatctacgtggtgatgtgcaggactggaggccctggccccaagggcatcagctgcatcgtggtggagaagggcaccccaggcctgagctttgggaagaaggagaagaaggtgggctggaacagccagcccaccagggctgtgatctttgaggactgtgctgtgcctgtggccaacagaattggcagcgagggccagggcttcctgattgctgtgcggggcctgaatggaggccgcatcaacatcgccagctgcagcctgggctgcccccggctgtgccacccccaccccaggcctccccagtgcccagaggccgtgtggagggccagcggccagtag

SEQ ID NO: 142448 - DNA, 681 bp, Artificial Sequence
  Description of Artificial Sequence: Synthetic coding sequence
atgaagagcaggaagaacttcaagaagtggcccctgaccctgctgcctgagcgctggctgcagatctggcagagcggcaccaggtccatgtgtgcctggatgattgacagctttggaaatgaggagcagaggcacaagttctgcccccccctgtgcaccatggagaagtttgccagctactgcctgacagagcccggcagcggcagtgatgctgccagcctgctgaccagcgccaagaagcagggcgaccactacatcctgaatggcagcaaggccttcatctctggagctggggagagtgacatctacgtggtgatgtgcaggactggaggccctggccccaagggcatcagctgcatcgtggtggagaagggcaccccaggcctgagctttgggaagaaggagaagaaggtgggctggaacagccagcccaccagggctgtgatctttgaggactgtgctgtgcctgtggccaacagaattggcagcgagggccagggcttcctgattgctgtgcggggcctgaatggaggccgcatcaacatcgccagctgcagcctgggcgccgcccacgccagcgtcatcctgacccgggaccacctgaatgtgaggaagcagtttggagagcccctggccagcaaccagaagaagcaggagaccctgaagctgtggatcacctag

SEQ ID NO: 142449 - DNA, 1866 bp, Artificial Sequence
  Description of Artificial Sequence: Synthetic coding sequence
atgagcggctgcggcctcttcctgcggaccacagctgctgcccgggcctgccggggcctggtggtgtccacagccaacagaaggctgctgcggaccagcccccctgtgcgggcctttgccaaggagctgttcctgggcaagatcaagaagaaggaggtgttccccttccctgaggtgtcccaggatgagctgaatgagatcaaccagttcctgggccctgtggagaagttcttcacagaggaggtggacagcaggaagattgaccaggagggcaagatcccagatgagaccctggagaagctgaagagcctgggcctgtttggcctgcaggtgcctgaggagtatggaggcctgggcttcagcaacaccatgtacagccggctgggggagatcatctccatggatggcagcatcaccgtgaccctggccgcccaccaggccatcggcctgaagggcatcatcctggccggcacagaggagcagaaggccaagtacctgcccaagctggccagcggggagcacatcgccgccttctgcctgacagagcccgccagcggcagtgatgctgccagcatccgcagccgggccaccctgtctgaggacaagaagcactacatcctgaatggcagcaaggtgtggatcaccaacggcggcctggccaacatcttcaccgtgtttgccaagacagaggtggtggacagtgatggctctgtgaaggacaagatcacagccttcatcgtggagcgggactttggaggagtgaccaacgggaagccagaggacaagctgggcatccggggcagcaacacctgtgaggtgcactttgagaacaccaagatccctgtggagaacatcctgggggaggtgggagatggcttcaaggtggccatgaacatcctgaacagcggccgcttctccatgggctctgtggtggccggcctgctgaagaggctgattgagatgacagcagaatatgcctgcaccaggaagcagttcaacaagaggctgtctgaatttggcctcatccaggagaagtttgccctgatggcccagaaggcctacgtgatggagagcatgacctacctgacagctggcatgctggaccagcccggcttcccagactgcagcattgaagctgccatggtgaaggtgttcagcagcgaggccgcctggcagtgtgtgtctgaggccctgcagatcctgggcggcctgggctacacccgggactacccctatgaaagaatcctgcgggacacccgcatcctgctgatctttgagggcaccaatgagatcctgaggatgtacatcgccctgaccggcctgcagcacgccggccgcatcctgaccacccgcatccacgagctgaagcaggccaaggtgtccacagtgatggacacagtgggccgccgcctgcgggacagcctgggccgcacagtggacctgggcctgaccggcaaccacggcgtggtgcaccccagcctggccgacagcgccaacaagtttgaggagaacacctactgcttcggccgcacagtggagaccctgctgctgcgctttgggaagaccatcatggaggagcagctggtgctgaagagggtggccaacatcctgatcaacctgtatggcatgacagctgtgctgagccgggccagccgcagcatccgcatcggcctgagaaatcatgaccacgaggtgctgctggccaacaccttctgtgtggaggcctacctgcagaacctcttcagcctgagccagctggacaagtatgcccctgagaacctggatgagcagatcaagaaggtgtcccagcagatcctggagaagagggcctacatctgtgcccaccccctggacaggacctgctag

SEQ ID NO: 142450 - DNA, 1467 bp, Artificial Sequence
  Description of Artificial Sequence: Synthetic coding sequence
atggatggcagcatcaccgtgaccctggccgcccaccaggccatcggcctgaagggcatcatcctggccggcacagaggagcagaaggccaagtacctgcccaagctggccagcggggagcacatcgccgccttctgcctgacagagcccgccagcggcagtgatgctgccagcatccgcagccgggccaccctgtctgaggacaagaagcactacatcctgaatggcagcaaggtgtggatcaccaatggaggcctggccaacatcttcaccgtgtttgccaagacagaggtggtggacagtgatggctctgtgaaggacaagatcacagccttcatcgtggagcgggactttggaggagtgaccaacgggaagccagaggacaagctgggcatccggggcagcaacacctgtgaggtgcactttgagaacaccaagatccctgtggagaacatcctgggggaggtgggagatggcttcaaggtggccatgaacatcctgaacagcggccgcttctccatgggctctgtggtggccggcctgctgaagaggctcatcgagatgacagcagaatatgcctgcaccaggaagcagttcaacaagaggctgtctgaatttggcctcatccaggagaagtttgccctgatggcccagaaggcctacgtgatggagagcatgacctacctgacagctggcatgctggaccagcccggcttcccagactgcagcattgaggccgccatggtgaaggtgttcagcagcgaggccgcctggcagtgtgtgtctgaggccctgcagatcctgggcggcctgggctacacccgggactacccctatgagcgcatcctgcgggacacccgcatcctgctgatctttgagggcaccaatgagatcctgaggatgtacatcgccctgaccggcctgcagcacgccggccgcatcctgaccacccgcatccacgagctgaagcaggccaaggtgtccacagtgatggacacagtgggccggcggctgcgggacagcctgggccgcacagtggacctgggcctgactggaaaccacggcgtggtgcaccccagcctggccgacagcgccaacaagtttgaggagaacacctactgctttggaagaacagtggagaccctgctgctgcgctttgggaagaccatcatggaggagcagctggtgctgaagagggtggccaacatcctgatcaacctgtatggcatgacagctgtgctgagccgggccagccgcagcatcagaattggcctgaggaaccacgaccacgaggtgctgctggccaacaccttctgtgtggaggcctacctgcagaacctcttcagcctgagccagctggacaagtatgcccctgagaacctggatgagcagatcaagaaggtgtcccagcagatcctggagaagagggcctacatctgtgcccaccccctggacaggacctgctag

SEQ ID NO: 142451 - DNA, 507 bp, Artificial Sequence
  Description of Artificial Sequence: Synthetic coding sequence
atggaggagcagctggtgctgaagggcggccagcacccccaccagcctgtgtggcatgatggccgggctgtggccggccagcccctgcacccccactgggccccccagccccggccccggggcagcctgggccagcacctgctgcggggcagcctgctggccgagagcctgcagcccctgtctgctggccaggtgtgcagcaggaagcccaggagccggctgaggaagtgccccagccgcagcctgcggtctgagcccatctctgtgcccaccctgtggacaggccatgctgagcggggccagtgccccctgctgcccccagcccccacccacggccccctgctggatgactgctacagcttcttccggcggctgggcctgagccaggtgaagccctttgtgccccggctgcacctgaagggctgccgcctggcctgggagagcctcttccaggtgctgacctgccggcagtgcagcctgaccggccccagccagctgctgaactag

SEQ ID NO: 142452 - DNA, 1239 bp, Artificial Sequence
  Description of Artificial Sequence: Synthetic coding sequence
atggctgctgccctgctggcccgggccagcggccctgcccggcgggccctgtgcccccgggcctggaggcagctgcacaccatctaccagagcgtggagctgcctgagacccaccagatgctgctgcagacctgccgggactttgctgagaaggagctgttccccatcgccgcccaggtggacaaggagcacctgtttcctgctgcccaggtgaagaagatgggcggcctgggcctgctggccatggatgtgcctgaggagctgggcggggccggcctggactacctggcctatgccatcgccatggaggagatcagccggggctgtgccagcactggagtcatcatgtctgtgaacaacagcctgtacctgggccccatcctgaagtttggcagcaaggagcagaagcaggcctgggtgacccccttcaccagcggggacaagattggctgctttgccctgtctgagcctggaaatggaagtgatgctggagctgccagcaccacagcccgggcagagggggacagctgggtgctgaatggcaccaaggcctggatcaccaatgcctgggaggccagcgctgctgtggtgtttgccagcacagaccgggccctgcagaacaagggcatcagcgccttcctggtgcccatgcccaccccaggcctgaccctgggcaagaaggaggacaagctgggcatccggggcagcagcacagccaacctgatctttgaggactgccgcatccccaaggacagcatcctgggggagcccggcatgggcttcaagatcgccatgcagaccctggacatgggcagaattggaattgccagccaggccctgggcatcgcccagacagccctggactgtgctgtgaactatgcagaaaataggatggccttcggggcccccctgaccaagctgcaggtgatccagttcaagctggccgacatggccctggccctggagagcgcccggctgctgacctggagggctgccatgctgaaggacaacaagaagcccttcatcaaggaggccgccatggccaagctggccgccagcgaggccgccacagccatcagccaccaggccatccagatcctgggcggcatgggctacgtgacagagatgcctgctgagcggcactacagagatgcccgcatcacagagatctatgagggcaccagcgagatccagaggctggtgattgctggccacctgctgcggagctaccgctcctag

SEQ ID NO: 142453 - DNA, 1365 bp, Artificial Sequence
  Description of Artificial Sequence: Synthetic coding sequence
atggctgctggcttcggccgctgctgccgggtgctgcggagcatcagccgcttccactggaggagccagcacaccaaggccaaccggcagcgggagcccggcctgggcttctcctttgagttcacagagcagcagaaggagttccaggccacagccaggaagtttgcccgggaggagatcatccctgtggccgcagaatatgacaagacaggagagtaccctgtgcccctcatcagaagagcctgggagctgggcctgatgaacacccacatccctgagaactgtgactacagcgtgtgccccctgctggaggcctgcaccctgtacctggatgccttcttcctgctgctgaccggcagcaacctgaacctgcacctgaacctgggcggcctgggcctgggcacctttgatgcctgcctgatcagcgaggagctggcctacggctgcaccggggtgcagacagccatcgagggcaacagcctgggccagatgcccatcatcatcgctggaaatgaccagcagaagaagaagtacctgggccgcatgacagaggagcccctgatgtgtgcctactgtgtgacagagcccggggccggcagtgatgtggccggcatcaagaccaaggccgagaagaagggagatgagtacatcatcaatggccagaagatgtggatcaccaatggaggcaaggccaactggtacttcctgctggcccggagtgaccctgaccccaaggccccagccaacaaggccttcaccggcttcatcgtggaggccgacaccccaggcatccagatcggcaggaaggagctgaacatgggccagcgctgcagcgacacccggggcatcgtgtttgaagatgtgaaggtgcccaaggaaaatgtgctgattggagatggagctggcttcaaggtggccatgggcgcctttgacaagaccaggcctgtggtggccgccggggctgtgggcctggcccagagggccctggatgaggccaccaagtatgccctggagaggaagaccttcggcaagctgctggtggagcaccaggccatctccttcatgctggccgagatggccatgaaggtggagctggccaggatgagctaccagagagctgcctgggaggtggacagcggcagaagaaacacctactatgccagcatcgccaaggcctttgctggggacatcgccaaccagctggccacagatgctgtgcagatcctgggcggcaatggcttcaacacagagtaccctgtggagaagctgatgagagatgccaagatctaccagatctatgagggcaccagccagatccagaggctgattgtggcccgggagcacatcgacaagtacaagaactag

SEQ ID NO: 142454 - DNA, 1266 bp, Artificial Sequence
  Description of Artificial Sequence: Synthetic coding sequence
atggctgctggcttcggccgctgctgccgggtgctgcggagcatcagccgcttccactggaggagccagcacaccaaggccaaccggcagcgggagcccggcctgggcttctcctttgagttcacagagcagcagaaggagttccaggccacagccaggaagtttgcccgggaggagatcatccctgtggccgcagaatatgacaagacaggagagtaccctgtgcccctcatcagaagagcctgggagctgggcctgatgaacacccacatccctgagaactgtggcggcctgggcctgggcacctttgatgcctgcctgatcagcgaggagctggcctacggctgcacaggagtgcagacagccatcgagggcaacagcctgggccagatgcccatcatcatcgctggaaatgaccagcagaagaagaagtacctgggccgcatgacagaggagcccctgatgtgtgcctactgtgtgacagagcctggagctggcagtgatgtggccggcatcaagaccaaggccgagaagaagggagatgagtacatcatcaatggccagaagatgtggatcaccaacggcggcaaggccaactggtacttcctgctggcccggagtgaccctgaccccaaggccccagccaacaaggccttcaccggcttcatcgtggaggccgacaccccaggcatccagattggaaggaaggagctgaacatgggccagcgctgcagcgacacccggggcatcgtgtttgaagatgtgaaggtgcccaaggaaaatgtgctgattggagatggagctggcttcaaggtggccatgggcgcctttgacaagaccaggcctgtggtggccgccggggctgtgggcctggcccagagggccctggatgaggccaccaagtatgccctggagaggaagaccttcggcaagctgctggtggagcaccaggccatctccttcatgctggccgagatggccatgaaggtggagctggccaggatgagctaccagagagctgcctgggaggtggacagcggcagaagaaacacctactatgccagcatcgccaaggcctttgctggggacatcgccaaccagctggccacagatgctgtgcagatcctgggcggcaatggcttcaacacagagtaccctgtggagaagctgatgagagatgccaagatctaccagatctatgagggcaccagccagatccagaggctcatcgtggcccgggagcacatcgacaagtacaagaactag

SEQ ID NO: 142455 - DNA, 1278 bp, Artificial Sequence
  Description of Artificial Sequence: Synthetic coding sequence
atggctgctggcttcggccgctgctgccgctgcagcctgcaggtgctgcggagcatcagccgcttccactggaggagccagcacaccaaggccaaccggcagcgggagcccggcctgggcttctcctttgagttcacagagcagcagaaggagttccaggccacagccaggaagtttgcccgggaggagatcatccctgtggccgcagaatatgacaagacaggagagtaccctgtgcccctcatcagaagagcctgggagctgggcctgatgaacacccacatccctgagaactgtggcggcctgggcctgggcacctttgatgcctgcctgatcagcgaggagctggcctacggctgcacaggagtgcagacagccatcgagggcaacagcctgggccagatgcccatcatcatcgctggaaatgaccagcagaagaagaagtacctgggccgcatgacagaggagcccctgatgtgtgcctactgtgtgacagagcctggagctggcagtgatgtggccggcatcaagaccaaggccgagaagaagggagatgagtacatcatcaatggccagaagatgtggatcaccaacggcggcaaggccaactggtacttcctgctggcccggagtgaccctgaccccaaggccccagccaacaaggccttcaccggcttcatcgtggaggccgacaccccaggcatccagattggaaggaaggagctgaacatgggccagcgctgcagcgacacccggggcatcgtgtttgaagatgtgaaggtgcccaaggaaaatgtgctgattggagatggagctggcttcaaggtggccatgggcgcctttgacaagaccaggcctgtggtggccgccggggctgtgggcctggcccagagggccctggatgaggccaccaagtatgccctggagaggaagaccttcggcaagctgctggtggagcaccaggccatctccttcatgctggccgagatggccatgaaggtggagctggccaggatgagctaccagagagctgcctgggaggtggacagcggcagaagaaacacctactatgccagcatcgccaaggcctttgctggggacatcgccaaccagctggccacagatgctgtgcagatcctgggcggcaatggcttcaacacagagtaccctgtggagaagctgatgagagatgccaagatctaccagatctatgagggcaccagccagatccagaggctcatcgtggcccgggagcacatcgacaagtacaagaactag

SEQ ID NO: 142456 - DNA, 1158 bp, Artificial Sequence
  Description of Artificial Sequence: Synthetic coding sequence
atgctgcaggagttcacagagcagcagaaggagttccaggccacagccaggaagtttgcccgggaggagatcatccctgtggccgcagaatatgacaagacaggagagtaccctgtgcccctcatcagaagagcctgggagctgggcctgatgaacacccacatccctgagaactgtggcggcctgggcctgggcacctttgatgcctgcctgatcagcgaggagctggcctacggctgcacaggagtgcagacagccatcgagggcaacagcctgggccagatgcccatcatcatcgctggaaatgaccagcagaagaagaagtacctgggccgcatgacagaggagcccctgatgtgtgcctactgtgtgacagagcctggagctggcagtgatgtggccggcatcaagaccaaggccgagaagaagggagatgagtacatcatcaatggccagaagatgtggatcaccaacggcggcaaggccaactggtacttcctgctggcccggagtgaccctgaccccaaggccccagccaacaaggccttcaccggcttcatcgtggaggccgacaccccaggcatccagattggaaggaaggagctgaacatgggccagcgctgcagcgacacccggggcatcgtgtttgaagatgtgaaggtgcccaaggaaaatgtgctgattggagatggagctggcttcaaggtggccatgggcgcctttgacaagaccaggcctgtggtggccgccggggctgtgggcctggcccagagggccctggatgaggccaccaagtatgccctggagaggaagaccttcggcaagctgctggtggagcaccaggccatctccttcatgctggccgagatggccatgaaggtggagctggccaggatgagctaccagagagctgcctgggaggtggacagcggcagaagaaacacctactatgccagcatcgccaaggcctttgctggggacatcgccaaccagctggccacagatgctgtgcagatcctgggcggcaatggcttcaacacagagtaccctgtggagaagctgatgagagatgccaagatctaccagatctatgagggcaccagccagatccagaggctcatcgtggcccgggagcacatcgacaagtacaagaactag

SEQ ID NO: 142457 - DNA, 699 bp, Artificial Sequence
  Description of Artificial Sequence: Synthetic coding sequence
atgtggatcaccaatggaggcaaggccaactggtacttcctgctggcccggagtgaccctgaccccaaggccccagccaacaaggccttcaccggcttcatcgtggaggccgacaccccaggcatccagatcggcaggaaggagctgaacatgggccagcgctgcagcgacacccggggcatcgtgtttgaagatgtgaaggtgcccaaggaaaatgtgctgattggagatggagctggcttcaaggtggccatgggcgcctttgacaagaccaggcctgtggtggccgccggggctgtgggcctggcccagagggccctggatgaggccaccaagtatgccctggagaggaagaccttcggcaagctgctggtggagcaccaggccatctccttcatgctggccgagatggccatgaaggtggagctggccaggatgagctaccagagagctgcctgggaggtggacagcggcagaagaaacacctactatgccagcatcgccaaggcctttgctggggacatcgccaaccagctggccacagatgctgtgcagatcctgggcggcaatggcttcaacacagagtaccctgtggagaagctgatgagagatgccaagatctaccagatctatgagggcaccagccagatccagaggctgattgtggcccgggagcacatcgacaagtacaagaactag

SEQ ID NO: 142458 - DNA, 1446 bp, Artificial Sequence
  Description of Artificial Sequence: Synthetic coding sequence
atggatggagctgtgatggagggccccctcttcctgcagagccagagatttggcaccaagcgctggaggaagacctgggccgtgctgtacccagccagcccccatggagtggcccggctggagttctttgaccacaagggcagcagcagcggcggcggccggggcagcagccggcggctggactgcaaggtgatccggctggctgaatgtgtgtctgtggcccctgtgacagtggagaccccacctgagcccggggccacagccttccggctggacacagcccagaggagccacctgctggccgcagatgcccccagcagcgctgcctgggtgcagaccctgtgcagaaatgccttccccaagggctcctggaccctggcccccacagacaacccccccaagctgagcgccctggagatgctggagaacagcctgtacagccccacctgggagggcagccagttctgggtgacagtgcagaggacagaggccgctgagcgctgtggcctgcacggcagctatgtgctgcgggtggaggccgagcggctgaccctgctgactgtgggcgcccagagccagatcctggagcccctgctgtcctggccctacaccctgctgcggcgctatggccgggacaaggtgatgttctcctttgaggccggccgccgctgccccagcggccctggcaccttcaccttccagacagcccagggcaatgacatcttccaggccgtggagacagccatccaccggcagaaggcccagggcaaggccggccagggccatgatgtgctgcgggctgacagccatgaaggagaggtggccgagggcaagctgcccagccccccaggcccccaggagctgctggacagccccccagccctgtatgcagagcccctggacagcctgagaattgccccctgccccagccaggacagcctgtacagcgaccccctggacagcaccagcgcccaggccggggagggcgtgcagaggaagaagcccctgtactgggacctgtatgaacatgcccagcagcagctgctgaaggccaagctgacagaccccaaggaggaccccatctatgatgagcctgagggcctggcccctgtgcccccccagggcctgtatgacctgccccgggagcccaaggatgcctggtggtgccaggcccgggtgaaggaggagggctatgagctgccctacaacccagccacagatgattatgctgtgcccccacccaggagcaccaagcccctgctggcccccaagccccagggccctgccttccctgagcctggaacagccactggaagtggcatcaagagccacaacagcgccctgtacagccaggtgcagaagagcggggccagcggctcctgggactgtggcctgagccgggtgggcacagacaagacaggagtgaagtctgagggcagcacctag

SEQ ID NO: 142459 - DNA, 1299 bp, Artificial Sequence
  Description of Artificial Sequence: Synthetic coding sequence
atggagggcctggccgtgcggctgctgcggggcagccggctgctgcggaggaacttcctgacctgcctgagctcctggaagatcccccctcatgtgtccaagagcagccagagcgaggccctgctgaacatcaccaacaacggcatccactttgcccccctgcagaccttcacagatgaggagatgatgatcaagagctctgtgaagaagtttgcccaggagcagatcgcccccctggtgtccaccatggatgagaacagcaagatggagaagagcgtcatccagggcctcttccagcagggcctgatgggcatcgaggtggaccctgaatatggaggcaccggggccagcttcctgagcacagtgctggtgattgaggagctggccaaggtggatgcctctgtggccgtgttctgtgagatccagaacaccctcatcaacaccctcatcaggaagcatggaacagaggagcagaaggccacctacctgccccagctgaccacagagaaggtgggcagcttctgcctgtctgaggccggggccggcagtgacagctttgccctgaagaccagggctgacaaggagggggactactacgtgctgaatggcagcaagatgtggatcagcagcgctgagcacgccggcctcttcctggtgatggccaacgtggaccccaccatcggctacaagggcatcaccagcttcctggtggaccgggacaccccaggcctgcacatcggcaagccagagaacaagctgggcctgcgggccagcagcacctgccccctgacctttgaaaatgtgaaggtgcctgaggccaacatcctgggccagattggacatggctacaagtatgccatcggcagcctgaatgaaggaagaattggaattgctgcccagatgctgggcctggcccagggctgctttgactacaccatcccctacatcaaggagcgcatccagtttgggaagaggctgtttgacttccagggcctgcagcaccaggtggcccacgtggccacccagctggaggccgcccggctgctgacctacaatgctgcccggctgctggaggccggcaagcccttcatcaaggaggcctccatggccaagtactatgccagcgagattgctggccagaccaccagcaagtgcatcgagtggatgggcggcgtgggctacaccaaggactaccctgtggagaagtacttcagagatgccaagattggcaccatctatgaaggagccagcaacatccagctgaacaccatcgccaagcacattgatgctgagtactag

SEQ ID NO: 142460 - DNA, 993 bp, Artificial Sequence
  Description of Artificial Sequence: Synthetic coding sequence
atgggcatcgaggtggaccctgaatatggaggcaccggggccagcttcctgagcacagtgctggtgattgaggagctggccaaggtggatgcctctgtggccgtgttctgtgagatccagaacaccctcatcaacaccctcatcaggaagcatggaacagaggagcagaaggccacctacctgccccagctgaccacagagaaggtgggcagcttctgcctgtctgaggccggggccggcagtgacagctttgccctgaagaccagggctgacaaggagggggactactacgtgctgaatggcagcaagatgtggatcagcagcgctgagcacgccggcctcttcctggtgatggccaacgtggaccccaccatcggctacaagggcatcaccagcttcctggtggaccgggacaccccaggcctgcacatcggcaagccagagaacaagctgggcctgcgggccagcagcacctgccccctgacctttgaaaatgtgaaggtgcctgaggccaacatcctgggccagattggacatggctacaagtatgccatcggcagcctgaatgaaggaagaattggaattgctgcccagatgctgggcctggcccagggctgctttgactacaccatcccctacatcaaggagcgcatccagtttgggaagaggctgtttgacttccagggcctgcagcaccaggtggcccacgtggccacccagctggaggccgcccggctgctgacctacaatgctgcccggctgctggaggccggcaagcccttcatcaaggaggcctccatggccaagtactatgccagcgagattgctggccagaccaccagcaagtgcatcgagtggatgggcggcgtgggctacaccaaggactaccctgtggagaagtacttcagagatgccaagattggcaccatctatgaaggagccagcaacatccagctgaacaccatcgccaagcacattgatgctgagtactag

SEQ ID NO: 142461 - DNA, 1968 bp, Artificial Sequence
  Description of Artificial Sequence: Synthetic coding sequence
atgcaggccgccaggatggccgccagcctgggccggcagctgctgcggctgggcggcggcagcagccggctgacagccctgctgggccagcccaggcctggccctgcccggcggccctatgccggcggggccgcccagctggccctggacaagagtgacagccaccccagtgatgccctgaccaggaagaagccagccaaggccgagagcaagagctttgctgtgggcatgttcaagggccagctgaccacagaccaggtgttcccctaccccagcgtgctgaatgaggagcagacccagttcctgaaggagctggtggagcctgtgagccgcttctttgaggaggtgaatgaccctgccaagaatgatgccctggagatggtggaggagaccacctggcagggcctgaaggagctgggcgccttcggcctgcaggtgcccagcgagctgggcggcgtgggcctgtgcaacacccagtatgcccggctggtggagatcgtgggcatgcatgacctgggcgtgggcatcaccctgggcgcccaccagagcatcggcttcaagggcatcctgctgtttggcaccaaggcccagaaggagaagtacctgcccaagctggccagcggggagaccgtggccgccttctgcctgacagagcccagcagcggcagtgatgctgccagcatccgcaccagcgctgtgcccagcccctgtgggaagtactacaccctgaatggcagcaagctgtggatcagcaatggaggcctggccgacatcttcaccgtgtttgccaagacccctgtgacagatcctgccaccggggctgtgaaggagaagatcacagcctttgtggtggagcggggctttggaggcatcacccacggccccccagagaagaagatgggcatcaaggccagcaacacagctgaggtgttctttgatggagtgcgggtgcccagtgaaaatgtgctgggggaggtgggcagcggcttcaaggtggccatgcacatcctgaacaacggccgcttcggcatggccgccgccctggccggcaccatgaggggcatcatcgccaaggctgtggaccacgccaccaacagaacccagtttggagagaagatccacaactttggcctcatccaggagaagctggccaggatggtgatgctgcagtatgtgacagagagcatggcctacatggtgtctgccaacatggaccagggcgccacagacttccagattgaagctgccatcagcaagatctttggaagtgaagctgcctggaaggtgacagatgagtgcatccagatcatgggcggcatgggcttcatgaaggagcccggggtggagcgggtgctgcgggacctgcgcatcttccgcatctttgagggcaccaatgacatcctgcggctgtttgtggccctgcagggctgcatggacaagggcaaggagctgagcggcctgggcagcgccctgaagaacccctttggaaatgccggcctgctgctgggggaggccggcaagcagctgcggaggagagctggcctgggcagcggcctgagcctgagcggcctggtgcaccctgagctgagccgcagcggggagctggccgtgcgggccctggagcagtttgccaccgtggtggaggccaagctgatcaagcacaagaagggcatcgtgaatgagcagttcctgctgcagaggctggctgatggagccatcgacctgtatgccatggtggtggtgctgagccgggccagccgcagcctgtctgagggccaccccacagcccagcacgagaagatgctgtgtgacacctggtgcatcgaggccgccgcccgcatccgggagggcatggccgccctgcagagcgacccctggcagcaggagctgtacagaaacttcaagagcatcagcaaggccctggtggagcggggcggcgtggtgaccagcaaccccctgggcttctag

SEQ ID NO: 142462 - DNA, 1902 bp, Artificial Sequence
  Description of Artificial Sequence: Synthetic coding sequence
atgcaggccgccaggatggccgccagcctgggccggcagctgctgcggctgggcggcggcagcagccggctgacagccctgctgggccagcccaggcctggccctgcccggcggccctatgccggcggggccgcccaggagagcaagagctttgctgtgggcatgttcaagggccagctgaccacagaccaggtgttcccctaccccagcgtgctgaatgaggagcagacccagttcctgaaggagctggtggagcctgtgagccgcttctttgaggaggtgaatgaccctgccaagaatgatgccctggagatggtggaggagaccacctggcagggcctgaaggagctgggcgccttcggcctgcaggtgcccagcgagctgggcggcgtgggcctgtgcaacacccagtatgcccggctggtggagatcgtgggcatgcatgacctgggcgtgggcatcaccctgggcgcccaccagagcatcggcttcaagggcatcctgctgtttggcaccaaggcccagaaggagaagtacctgcccaagctggccagcggggagaccgtggccgccttctgcctgacagagcccagcagcggcagtgatgctgccagcatccgcaccagcgctgtgcccagcccctgtgggaagtactacaccctgaatggcagcaagctgtggatcagcaatggaggcctggccgacatcttcaccgtgtttgccaagacccctgtgacagatcctgccaccggggctgtgaaggagaagatcacagcctttgtggtggagcggggctttggaggcatcacccacggccccccagagaagaagatgggcatcaaggccagcaacacagctgaggtgttctttgatggagtgcgggtgcccagtgaaaatgtgctgggggaggtgggcagcggcttcaaggtggccatgcacatcctgaacaacggccgcttcggcatggccgccgccctggccggcaccatgaggggcatcatcgccaaggctgtggaccacgccaccaacagaacccagtttggagagaagatccacaactttggcctcatccaggagaagctggccaggatggtgatgctgcagtatgtgacagagagcatggcctacatggtgtctgccaacatggaccagggcgccacagacttccagattgaagctgccatcagcaagatctttggaagtgaagctgcctggaaggtgacagatgagtgcatccagatcatgggcggcatgggcttcatgaaggagcccggggtggagcgggtgctgcgggacctgcgcatcttccgcatctttgagggcaccaatgacatcctgcggctgtttgtggccctgcagggctgcatggacaagggcaaggagctgagcggcctgggcagcgccctgaagaacccctttggaaatgccggcctgctgctgggggaggccggcaagcagctgcggaggagagctggcctgggcagcggcctgagcctgagcggcctggtgcaccctgagctgagccgcagcggggagctggccgtgcgggccctggagcagtttgccaccgtggtggaggccaagctgatcaagcacaagaagggcatcgtgaatgagcagttcctgctgcagaggctggctgatggagccatcgacctgtatgccatggtggtggtgctgagccgggccagccgcagcctgtctgagggccaccccacagcccagcacgagaagatgctgtgtgacacctggtgcatcgaggccgccgcccgcatccgggagggcatggccgccctgcagagcgacccctggcagcaggagctgtacagaaacttcaagagcatcagcaaggccctggtggagcggggcggcgtggtgaccagcaaccccctgggcttctag

SEQ ID NO: 142463 - DNA, 2106 bp, Artificial Sequence
  Description of Artificial Sequence: Synthetic coding sequence
atgccccggggcccccagcccagcgctgcccgctgcaccgtggatgatgagagcggcctgggcgcccctggccggggccgggccggccggcagagctgggtgcgggcccgggccagcggggcccggcgggacagcgagatgcaggccgccaggatggccgccagcctgggccggcagctgctgcggctgggcggcggcagcagccggctgacagccctgctgggccagcccaggcctggccctgcccggcggccctatgccggcggggccgcccagctggccctggacaagagtgacagccaccccagtgatgccctgaccaggaagaagccagccaaggccgagagcaagagctttgctgtgggcatgttcaagggccagctgaccacagaccaggtgttcccctaccccagcgtgctgaatgaggagcagacccagttcctgaaggagctggtggagcctgtgagccgcttctttgaggaggtgaatgaccctgccaagaatgatgccctggagatggtggaggagaccacctggcagggcctgaaggagctgggcgccttcggcctgcaggtgcccagcgagctgggcggcgtgggcctgtgcaacacccagtatgcccggctggtggagatcgtgggcatgcatgacctgggcgtgggcatcaccctgggcgcccaccagagcatcggcttcaagggcatcctgctgtttggcaccaaggcccagaaggagaagtacctgcccaagctggccagcggggagaccgtggccgccttctgcctgacagagcccagcagcggcagtgatgctgccagcatccgcaccagcgctgtgcccagcccctgtgggaagtactacaccctgaatggcagcaagctgtggatcagcaatggaggcctggccgacatcttcaccgtgtttgccaagacccctgtgacagatcctgccaccggggctgtgaaggagaagatcacagcctttgtggtggagcggggctttggaggcatcacccacggccccccagagaagaagatgggcatcaaggccagcaacacagctgaggtgttctttgatggagtgcgggtgcccagtgaaaatgtgctgggggaggtgggcagcggcttcaaggtggccatgcacatcctgaacaacggccgcttcggcatggccgccgccctggccggcaccatgaggggcatcatcgccaaggctgtggaccacgccaccaacagaacccagtttggagagaagatccacaactttggcctcatccaggagaagctggccaggatggtgatgctgcagtatgtgacagagagcatggcctacatggtgtctgccaacatggaccagggcgccacagacttccagattgaagctgccatcagcaagatctttggaagtgaagctgcctggaaggtgacagatgagtgcatccagatcatgggcggcatgggcttcatgaaggagcccggggtggagcgggtgctgcgggacctgcgcatcttccgcatctttgagggcaccaatgacatcctgcggctgtttgtggccctgcagggctgcatggacaagggcaaggagctgagcggcctgggcagcgccctgaagaacccctttggaaatgccggcctgctgctgggggaggccggcaagcagctgcggaggagagctggcctgggcagcggcctgagcctgagcggcctggtgcaccctgagctgagccgcagcggggagctggccgtgcgggccctggagcagtttgccaccgtggtggaggccaagctgatcaagcacaagaagggcatcgtgaatgagcagttcctgctgcagaggctggctgatggagccatcgacctgtatgccatggtggtggtgctgagccgggccagccgcagcctgtctgagggccaccccacagcccagcacgagaagatgctgtgtgacacctggtgcatcgaggccgccgcccgcatccgggagggcatggccgccctgcagagcgacccctggcagcaggagctgtacagaaacttcaagagcatcagcaaggccctggtggagcggggcggcgtggtgaccagcaaccccctgggcttctag

SEQ ID NO: 142464 - DNA, 2106 bp, Artificial Sequence; identical to SEQ ID NO: 142463
  Description of Artificial Sequence: Synthetic coding sequence

SEQ ID NO: 142465 - DNA, 2037 bp, Artificial Sequence
  Description of Artificial Sequence: Synthetic coding sequence
atgctgggcggcctggccgctgctgctggcacccgcatcatgggcaaggagattgaggccgaggcccagaggcccctgcggcagacctggaggcctggccagcccccagccatgacagccaagaccatgagcagccggctgacagccctgctgggccagccccggcccggccctgcccggcggccctatgctgggggcgccgcccagctggccctggacaagagtgacagccaccccagtgatgccctgaccaggaagaagccagccaaggccgagagcaagagctttgctgtgggcatgttcaagggccagctgaccacagaccaggtgttcccctaccccagcgtgctgaatgaggagcagacccagttcctgaaggagctggtggagcctgtgagccgcttctttgaggaggtgaatgaccctgccaagaatgatgccctggagatggtggaggagaccacctggcagggcctgaaggagctgggcgccttcggcctgcaggtgcccagcgagctgggcggcgtgggcctgtgcaacacccagtatgcccggctggtggagatcgtgggcatgcatgacctgggcgtgggcatcaccctgggcgcccaccagagcatcggcttcaagggcatcctgctgtttggcaccaaggcccagaaggagaagtacctgcccaagctggccagcggggagaccgtggccgccttctgcctgacagagcccagcagcggcagtgatgctgccagcatccgcaccagcgctgtgcccagcccctgtgggaagtactacaccctgaatggcagcaagctgtggatcagcaatggaggcctggccgacatcttcaccgtgtttgccaagacccctgtgacagatcctgccactggagctgtgaaggagaagatcacagcctttgtggtggagcggggctttggaggcatcacccacggccccccagagaagaagatgggcatcaaggccagcaacacagctgaggtgttctttgatggagtgcgggtgcccagtgaaaatgtgctgggggaggtgggcagcggcttcaaggtggccatgcacatcctgaacaacggccgcttcggcatggctgctgccctggccggcaccatgaggggcatcatcgccaaggctgtggaccacgccaccaacagaacccagtttggagagaagatccacaactttggcctcatccaggagaagctggccaggatggtgatgctgcagtatgtgacagagagcatggcctacatggtgtctgccaacatggaccagggcgccacagacttccagatcgaggccgccatcagcaagatcttcggcagcgaggccgcctggaaggtgacagatgagtgcatccagatcatgggcggcatgggcttcatgaaggagcccggggtggagcgggtgctgcgggacctgcgcatcttccgcatctttgagggcaccaatgacatcctgcggctgtttgtggccctgcagggctgcatggacaagggcaaggagctgagcggcctgggcagcgccctgaagaacccctttggaaatgccggcctgctgctgggggaggccggcaagcagctgcggcggcgggccggcctgggcagcggcctgagcctgagcggcctggtgcaccctgagctgagccgctctggagagctggccgtgcgggccctggagcagtttgccaccgtggtggaggccaagctgatcaagcacaagaagggcatcgtgaatgagcagttcctgctgcagaggctggctgatggagccatcgacctgtatgccatggtggtggtgctgagccgggccagccgcagcctgtctgagggccaccccacagcccagcacgagaagatgctgtgtgacacctggtgcattgaagctgctgcccgcatccgggagggcatggccgccctgcagagcgacccctggcagcaggagctgtacagaaacttcaagagcatcagcaaggccctggtggagcggggcggcgtggtgaccagcaaccccctgggcttctag

SEQ ID NO: 142466 - DNA, 1983 bp, Artificial Sequence
  Description of Artificial Sequence: Synthetic coding sequence
atgaacccagacctgcggcgggagcgggacagcgccagcttcaaccctgagctgctgacccacatcctggatggcagccctgagaagaccaggagaagaagagaaattgagaacatgatcctgaatgaccctgacttccagcacgaggacctgaacttcctgaccaggagccagagatatgaggtggccgtgaggaagagcgccatcatggtgaagaagatgagggagtttggaattgctgaccctgatgagatcatgtggttcaagaactttgtgcaccggggccggcctgagcccctggacctgcacctgggcatgttcctgcccaccctgctgcaccaggccacagctgagcagcaggagcgcttcttcatgcctgcctggaacctggagatcatcggcacctacgcccagacagagatgggccacggcacccacctgcggggcctggagaccacagccacctatgaccctgagacccaggagttcatcctgaacagccccaccgtgaccagcatcaagtggtggccaggcggcctgggcaagaccagcaaccacgccatcgtgctggcccagctgatcaccaagggcaagtgctacggcctgcacgccttcatcgtgcccatccgggagatcggcacccacaagcccctgcccggcatcaccgtgggggacatcggccccaagtttggctatgatgaaattgacaatggctacctgaagatggacaaccaccgcatcccccgggagaacatgctgatgaagtatgcccaggtgaagccagatggcacctacgtgaagcccctgagcaacaagctgacctacggcaccatggtgtttgtgcgctccttcctggtgggggaggccgcccgggccctgagcaaggcctgcaccatcgccatccgctacagcgctgtgcgccaccagagcgagatcaagccaggagagcctgagccccagatcctggacttccagacccagcagtacaagctgttccccctgctggccacagcctatgccttccagtttgtgggcgcctacatgaaggagacctaccaccgcatcaatgaaggaattggccagggcgacctgtctgagctgcctgagctgcacgccctgacagctggcctgaaggccttcacctcctggacagccaacacaggaattgaggcctgcaggatggcctgtggcggccacggctacagccactgcagcggcctgcccaacatctacgtgaacttcacccccagctgcacctttgaaggagaaaatacagtgatgatgctgcagacagcccgcttcctgatgaagagctatgaccaggtgcacagcggcaagctggtgtgtggcatggtgtcctacctgaatgacctgcccagccagaggatccagccccagcaggtggccgtgtggcccaccatggtggacatcaacagccctgagagcctgacagaggcctacaagctgcgggccgcccggctggtggagattgctgccaagaacctgcagaaggaggtgatccacaggaagagcaaggaggtggcctggaacctgacctctgtggacctggtgcgggccagcgaggcccactgccactacgtggtggtgaagctgttcagcgagaagctgctgaagatccaggacaaggccatccaggccgtgctgcggagcctgtgcctgctgtacagcctgtatggcatcagccagaatgctggggacttcctgcagggcagcatcatgacagagccccagatcacccaggtgaaccagagggtgaaggagctgctgaccctcatccgcagtgatgctgtggccctggtggatgcctttgacttccaggatgtgaccctgggctctgtgctgggccgctatgatggaaatgtgtatgagaacctgtttgagtgggccaagaacagccccctgaacaaggccgaggtgcatgagagctacaagcacctgaagagcctgcagagcaagctgtag

SEQ ID NO: 142467 - DNA, 1983 bp, Artificial Sequence
  Description of Artificial Sequence: Synthetic coding sequence
atgaacccagacctgcggcgggagcgggacagcgccagcttcaaccctgagctgctgacccacatcctggatggcagccctgagaagaccaggagaagaagagaaattgagaacatgatcctgaatgaccctgacttccagcacgaggacctgaacttcctgaccaggagccagagatatgaggtggccgtgaggaagagcgccatcatggtgaagaagatgagggagtttggaattgctgaccctgatgagatcatgtggttcaagaagctgcacctggtgaactttgtggagcctgtgggcctgaactacagcatgttcatccccaccctgctgaaccagggcaccacagcccagaaggagaagtggctgctgagcagcaagggcctgcagatcatcggcacctacgcccagacagagatgggccacggcacccacctgcggggcctggagaccacagccacctatgaccctgagacccaggagttcatcctgaacagccccaccgtgaccagcatcaagtggtggccaggcggcctgggcaagaccagcaaccacgccatcgtgctggcccagctgatcaccaagggcaagtgctacggcctgcacgccttcatcgtgcccatccgggagatcggcacccacaagcccctgcccggcatcaccgtgggggacatcggccccaagtttggctatgatgaaattgacaatggctacctgaagatggacaaccaccgcatcccccgggagaacatgctgatgaagtatgcccaggtgaagccagatggcacctacgtgaagcccctgagcaacaagctgacctacggcaccatggtgtttgtgcgctccttcctggtgggggaggccgcccgggccctgagcaaggcctgcaccatcgccatccgctacagcgctgtgcgccaccagagcgagatcaagccaggagagcctgagccccagatcctggacttccagacccagcagtacaagctgttccccctgctggccacagcctatgccttccagtttgtgggcgcctacatgaaggagacctaccaccgcatcaatgaaggaattggccagggcgacctgtctgagctgcctgagctgcacgccctgacagctggcctgaaggccttcacctcctggacagccaacacaggaattgaggcctgcaggatggcctgtggcggccacggctacagccactgcagcggcctgcccaacatctacgtgaacttcacccccagctgcacctttgaaggagaaaatacagtgatgatgctgcagacagcccgcttcctgatgaagagctatgaccaggtgcacagcggcaagctggtgtgtggcatggtgtcctacctgaatgacctgcccagccagaggatccagccccagcaggtggccgtgtggcccaccatggtggacatcaacagccctgagagcctgacagaggcctacaagctgcgggccgcccggctggtggagattgctgccaagaacctgcagaaggaggtgatccacaggaagagcaaggaggtggcctggaacctgacctctgtggacctggtgcgggccagcgaggcccactgccactacgtggtggtgaagctgttcagcgagaagctgctgaagatccaggacaaggccatccaggccgtgctgcggagcctgtgcctgctgtacagcctgtatggcatcagccagaatgctggggacttcctgcagggcagcatcatgacagagccccagatcacccaggtgaaccagagggtgaaggagctgctgaccctcatccgcagtgatgctgtggccctggtggatgcctttgacttccaggatgtgaccctgggctctgtgctgggccgctatgatggaaatgtgtatgagaacctgtttgagtgggccaagaacagccccctgaacaaggccgaggtgcatgagagctacaagcacctgaagagcctgcagagcaagctgtag

SEQ ID NO: 142468 - DNA, 1869 bp, Artificial Sequence
  Description of Artificial Sequence: Synthetic coding sequence
atgatcctgaatgaccctgacttccagcacgaggacctgaacttcctgaccaggagccagagatatgaggtggccgtgaggaagagcgccatcatggtgaagaagatgagggagtttggaattgctgaccctgatgagatcatgtggttcaagaactttgtgcaccggggccggcctgagcccctggacctgcacctgggcatgttcctgcccaccctgctgcaccaggccacagctgagcagcaggagcgcttcttcatgcctgcctggaacctggagatcatcggcacctacgcccagacagagatgggccacggcacccacctgcggggcctggagaccacagccacctatgaccctgagacccaggagttcatcctgaacagccccaccgtgaccagcatcaagtggtggccaggcggcctgggcaagaccagcaaccacgccatcgtgctggcccagctgatcaccaagggcaagtgctacggcctgcacgccttcatcgtgcccatccgggagatcggcacccacaagcccctgcccggcatcaccgtgggggacatcggccccaagtttggctatgatgaaattgacaatggctacctgaagatggacaaccaccgcatcccccgggagaacatgctgatgaagtatgcccaggtgaagccagatggcacctacgtgaagcccctgagcaacaagctgacctacggcaccatggtgtttgtgcgctccttcctggtgggggaggccgcccgggccctgagcaaggcctgcaccatcgccatccgctacagcgctgtgcgccaccagagcgagatcaagccaggagagcctgagccccagatcctggacttccagacccagcagtacaagctgttccccctgctggccacagcctatgccttccagtttgtgggcgcctacatgaaggagacctaccaccgcatcaatgaaggaattggccagggcgacctgtctgagctgcctgagctgcacgccctgacagctggcctgaaggccttcacctcctggacagccaacacaggaattgaggcctgcaggatggcctgtggcggccacggctacagccactgcagcggcctgcccaacatctacgtgaacttcacccccagctgcacctttgaaggagaaaatacagtgatgatgctgcagacagcccgcttcctgatgaagagctatgaccaggtgcacagcggcaagctggtgtgtggcatggtgtcctacctgaatgacctgcccagccagaggatccagccccagcaggtggccgtgtggcccaccatggtggacatcaacagccctgagagcctgacagaggcctacaagctgcgggccgcccggctggtggagattgctgccaagaacctgcagaaggaggtgatccacaggaagagcaaggaggtggcctggaacctgacctctgtggacctggtgcgggccagcgaggcccactgccactacgtggtggtgaagctgttcagcgagaagctgctgaagatccaggacaaggccatccaggccgtgctgcggagcctgtgcctgctgtacagcctgtatggcatcagccagaatgctggggacttcctgcagggcagcatcatgacagagccccagatcacccaggtgaaccagagggtgaaggagctgctgaccctcatccgcagtgatgctgtggccctggtggatgcctttgacttccaggatgtgaccctgggctctgtgctgggccgctatgatggaaatgtgtatgagaacctgtttgagtgggccaagaacagccccctgaacaaggccgaggtgcatgagagctacaagcacctgaagagcctgcagagcaagctgtag

SEQ ID NO: 142469 - DNA, 1779 bp, Artificial Sequence
  Description of Artificial Sequence: Synthetic coding sequence
atggccgccttcatccagaggaccccagacaactggcacctgcggccagatggaaatggccccaggtttgtgcaccggggccggcctgagcccctggacctgcacctgggcatgttcctgcccaccctgctgcaccaggccacagctgagcagcaggagcgcttcttcatgcctgcctggaacctggagatcatcggcacctacgcccagacagagatgggccacggcacccacctgcggggcctggagaccacagccacctatgaccctgagacccaggagttcatcctgaacagccccaccgtgaccagcatcaagtggtggccaggcggcctgggcaagaccagcaaccacgccatcgtgctggcccagctgatcaccaagggcaagtgctacggcctgcacgccttcatcgtgcccatccgggagatcggcacccacaagcccctgcccggcatcaccgtgggggacatcggccccaagtttggctatgatgaaattgacaatggctacctgaagatggacaaccaccgcatcccccgggagaacatgctgatgaagtatgcccaggtgaagccagatggcacctacgtgaagcccctgagcaacaagctgacctacggcaccatggtgtttgtgcgctccttcctggtgggggaggccgcccgggccctgagcaaggcctgcaccatcgccatccgctacagcgctgtgcgccaccagagcgagatcaagccaggagagcctgagccccagatcctggacttccagacccagcagtacaagctgttccccctgctggccacagcctatgccttccagtttgtgggcgcctacatgaaggagacctaccaccgcatcaatgaaggaattggccagggcgacctgtctgagctgcctgagctgcacgccctgacagctggcctgaaggccttcacctcctggacagccaacacaggaattgaggcctgcaggatggcctgtggcggccacggctacagccactgcagcggcctgcccaacatctacgtgaacttcacccccagctgcacctttgaaggagaaaatacagtgatgatgctgcagacagcccgcttcctgatgaagagctatgaccaggtgcacagcggcaagctggtgtgtggcatggtgtcctacctgaatgacctgcccagccagaggatccagccccagcaggtggccgtgtggcccaccatggtggacatcaacagccctgagagcctgacagaggcctacaagctgcgggccgcccggctggtggagattgctgccaagaacctgcagaaggaggtgatccacaggaagagcaaggaggtggcctggaacctgacctctgtggacctggtgcgggccagcgaggcccactgccactacgtggtggtgaagctgttcagcgagaagctgctgaagatccaggacaaggccatccaggccgtgctgcggagcctgtgcctgctgtacagcctgtatggcatcagccagaatgctggggacttcctgcagggcagcatcatgacagagccccagatcacccaggtgaaccagagggtgaaggagctgctgaccctcatccgcagtgatgctgtggccctggtggatgcctttgacttccaggatgtgaccctgggctctgtgctgggccgctatgatggaaatgtgtatgagaacctgtttgagtgggccaagaacagccccctgaacaaggccgaggtgcatgagagctacaagcacctgaagagcctgcagagcaagctgtag

SEQ ID NO: 142470 - DNA, 1983 bp, Artificial Sequence; identical to SEQ ID NO: 142466
  Description of Artificial Sequence: Synthetic coding sequence

SEQ ID NO: 142471 - DNA, 2046 bp, Artificial Sequence
  Description of Artificial Sequence: Synthetic coding sequence
atgggcagccctgtgcaccgggtgtccctgggggacacctggagccggcagatgcacccagacatcgagagcgagcgctacatgcagagctttgatgtggagcggctgaccaacatcctggatggaggagcccagaacacagccctgcggaggaaggtggagagcatcatccacagctacccagagttcagctgcaaggacaactacttcatgacccagaatgaaagatacaaggccgccatgaggcgggccttccacatccgcctcatcgcccggcggctgggctggctggaggatggccgggagctgggctacgcctaccgggccctgtctggagatgtggccctgaacatccaccgggtgtttgtgcgggccctgcggagcctgggcagcgaggagcagatcgccaagtgggaccccctgtgcaagaacatccagatcatcgccacctacgcccagacagagctgggccacggcacctacctgcagggcctggagacagaggccacctatgatgctgccacccaggagtttgtgatccacagccccaccctgacagccaccaagtggtggccaggggacctgggccgcagcgccacccacgccctggtgcaggcccagctgatctgcagcggggcccggcggggcatgcacgccttcatcgtgcccatccgcagcctgcaggaccacacccccctgcccggcatcatcatcggggacatcggccccaagatggactttgaccagacagacaatggcttcctgcagctgaaccacgtgcgggtgccccgggagaacatgctgagcagatttgcccaggtgctgcctgatggcacctacgtgaagctgggcacagcccagagcaactacctgcccatggtggtggtgcgggtggagctgctgagcggggagatcctgcccatcctgcagaaggcctgtgtgattgccatgagatacagcgtcatccggcggcagagccggctgcggcccagcgaccctgaggccaaggtgctggactaccagacccagcagcagaagctgttcccccagctggccatctcctatgccttccacttcctggccgtgtccctgctggagttcttccagcacagctacacagccatcctgaaccaggacttctccttcctgcctgagctgcacgccctgagcacaggcatgaaggccatgatgtctgagttctgcacccagggcgctgagatgtgcagaagagcctgtggcggccacggctacagcaagctgagcggcctgcccagcctggtgaccaagctgagcgccagctgcacctatgaaggagaaaatacagtgctgtacctgcaggtggcccgcttcctggtgaagagctacctgcagacccagatgagccctggcagcaccccccagaggagcctgagccccagcgtggcctacctgacagccccagacctggcccgctgcccagcccagagagctgctgacttcctgtgcccagagctgtacaccacagcctgggcccacgtggccgtgcggctcatcaaggacagcgtgcagcacctgcagaccctgacccagagcggggctgaccagcacgaggcctggaaccagaccaccgtcatccacctgcaggccgccaaggtgcactgctactacgtgacagtgaagggcttcacagaggccctggagaagctggagaatgagcccgccatccagcaggtgctgaagaggctgtgtgacctgcacgccatccacggcatcctgaccaacagcggggacttcctgcatgatgccttcctgagcggggcccaggtggacatggccaggacagcctacctggacctgctgcggctcatcaggaaggatgccatcctgctgacagatgcctttgacttcacagaccagtgcctgaacagcgccctgggctgctatgatggaaatgtgtatgaaagactcttccagtgggcccagaagagccccaccaacacccaggagaacccagcctatgaggagtacatccggcccctgctgcagagctggaggagcaagctgtag

SEQ ID NO: 142472 - DNA, 516 bp, Artificial Sequence
  Description of Artificial Sequence: Synthetic coding sequence
atgggcagccctgtgcaccgggtgtccctgggggacacctggagccggcagatgcacccagacatcgagagcgagcgctacatgcagagctttgatgtggagcggctgaccaacatcctggatggaggagcccagaacacagccctgcggaggaaggtggagagcatcatccacagctacccagagttcagctgcaaggacaactacttcatgacccagaatgaaagatacaaggccgccatgaggcgggccttccacatccgcctcatcgcccggcggctgggctggctggaggatggccgggagctgggctacgcctaccgggccctgtctggagatgtggccctgaacatccaccgggtgtttgtgcgggccctgcggagcctgggcagcgaggagcagatcgccaagtgggaccccctgtgcaagaacatccagatcatcgccacctacgcccagacagagctgggccacggcacctacctgcagggcctggagacagaggccacctactag

SEQ ID NO: 142473 - DNA, 2103 bp, Artificial Sequence
  Description of Artificial Sequence: Synthetic coding sequence
atggccagcacagtggagggcggggacacagccctgctgcctgagttcccccggggccccctggatgcctaccgggcccgggccagcttctcctggaaggagctggccctcttcacagaaggagagggcatgctgcgcttcaagaagaccatcttcagcgccctggagaatgaccccctgtttgcccggagccctggagctgacctgagcctggagaagtaccgggagctgaacttcctgcgctgcaagaggatctttgaatatgacttcctgtctgtggaggacatgttcaagagccccctgaaggtgcctgccctgatccagtgcctgggcatgtatgacagcagcctggccgccaagtacctgctgcacagcctggtgtttggcagcgctgtgtacagcagcggcagcgagcggcacctgacctacatccagaagatcttcaggatggagatcttcggctgctttgccctgacagagctgagccacggcagcaacaccaaggccatccgcaccacagcccactatgaccctgccacagaggagttcatcatccacagcccagactttgaggccgccaagttctgggtgggcaacatgggcaagacagccacccatgctgtggtgtttgccaagctgtgtgtgcctggggaccagtgccacggcctgcaccccttcatcgtgcagatccgggaccccaagaccctgctgcccatgcctggggtgatggtgggggacatcggcaagaagctgggccagaatggcctggacaatggatttgccatgttccacaaggtgcgggtgccccggcagagcctgctgaacaggatgggagatgtgaccccagagggcacctacgtgagccccttcaaggatgtgcggcagagatttggagccagcctgggcagcctgagcagcggccgggtgtccatcgtgtccctggccatcctgaacctgaagctggccgtggccatcgccctgcgcttcagcgccacccggcggcagtttggccccacagaggaggaggagatccctgtgctggagtaccccatgcagcagtggaggctgctgccctacctggccgctgtgtatgccctggaccacttcagcaagagcctcttcctggacctggtggagctgcagaggggcctggccagcggggacagaagtgcccggcaggccgagctgggccgggagatccacgccctggccagcgccagcaagcccctggcctcctggaccacccagcagggcatccaggagtgccgggaggcctgtggcggccacggctacctggccatgaaccggctgggcgtgctgagagatgacaatgaccccaactgcacctatgaaggagacaacaacatcctgctgcagcagaccagcaactacctgctgggcctgctggcccaccaggtgcatgatggagcctgcttccgcagccccctgaagtctgtggacttcctggatgcctacccaggcatcctggaccagaagtttgaggtgtcctctgtggccgactgcctggacagcgctgtggccctggccgcctacaagtggctggtgtgctacctgctgcgggagacctaccagaagctgaaccaggagaagaggagcggcagcagtgactttgaggccaggaacaagtgccaggtgagccacggccggcccctggccctggcctttgtggagctgactgtggtgcagcgcttccacgagcacgtgcaccagcccagcgtgccccccagcctgcgggctgtgctgggccgcctgagcgccctgtatgccctgtggagcctgagcagacatgctgccctgctgtaccggggcggctacttcagcggggagcaggccggggaggtgctggagagcgctgtgctggccctgtgcagccagctgaaggatgatgctgtggccctggtggatgtgattgcccccccagactttgtgctggacagccccatcggccgggcagatggagagctgtacaagaacctgtggggcgctgtgctgcaggagagcaaggtgctggagcgggcctcctggtggccagagttctctgtgaacaagcctgtgattggcagcctgaagagcaagctgtag

SEQ ID NO: 142474 - DNA, 1875 bp, Artificial Sequence
  Description of Artificial Sequence: Synthetic coding sequence
atggccagcacagtggagggcggggacacagccctgctgcctgagttcccccggggccccctggatgcctaccgggcccgggccagcttctcctggaaggagctggccctcttcacagaaggagagggcatgctgcgcttcaagaagaccatcttcagcgccctggagaatgaccccctgtttgcccggagccctggagctgacctgagcctggagaagtaccgggagctgaacttcctgcgctgcaagaggatctttgaatatgacttcctgtctgtggaggacatgttcaagagccccctgaaggtgcctgccctgatccagtgcctgggcatgtatgacagcagcctggccgccaagtacctgctgcacagcctggtgtttggcagcgctgtgtacagcagcggcagcgagcggcacctgacctacatccagaagatcttcaggatggagatcttcggctgctttgccctgacagagctgagccacggcagcaacaccaaggccatccgcaccacagcccactatgaccctgccacagaggagttcatcatccacagcccagactttgaggccgccaagttctgggtgggcaacatgggcaagacagccacccatgctgtggtgtttgccaagctgtgtgtgcctggggaccagtgccacggcctgcaccccttcatcgtgcagatccgggaccccaagaccctgctgcccatgcctggggtgatggtgggggacatcggcaagaagctgggccagaatggcctggacaatggatttgccatgttccacaaggtgcgggtgccccggcagagcctgctgaacaggatgggagatgtgaccccagagggcacctacgtgagccccttcaaggatgtgcggcagagatttggagccagcctgggcagcctgagcagcggccgggtgtccatcgtgtccctggccatcctgaacctgaagctggccgtggccatcgccctgcgcttcagcgccacccggcggcagtttggccccacagaggaggaggagatccctgtgctggagtaccccatgcagcagtggaggctgctgccctacctggccgctgtgtatgccctggaccacttcagcaagagcctcttcctggacctggtggagctgcagaggggcctggccagcggggacagaagtgcccggcaggccgagctgggccgggagatccacgccctggccagcgccagcaagcccctggcctcctggaccacccagcagggcatccaggagtgccgggaggcctgtggcggccacggctacctggccatgaaccggctgggcgtgctgagagatgacaatgaccccaactgcacctatgaaggagacaacaacatcctgctgcagcagaccagcaactacctgctgggcctgctggcccaccaggtgcatgatggagcctgcttccgcagccccctgaagtctgtggacttcctggatgcctacccaggcatcctggaccagaagtttgaggtgtcctctgtggccgactgcctggacagcgctgtggccctggccgcctacaagtggctggtgtgctacctgctgcgggagacctaccagaagctgaaccaggagaagaggagcggcagcagtgactttgaggccaggaacaagtgccaggtgagccacggccggcccctggccctggcctttgtggagctgactgtggtgcagcgcttccacgagcacgtgcaccagcccagcgtgccccccagcctgcgggctgtgctgggccgcctgagcgccctgtatgccctgtggagcctgagcagacatgctgccctgctgtacagagctgagcggcgctgcagctgccctggaagaagagacaggagcagctag

SEQ ID NO: 142475 - DNA, 2103 bp, Artificial Sequence; identical to SEQ ID NO: 142473
  Description of Artificial Sequence: Synthetic coding sequence

SEQ ID NO: 142476 - DNA, 2175 bp, Artificial Sequence
  Description of Artificial Sequence: Synthetic coding sequence
atgcccagaaattctggagctggctacggctgcccccatggagaccccagcatgctggacagccgggagaccccccaggagagccggcaggacatgattgtgaggaccacccaggagaagctgaagaccagcagcctgacagaccggcagcccctgagcaaggagagcctgaaccacgccctggagctgtctgtgcctgagaaggtgaacaatgcccagtgggatgcccctgaggaggccctgtggaccaccagggcagatggccgggtgcggctgagaattgaccccagctgcccccagctgccctacacagtgcacaggatgttttatgaggccctggacaagtacggggacctgattgccctgggcttcaagaggcaggacaagtgggagcacatctcctacagccagtactacctgctggccaggagagctgccaagggcttcctgaagctgggcctgaagcaggcccacagcgtggccatcctgggcttcaacagccctgagtggttcttctctgctgtgggcaccgtgtttgctgggggcatcgtgacaggcatctacaccaccagcagccctgaggcctgccagtacatcgcctatgactgctgtgccaacgtcatcatggtggacacccagaagcagctggagaagatcctgaagatctggaagcagctgccccacctgaaggctgtggtgatctacaaggagcccccacccaacaagatggccaacgtgtacaccatggaggagttcatggagctgggcaatgaggtgcctgaggaggccctggatgccatcatcgacacccagcagcccaaccagtgctgcgtgctggtgtacaccagcggcaccaccggcaaccccaagggcgtgatgctgagccaggacaacatcacctggacagcccgctatggcagccaggccggggacatccggcctgctgaggtgcagcaggaggtggtggtgtcctacctgcccctgagccacatcgccgcccagatctatgacctgtggacaggcatccagtggggcgcccaggtgtgctttgctgagccagatgccctgaagggcagcctggtgaacaccctgcgggaggtggagcccaccagccacatgggcgtgccccgggtgtgggagaagatcatggagcgcatccaggaggtggccgcccagagcggcttcatccggaggaagatgctgctgtgggccatgtctgtgaccctggagcagaacctgacctgccccggcagtgacctgaagcccttcaccacccggctggccgactacctggtgctggccaaggtgcggcaggccctgggctttgccaagtgccagaagaacttctacggggccgcccccatgatggccgagacccagcacttcttcctgggcctgaacatccggctgtatgccggctacggcctgtctgagaccagcggcccccacttcatgagcagcccctacaactaccgcctgtacagcagcggcaagctggtgcccggctgccgggtgaagctggtgaaccaggatgctgagggcattggagagatctgcctgtggggccgcaccatcttcatgggctacctgaacatggaggacaagacctgtgaggccattgatgaggagggctggctgcacactggagatgctggccgcctggatgctgatggcttcctgtacatcaccggccgcctgaaggagctgatcatcacagctggaggagaaaatgtgccccctgtgcccatcgaggaggccgtgaagatggagctgcccatcatcagcaatgccatgctgattggagaccagaggaagttcctgtccatgctgctgaccctgaagtgcaccctggaccctgacaccagtgaccagacagacaacctgacagagcaggccatggagttctgccagagggtgggcagccgggccaccaccgtgtctgagatcatcgagaagaaggatgaggccgtgtaccaggccatcgaggagggcatccggcgggtgaacatgaatgctgctgcccggccctaccacatccagaagtgggccatcctggagcgggacttcagcatcagcggcggggagctgggccccaccatgaagctgaagaggctgactgtgctggagaagtacaagggcatcatcgacagcttctaccaggagcagaagatgtag

SEQ ID NO: 142477 - DNA, 1449 bp, Artificial Sequence
  Description of Artificial Sequence: Synthetic coding sequence
atggccaacgtgtacaccatggaggagttcatggagctgggcaatgaggtgcctgaggaggccctggatgccatcatcgacacccagcagcccaaccagtgctgcgtgctggtgtacaccagcggcaccaccggcaaccccaagggcgtgatgctgagccaggacaacatcacctggacagcccgctatggcagccaggccggggacatccggcctgctgaggtgcagcaggaggtggtggtgtcctacctgcccctgagccacatcgccgcccagatctatgacctgtggacaggcatccagtggggcgcccaggtgtgctttgctgagccagatgccctgaagggcagcctggtgaacaccctgcgggaggtggagcccaccagccacatgggcgtgccccgggtgtgggagaagatcatggagcgcatccaggaggtggccgcccagagcggcttcatccggaggaagatgctgctgtgggccatgtctgtgaccctggagcagaacctgacctgccccggcagtgacctgaagcccttcaccacccggctggccgactacctggtgctggccaaggtgcggcaggccctgggctttgccaagtgccagaagaacttctacggggccgcccccatgatggccgagacccagcacttcttcctgggcctgaacatccggctgtatgccggctacggcctgtctgagaccagcggcccccacttcatgagcagcccctacaactaccgcctgtacagcagcggcaagctggtgcccggctgccgggtgaagctggtgaaccaggatgctgagggcattggagagatctgcctgtggggccgcaccatcttcatgggctacctgaacatggaggacaagacctgtgaggccattgatgaggagggctggctgcacactggagatgctggccgcctggatgctgatggcttcctgtacatcaccggccgcctgaaggagctgatcatcacagctggaggagaaaatgtgccccctgtgcccatcgaggaggccgtgaagatggagctgcccatcatcagcaatgccatgctgattggagaccagaggaagttcctgtccatgctgctgaccctgaagtgcaccctggaccctgacaccagtgaccagacagacaacctgacagagcaggccatggagttctgccagagggtgggcagccgggccaccaccgtgtctgagatcatcgagaagaaggatgaggccgtgtaccaggccatcgaggagggcatccggcgggtgaacatgaatgctgctgcccggccctaccacatccagaagtgggccatcctggagcgggacttcagcatcagcggcggggagctgggccccaccatgaagctgaagaggctgactgtgctggagaagtacaagggcatcatcgacagcttctaccaggagcagaagatgtag

SEQ ID NO: 142478 - DNA, 2001 bp, Artificial Sequence
  Description of Artificial Sequence: Synthetic coding sequence
atgacaggcacccccaagacccaggagggcgccaaggacctggaggtggacatgaacaagacagaggtgaccccccggctgtggaccacctgcagagatggagaggtgctgctgcggctgagcaagcacggccctggccacgagacccccatgaccatccctgagttcttccgggagagcgtgaaccgcttcggcacctacccagccctggccagcaagaatggcaagaagtgggagatcctgaacttcaaccagtactatgaggcctgcaggaaggccgccaagagcctcatcaagctgggcctggagcgcttccacggcgtgggcatcctgggcttcaacagcgctgagtggttcatcacagctgtgggcgccatcctggccggcggcctgtgtgtgggcatctatgccaccaacagcgctgaggtgtgccagtatgtgatcacccacgccaaggtgaacatcctgctggtggagaatgaccagcagctgcagaagatcctgagcatcccccagagcagcctggagcccctgaaggccatcatccagtaccgcctgcccatgaagaagaacaacaacctgtacagctgggatgacttcatggagctgggccgcagcatcccagacacccagctggagcaggtgattgagagccagaaggccaaccagtgtgctgtgctgatctacaccagcggcaccaccggcatccccaagggcgtgatgctgagccatgacaacatcacctggattgctggagctgtgaccaaggacttcaagctgacagacaagcatgagaccgtggtgtcctacctgcccctgagccacatcgccgcccagatgatggacatctgggtgcccatcaagattggagccctgacctactttgcccaggctgatgccctgaagggcaccctggtgtccaccctgaaggaggtgaagcccaccgtcttcatcggcgtgccccagatctgggagaagatccacgagatggtgaagaagaacagcgccaagtccatgggcctgaagaagaaggcctttgtgtgggccaggaacatcggcttcaaggtgaacagcaagaagatgctgggcaagtacaacacccctgtgtcctacaggatggccaagaccctggtgttcagcaaggtgaagaccagcctgggcctggaccactgccacagcttcatcagcggcacagcccccctgaaccaggagacagctgagttcttcctgagcctggacatccccatcggggagctgtatggcctgtctgagagcagcggcccccacaccatcagcaaccagaacaactaccgcctgctgagctgtgggaagatcctgaccggctgcaagaacatgctgttccagcagaacaaggatggcattggagagatctgcctgtggggccgccacatcttcatgggctacctggagagcgagacagagaccacagaggccattgatgatgagggctggctgcacagcggggacctgggccagctggatggcctgggcttcctgtatgtgacaggccacatcaaggagatcctgatcacagctggaggagaaaatgtgccccccatccctgtggagaccctggtgaagaagaagatccccatcatcagcaatgccatgctggtgggggacaagctgaagttcctgtccatgctgctgaccctgaagtgtgagatgaaccagatgtctggagagcccctggacaagctgaactttgaggccatcaacttctgccggggcctgggcagccaggccagcacagtgacagaaattgtgaagcagcaggaccccctggtgtacaaggccatccagcagggcatcaatgctgtgaaccaggaggccatgaacaatgcccagagaattgagaagtgggtgatcctggagaaggacttcagcatctacggcggggagctgggccccatgatgaagctgaagaggcactttgtggcccagaagtacaagaagcagattgaccacatgtaccactag

SEQ ID NO: 142479 - DNA, 1848 bp, Artificial Sequence
  Description of Artificial Sequence: Synthetic coding sequence
atggctgtgtatgtgggcatgctgcggctgggccgcctgtgtgccggcagcagcggcgtgctgggcgcccgggccgccctgagccgctcctggcaggaggcccggctgcagggcgtgcgcttcctgagcagccgggaggtggacaggatggtgtccacccccatcggcggcctgtcctatgtgcagggctgcaccaagaagcacctgaacagcaagacagtgggccagtgcctggagaccacagcccagagggtgcctgagcgggaggccctggtggtgctgcatgaagatgtgcggctgacctttgcccagctgaaggaggaggtggacaaggccgccagcggcctgctgagcatcggcctgtgcaagggggaccggctgggcatgtggggccccaacagctatgcctgggtgctgatgcagctggccacagcccaggccggcatcatcctggtgtctgtgaacccagcctaccaggccatggagctggagtatgtgctgaagaaggtgggctgcaaggccctggtgttccccaagcagttcaagacccagcagtactacaacgtgctgaagcagatctgcccagaggtggagaatgcccagcccggggccctgaagagccagaggctgcctgacctgaccaccgtcatctctgtggatgcccccctgcccggcaccctgctgctggatgaggtggtggccgccggcagcacccggcagcacctggaccagctgcagtacaaccagcagttcctgagctgccacgaccccatcaacatccagttcaccagcggcaccaccggcagccccaagggggccaccctgagccactacaacatcgtgaacaacagcaacatcctgggggagcggctgaagctgcacgagaagaccccagagcagctgaggatgatcctgcccaaccccctgtaccactgcctgggctctgtggccggcaccatgatgtgcctgatgtatggagccaccctcatcctggccagccccatcttcaacgggaagaaggccctggaggccatcagccgggagcggggcaccttcctgtatggcacccccaccatgtttgtggacatcctgaaccagcctgacttcagcagctatgacatcagcaccatgtgtggcggcgtgattgctggcagccctgcccctcctgagctgatccgggccatcatcaacaagatcaacatgaaggacctggtggtggcctacggcaccacagagaacagccctgtgacctttgcccacttcccagaagatactgtggagcagaaggccgagagcgtgggccgcatcatgccccacacagaggcccgcatcatgaacatggaggccggcaccctggccaagctgaacaccccaggagagctgtgcatccggggctactgtgtgatgctgggctactggggcgagccccagaagacagaggaggccgtggaccaggacaagtggtactggacaggagatgtggccaccatgaatgagcagggcttctgcaagatcgtgggccgcagcaaggacatgatcatccggggcggggagaacatctacccagctgagctggaggacttcttccacacccaccccaaggtgcaggaggtgcaggtggtgggcgtgaaggatgacaggatgggagaggagatctgtgcctgcatccggctgaaggatggagaggagaccaccgtggaggagatcaaggccttctgcaagggcaagatcagccacttcaagatccccaagtacatcgtgtttgtgaccaactaccccctgaccatcagcggcaagatccagaagttcaagctgcgggagcagatggagcggcacctgaacctgtag

SEQ ID NO: 142480 - DNA, 1923 bp, Artificial Sequence
  Description of Artificial Sequence: Synthetic coding sequence
atggctgtgtatgtgggcatgctgcggctgggccgcctgtgtgccggcagcagcggcgtgctgggcgcccgggccgccctgagccgctcctggcaggaggcccggctgcagggcgtgcgcttcctgagcgcccggggcggcatggaggccggccggcagaggatctctgtgcccagcagcttcaccgccagcgctgctgcccacagccgggaggtggacaggatggtgtccacccccatcggcggcctgtcctatgtgcagggctgcaccaagaagcacctgaacagcaagacagtgggccagtgcctggagaccacagcccagagggtgcctgagcgggaggccctggtggtgctgcatgaagatgtgcggctgacctttgcccagctgaaggaggaggtggacaaggccgccagcggcctgctgagcatcggcctgtgcaagggggaccggctgggcatgtggggccccaacagctatgcctgggtgctgatgcagctggccacagcccaggccggcatcatcctggtgtctgtgaacccagcctaccaggccatggagctggagtatgtgctgaagaaggtgggctgcaaggccctggtgttccccaagcagttcaagacccagcagtactacaacgtgctgaagcagatctgcccagaggtggagaatgcccagcccggggccctgaagagccagaggctgcctgacctgaccaccgtcatctctgtggatgcccccctgcccggcaccctgctgctggatgaggtggtggccgccggcagcacccggcagcacctggaccagctgcagtacaaccagcagttcctgagctgccacgaccccatcaacatccagttcaccagcggcaccaccggcagccccaagggggccaccctgagccactacaacatcgtgaacaacagcaacatcctgggggagcggctgaagctgcacgagaagaccccagagcagctgaggatgatcctgcccaaccccctgtaccactgcctgggctctgtggccggcaccatgatgtgcctgatgtacggggccaccctcatcctggccagccccatcttcaacgggaagaaggccctggaggccatcagccgggagcggggcaccttcctgtatggcacccccaccatgtttgtggacatcctgaaccagcctgacttcagcagctatgacatcagcaccatgtgtggcggcgtgattgctggcagccctgcccctcctgagctgatccgggccatcatcaacaagatcaacatgaaggacctggtggtggcctacggcaccacagagaacagccctgtgacctttgcccacttccctgaggacacagtggagcagaaggccgagagcgtgggccgcatcatgccccacacagaggcccgcatcatgaacatggaggccggcaccctggccaagctgaacaccccaggagagctgtgcatccggggctactgtgtgatgctgggctactggggcgagccccagaagacagaggaggccgtggaccaggacaagtggtactggacaggagatgtggccaccatgaatgagcagggcttctgcaagatcgtgggccgcagcaaggacatgatcatcagaggaggagagaacatctacccagctgagctggaggacttcttccacacccaccccaaggtgcaggaggtgcaggtggtgggcgtgaaggatgacaggatgggagaggagatctgtgcctgcatccggctgaaggatggagaggagaccaccgtggaggagatcaaggccttctgcaagggcaagatcagccacttcaagatccccaagtacatcgtgtttgtgaccaactaccccctgaccatcagcggcaagatccagaagttcaagctgcgggagcagatggagcggcacctgaacctgtag

SEQ ID NO: 142481 - DNA, 1809 bp, Artificial Sequence
  Description of Artificial Sequence: Synthetic coding sequence
atggctgtgtatgtgggcatgctgcggctgggccgcctgtgtgccggcagcagcggcgtgctgggcgcccgggccgccctgagccgctcctggcaggaggcccggctgcagggcgtgcgcttcctgagcagccgggaggtggacaggatggtgtccacccccatcggcggcctgtcctatgtgcagggctgcaccaagaagcacctgaacagcaagacagtgggccagtgcctggagaccacagcccagagggtgcctgagcgggaggccctggtggtgctgcatgaagatgtgcggctgacctttgcccagctgaaggaggaggtggacaaggccgccagcggcctgctgagcatcggcctgtgcaagggggaccggctgggcatgtggggccccaacagctatgcctgggtgctgatgcagctggccacagcccaggccatggagctggagtatgtgctgaagaaggtgggctgcaaggccctggtgttccccaagcagttcaagacccagcagtactacaacgtgctgaagcagatctgcccagaggtggagaatgcccagcccggggccctgaagagccagaggctgcctgacctgaccaccgtcatctctgtggatgcccccctgcccggcaccctgctgctggatgaggtggtggccgccggcagcacccggcagcacctggaccagctgcagtacaaccagcagttcctgagctgccacgaccccatcaacatccagttcaccagcggcaccaccggcagccccaagggggccaccctgagccactacaacatcgtgaacaacagcaacatcctgggggagcggctgaagctgcacgagaagaccccagagcagctgaggatgatcctgcccaaccccctgtaccactgcctgggctctgtggccggcaccatgatgtgcctgatgtacggggccaccctcatcctggccagccccatcttcaacgggaagaaggccctggaggccatcagccgggagcggggcaccttcctgtatggcacccccaccatgtttgtggacatcctgaaccagcctgacttcagcagctatgacatcagcaccatgtgtggcggcgtgattgctggcagccctgcccctcctgagctgatccgggccatcatcaacaagatcaacatgaaggacctggtggtggcctacggcaccacagagaacagccctgtgacctttgcccacttccctgaggacacagtggagcagaaggccgagagcgtgggccgcatcatgccccacacagaggcccgcatcatgaacatggaggccggcaccctggccaagctgaacaccccaggagagctgtgcatccggggctactgtgtgatgctgggctactggggcgagccccagaagacagaggaggccgtggaccaggacaagtggtactggacaggagatgtggccaccatgaatgagcagggcttctgcaagatcgtgggccgcagcaaggacatgatcatcagaggaggagagaacatctacccagctgagctggaggacttcttccacacccaccccaaggtgcaggaggtgcaggtggtgggcgtgaaggatgacaggatgggagaggagatctgtgcctgcatccggctgaaggatggagaggagaccaccgtggaggagatcaaggccttctgcaagggcaagatcagccacttcaagatccccaagtacatcgtgtttgtgaccaactaccccctgaccatcagcggcaagatccagaagttcaagctgcgggagcagatggagcggcacctgaacctgtag

SEQ ID NO: 142482 - DNA, 1719 bp, Artificial Sequence
  Description of Artificial Sequence: Synthetic coding sequence
atggctgtgtatgtgggcatgctgcggctgggccgcctgtgtgccggcagcagcggcgtgctgggcgcccgggccgccctgagccgctcctggcaggaggcccggctgcagggcgtgcgcttcctgagcagccgggaggtggacaggatggtgtccacccccatcggcggcctgtcctatgtgcagggctgcaccaagaagcacctgaacagcaagacagtgggccagtgcctggagaccacagcccagagggtgcctgagcgggaggccctggtggtgctgcatgaagatgtgcggctgacctttgcccagctgaaggaggaggtgtctgtgaacccagcctaccaggccatggagctggagtatgtgctgaagaaggtgggctgcaaggccctggtgttccccaagcagttcaagacccagcagtactacaacgtgctgaagcagatctgcccagaggtggagaatgcccagcccggggccctgaagagccagaggctgcctgacctgaccaccgtcatctctgtggatgcccccctgcccggcaccctgctgctggatgaggtggtggccgccggcagcacccggcagcacctggaccagctgcagtacaaccagcagttcctgagctgccacgaccccatcaacatccagttcaccagcggcaccaccggcagccccaagggggccaccctgagccactacaacatcgtgaacaacagcaacatcctgggggagcggctgaagctgcacgagaagaccccagagcagctgaggatgatcctgcccaaccccctgtaccactgcctgggctctgtggccggcaccatgatgtgcctgatgtacggggccaccctcatcctggccagccccatcttcaacgggaagaaggccctggaggccatcagccgggagcggggcaccttcctgtatggcacccccaccatgtttgtggacatcctgaaccagcctgacttcagcagctatgacatcagcaccatgtgtggcggcgtgattgctggcagccctgcccctcctgagctgatccgggccatcatcaacaagatcaacatgaaggacctggtggtggcctacggcaccacagagaacagccctgtgacctttgcccacttccctgaggacacagtggagcagaaggccgagagcgtgggccgcatcatgccccacacagaggcccgcatcatgaacatggaggccggcaccctggccaagctgaacaccccaggagagctgtgcatccggggctactgtgtgatgctgggctactggggcgagccccagaagacagaggaggccgtggaccaggacaagtggtactggacaggagatgtggccaccatgaatgagcagggcttctgcaagatcgtgggccgcagcaaggacatgatcatcagaggaggagagaacatctacccagctgagctggaggacttcttccacacccaccccaaggtgcaggaggtgcaggtggtgggcgtgaaggatgacaggatgggagaggagatctgtgcctgcatccggctgaaggatggagaggagaccaccgtggaggagatcaaggccttctgcaagggcaagatcagccacttcaagatccccaagtacatcgtgtttgtgaccaactaccccctgaccatcagcggcaagatccagaagttcaagctgcgggagcagatggagcggcacctgaacctgtag

SEQ ID NO: 142483 - DNA, 1368 bp, Artificial Sequence
  Description of Artificial Sequence: Synthetic coding sequence
atggagctggagtatgtgctgaagaaggtgggctgcaaggccctggtgttccccaagcagttcaagacccagcagtactacaacgtgctgaagcagatctgcccagaggtggagaatgcccagcccggggccctgaagagccagaggctgcctgacctgaccaccgtcatctctgtggatgcccccctgcccggcaccctgctgctggatgaggtggtggccgccggcagcacccggcagcacctggaccagctgcagtacaaccagcagttcctgagctgccacgaccccatcaacatccagttcaccagcggcaccaccggcagccccaagggggccaccctgagccactacaacatcgtgaacaacagcaacatcctgggggagcggctgaagctgcacgagaagaccccagagcagctgaggatgatcctgcccaaccccctgtaccactgcctgggctctgtggccggcaccatgatgtgcctgatgtatggagccaccctcatcctggccagccccatcttcaacgggaagaaggccctggaggccatcagccgggagcggggcaccttcctgtatggcacccccaccatgtttgtggacatcctgaaccagcctgacttcagcagctatgacatcagcaccatgtgtggcggcgtgattgctggcagccctgcccctcctgagctgatccgggccatcatcaacaagatcaacatgaaggacctggtggtggcctacggcaccacagagaacagccctgtgacctttgcccacttcccagaagatactgtggagcagaaggccgagagcgtgggccgcatcatgccccacacagaggcccgcatcatgaacatggaggccggcaccctggccaagctgaacaccccaggagagctgtgcatccggggctactgtgtgatgctgggctactggggcgagccccagaagacagaggaggccgtggaccaggacaagtggtactggacaggagatgtggccaccatgaatgagcagggcttctgcaagatcgtgggccgcagcaaggacatgatcatccggggcggggagaacatctacccagctgagctggaggacttcttccacacccaccccaaggtgcaggaggtgcaggtggtgggcgtgaaggatgacaggatgggagaggagatctgtgcctgcatccggctgaaggatggagaggagaccaccgtggaggagatcaaggccttctgcaagggcaagatcagccacttcaagatccccaagtacatcgtgtttgtgaccaactaccccctgaccatcagcggcaagatccagaagttcaagctgcgggagcagatggagcggcacctgaacctgtag

SEQ ID NO: 142484 - DNA, 1731 bp, Artificial Sequence
  Description of Artificial Sequence: Synthetic coding sequence
atgctgccccacgtggtgctgaccttccggcggctgggctgtgccctggccagctgccgcctggccccagcccggcaccggggcagcggcctgctgcacacagcccctgtggcccggagtgacagaagtgcccctgtgttcacccgggccctggcctttggagacagaattgccctggtggaccagcacggccgccacacctaccgggagctgtacagccgcagcctgcggctgagccaggagatctgccgcctgtgtggctgtgtgggcggggacctgcgggaggagcgggtgtccttcctgtgtgccaatgatgccagctatgtggtggcccagtgggcctcctggatgtctgggggcgtggccgtgcccctgtacaggaagcaccctgctgcccagctggagtatgtgatctgtgacagccagagctctgtggtgctggccagccaggagtacctggagctgctgagccctgtggtgaggaagctgggcgtgcccctgctgcccctgaccccagccatctacaccggggctgtggaggagcctgctgaggtgcctgtgcctgagcagggctggagaaataaaggagccatgatcatctacaccagcggcaccaccggccggcccaagggcgtgctgagcacccaccagaacatccgggctgtggtgacaggcctggtgcacaagtgggcctggaccaaggatgatgtgatcctgcacgtgctgcccctgcaccacgtgcacggcgtggtgaatgccctgctgtgccccctgtgggtgggcgccacctgtgtgatgatgcctgagttcagcccccagcaggtgtgggagaagttcctgagcagcgagaccccccgcatcaacgtgttcatggctgtgcccaccatctacaccaagctgatggagtactatgacagacacttcacccagccccacgcccaggacttcctgcgggctgtgtgtgaggagaagatccggctgatggtgtctggcagcgctgccctgcccctgcctgtgctggagaagtggaagaacatcaccggccacaccctgctggagagatatggcatgacagagatcggcatggccctgagcggccccctgaccacagctgtgcggctgcccggctctgtgggcacccccctgcccggggtgcaggtgagaattgtgtctgagaacccccagcgggaggcctgcagctacaccatccatgctgaaggagatgagcggggcaccaaggtgaccccaggctttgaggagaaggagggggagctgctggtgcggggccccagcgtcttccgggagtactggaacaagccagaggagaccaagagcgccttcaccctggatggctggttcaagacaggagacacagtggtgttcaaggatggccagtactggatccggggccgcacctctgtggacatcatcaagacaggaggctacaaggtgtctgccctggaggtggagtggcacctgctggcccaccccagcatcacagatgtggccgtgattggagtgcctgacatgacctggggccagagggtgacagctgtggtgaccctgcgggagggccacagcctgagccaccgggagctgaaggagtgggccagaaatgtgctggccccctatgctgtgcccagcgagctggtgctggtggaggagatccccaggaaccagatgggcaagattgacaagaaggccctgatccgccacttccaccccagctag

SEQ ID NO: 142485 - DNA, 1731 bp, Artificial Sequence; identical to SEQ ID NO: 142484
  Description of Artificial Sequence: Synthetic coding sequence

SEQ ID NO: 142486 - DNA, 714 bp, Artificial Sequence
  Description of Artificial Sequence: Synthetic coding sequence
atgctgccccacgtggtgctgaccttccggcggctgggctgtgccctggccagctgccgcctggccccagcccggcaccggggcagcggcctgctgcacacagcccctgtggcccggagtgacagaagtgcccctgtgttcacccgggccctggcctttggagacagaattgccctggtggaccagcacggccgccacacctaccgggagctgtacagccgcagcctgcggctgagccaggagatctgccgcctgtgtggctgtgtgggcggggacctgcgggaggagcgggtgtccttcctgtgtgccaatgatgccagctatgtggtggcccagtgggcctcctggatgtctgggggcgtggccgtgcccctgtacaggaagcaccctgctgcccagctggagtatgtgatctgtgacagccagagctctgtggtgctggccagccaggagtacctggagctgctgagccctgtggtgaggaagctgggcgtgcccctgctgcccctgaccccagccatctacaccggggctgtggaggagcctgctgaggtgcctgtgcctgagcagggctggagaaataaaggagccatgatcatctacaccagcggcaccaccggccggcccaagggcgtgctgagcacccaccagaacatccgggctgtggtgacaggcctggtgcacaagtgggcctggaccaaggatgatgtgtag

SEQ ID NO: 142487 - DNA, 2097 bp, Artificial Sequence
  Description of Artificial Sequence: Synthetic coding sequence
atgcaggcccacgagctgttccgctacttcaggatgcctgagctggtggacttccggcagtatgtgaggaccctgcccaccaacaccctgatgggctttggagcctttgctgccctgaccaccttctggtacgccacccggcccaagcccctgaagccaccctgtgacctgtccatgcagagcgtggaggtggccggcagcggcggggccaggagaagtgccctgctggacagtgatgagcccctggtgtacttctatgatgatgtgaccaccctgtatgagggcttccagaggggcatccaggtgagcaacaacggcccctgcctgggcagcaggaagccagaccagccctatgagtggctgagctacaagcaggtggccgagctgtctgaatgtattggcagcgccctgatccagaagggcttcaagacagccccagaccagttcatcggcatctttgcccagaacagacctgagtgggtgatcatcgagcagggctgctttgcctacagcatggtgattgtgcccctgtatgacaccctgggcaatgaggccatcacctacatcgtgaacaaggccgagctgagcctggtgtttgtggacaagccagagaaggccaagctgctgctggagggcgtggagaacaagctgatccctggcctgaagatcatcgtggtgatggatgcctacggcagcgagctggtggagcggggccagagatgtggggtggaggtgacctccatgaaggccatggaggacctgggccgggccaacagaaggaagcccaagcccccagcccctgaggacctggccgtcatctgcttcaccagcggcaccaccggcaaccccaagggggccatggtgacccacagaaatattgtgtctgactgcagcgcctttgtgaaggccacagaaaatacagtgaacccctgcccagatgacaccctcatctccttcctgcccctggcccacatgtttgagcgggtggtggagtgtgtgatgctgtgccacggggccaagattggcttcttccagggcgacatccggctgctgatggatgacctgaaggtgctgcagcccaccgtcttccctgtggtgccccggctgctgaacaggatgtttgaccgcatcttcggccaggccaacaccaccctgaagcgctggctgctggactttgccagcaagaggaaggaggccgagctgcggagcggcatcatccggaacaacagcctgtgggacaggctcatcttccacaaggtgcagagcagcctgggcggccgggtgcggctgatggtgactggagctgcccctgtgtctgccaccgtgctgaccttcctgcgggccgccctgggctgccagttctatgagggctacggccagacagagtgcacagctggctgctgcctgaccatgcctggggactggacagctggccacgtgggcgcccccatgccctgcaacctgatcaagctggtggatgtggaggagatgaactacatggctgctgagggggagggggaggtgtgtgtgaagggccccaacgtgttccagggctacctgaaggaccctgccaagacagctgaggccctggacaaggatggctggctgcacactggagacatcggcaagtggctgcccaacggcaccctgaagatcatcgacaggaagaagcacatcttcaagctggcccagggcgagtacatcgcccctgagaagattgagaacatctacatgaggtctgagcctgtggcccaggtgtttgtgcatggagagagcctgcaggccttcctgattgccatcgtggtgcctgatgtggagaccctgtgctcctgggcccagaagaggggctttgagggcagctttgaggagctgtgcaggaacaaggatgtgaagaaggccatcctggaggacatggtgcggctgggcaaggacagcggcctgaagccctttgagcaggtgaagggcatcaccctgcaccctgagctgttcagcattgacaatggcctgctgacccccaccatgaaggccaagaggcctgagctgaggaactacttccgcagccagattgatgacctgtacagcaccatcaaggtgtag

SEQ ID NO: 142488 - DNA, 1584 bp, Artificial Sequence
  Description of Artificial Sequence: Synthetic coding sequence
atggtgattgtgcccctgtatgacaccctgggcaatgaggccatcacctacatcgtgaacaaggccgagctgagcctggtgtttgtggacaagccagagaaggccaagctgctgctggagggcgtggagaacaagctgatccctggcctgaagatcatcgtggtgatggatgcctacggcagcgagctggtggagcggggccagagatgtggggtggaggtgacctccatgaaggccatggaggacctgggccgggccaacagaaggaagcccaagcccccagcccctgaggacctggccgtcatctgcttcaccagcggcaccactggaaaccccaagggggccatggtgacccacaggaacatcgtgtctgactgcagcgcctttgtgaaggccacagagaacacagtgaacccctgcccagatgacaccctcatctccttcctgcccctggcccacatgtttgagcgggtggtggagtgtgtgatgctgtgccacggggccaagattggcttcttccagggcgacatccggctgctgatggatgacctgaaggtgctgcagcccaccgtcttccctgtggtgccccggctgctgaacaggatgtttgaccgcatcttcggccaggccaacaccaccctgaagcgctggctgctggactttgccagcaagaggaaggaggccgagctgcggagcggcatcatccggaacaacagcctgtgggacaggctcatcttccacaaggtgcagagcagcctgggcggccgggtgcggctgatggtgactggagctgcccctgtgtctgccaccgtgctgaccttcctgcgggccgccctgggctgccagttctatgagggctacggccagacagaatgtacagctggctgctgcctgaccatgcctggggactggacagctggccacgtgggcgcccccatgccctgcaacctgatcaagctggtggatgtggaggagatgaactacatggctgctgagggggagggggaggtgtgtgtgaagggccccaacgtgttccagggctacctgaaggaccctgccaagacagctgaggccctggacaaggatggctggctgcacactggagacatcggcaagtggctgcccaacggcaccctgaagatcatcgacaggaagaagcacatcttcaagctggcccagggcgagtacatcgcccctgagaagattgagaacatctacatgaggtctgagcctgtggcccaggtgtttgtgcacggggagagcctgcaggccttcctgattgccatcgtggtgcctgatgtggagaccctgtgctcctgggcccagaagaggggctttgagggcagctttgaggagctgtgcaggaacaaggatgtgaagaaggccatcctggaggacatggtgcggctgggcaaggacagcggcctgaagccctttgagcaggtgaagggcatcaccctgcaccctgagctgttcagcattgacaatggcctgctgacccccaccatgaaggccaagaggcctgagctgaggaactacttccgcagccagattgatgacctgtacagcaccatcaaggtgtag

SEQ ID NO: 142489 - DNA, 1584 bp, Artificial Sequence; identical to SEQ ID NO: 142488
  Description of Artificial Sequence: Synthetic coding sequence

SEQ ID NO: 142490 - DNA, 2097 bp, Artificial Sequence; identical to SEQ ID NO: 142487
  Description of Artificial Sequence: Synthetic coding sequence

SEQ ID NO: 142491 - DNA, 1995 bp, Artificial Sequence
  Description of Artificial Sequence: Synthetic coding sequence
atgcaggcccacgagctgttccgctacttcaggatgcctgagctggtggacttccggcagtatgtgaggaccctgcccaccaacaccctgatgggctttggagcctttgctgccctgaccaccttctggtacgccacccggcccaagcccctgaagccaccctgtgacctgtccatgcagagcgtggaggtggccggcagcggcggggccaggagaagtgccctgctggacagtgatgagcccctggtgtacttctatgatgatgtgaccaccctgtatgagggcttccagaggggcatccaggtgagcaacaacggcccctgcctgggcagcaggaagccagaccagccctatgagtggctgagctacaagcagtgggtgatcatcgagcagggctgctttgcctacagcatggtgattgtgcccctgtatgacaccctgggcaatgaggccatcacctacatcgtgaacaaggccgagctgagcctggtgtttgtggacaagccagagaaggccaagctgctgctggagggcgtggagaacaagctgatccctggcctgaagatcatcgtggtgatggatgcctacggcagcgagctggtggagcggggccagagatgtggggtggaggtgacctccatgaaggccatggaggacctgggccgggccaacagaaggaagcccaagcccccagcccctgaggacctggccgtcatctgcttcaccagcggcaccaccggcaaccccaagggggccatggtgacccacagaaatattgtgtctgactgcagcgcctttgtgaaggccacagaaaatacagtgaacccctgcccagatgacaccctcatctccttcctgcccctggcccacatgtttgagcgggtggtggagtgtgtgatgctgtgccacggggccaagattggcttcttccagggcgacatccggctgctgatggatgacctgaaggtgctgcagcccaccgtcttccctgtggtgccccggctgctgaacaggatgtttgaccgcatcttcggccaggccaacaccaccctgaagcgctggctgctggactttgccagcaagaggaaggaggccgagctgcggagcggcatcatccggaacaacagcctgtgggacaggctcatcttccacaaggtgcagagcagcctgggcggccgggtgcggctgatggtgactggagctgcccctgtgtctgccaccgtgctgaccttcctgcgggccgccctgggctgccagttctatgagggctacggccagacagagtgcacagctggctgctgcctgaccatgcctggggactggacagctggccacgtgggcgcccccatgccctgcaacctgatcaagctggtggatgtggaggagatgaactacatggctgctgagggggagggggaggtgtgtgtgaagggccccaacgtgttccagggctacctgaaggaccctgccaagacagctgaggccctggacaaggatggctggctgcacactggagacatcggcaagtggctgcccaacggcaccctgaagatcatcgacaggaagaagcacatcttcaagctggcccagggcgagtacatcgcccctgagaagattgagaacatctacatgaggtctgagcctgtggcccaggtgtttgtgcatggagagagcctgcaggccttcctgattgccatcgtggtgcctgatgtggagaccctgtgctcctgggcccagaagaggggctttgagggcagctttgaggagctgtgcaggaacaaggatgtgaagaaggccatcctggaggacatggtgcggctgggcaaggacagcggcctgaagccctttgagcaggtgaagggcatcaccctgcaccctgagctgttcagcattgacaatggcctgctgacccccaccatgaaggccaagaggcctgagctgaggaactacttccgcagccagattgatgacctgtacagcaccatcaaggtgtag

SEQ ID NO: 142492 - DNA, 2097 bp, Artificial Sequence; identical to SEQ ID NO: 142487
  Description of Artificial Sequence: Synthetic coding sequence

SEQ ID NO: 142493 - DNA, 2163 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagccggcaggagaagagcaaccgcatcaaggccaagcctgtgaacagcaagccagacagcgcctacagatctgtgaacagcctggatggcctggcctctgtgctgtacccaggctgtgacaccctggacaaggtgttcacctacgccaagaacaagttcaagaacaagaggctgctgggcacccgggaggtgctgaatgaggaggatgaggtgcagcccaacgggaagatcttcaagaaggtgatcctgggccagtacaactggctgtcctatgaagatgtgtttgtgcgggccttcaactttggaaatggcctgcagatgctgggccagaagcccaagaccaacatcgccatcttctgtgagaccagggctgagtggatgattgctgcccaggcctgcttcatgtacaacttccagctggtgaccctgtatgccaccctgggcggccctgccatcgtgcacgccctgaatgaaacagaggtgaccaacatcatcaccagcaaggagctgctgcagaccaagctgaaggacatcgtgtccctggtgccccggctgcggcacatcatcaccgtggatggcaagccacccacctggagcgagttccccaagggcatcatcgtgcacaccatggctgctgtggaggccctgggcgccaaggcctccatggagaaccagccccacagcaagcccctgcccagcgacattgctgtgatcatgtacaccagcggcagcacaggcctgcccaagggcgtgatgatcagccacagcaacatcatcgccggcatcaccggcatggccgagcgcatccctgagctgggggaggaggatgtgtacatcggctacctgcccctggcccacgtgctggagctgtctgctgagctggtgtgcctgagccacggctgcagaattggctacagcagcccccagaccctggccgaccagagcagcaagatcaagaagggcagcaaaggagacacctccatgctgaagcccaccctgatggctgctgtgcctgagatcatggaccgcatctacaagaatgtgatgaacaaggtgtctgagatgagcagcttccagaggaacctcttcatcctggcctacaactacaagatggagcagatcagcaagggcaggaacacccccctgtgtgacagctttgtgttcaggaaggtgcgcagcctgctgggcggcaacatccggctgctgctgtgtggcggggcccccctgagcgccaccacccagcgcttcatgaacatctgcttctgctgccctgtgggccagggctacggcctgacagagagcgctggagctggcaccatcagcgaggtgtgggactacaacacaggccgggtgggcgcccccctggtgtgctgtgagatcaagctgaagaactgggaggagggcggctacttcaacacagacaagccccaccccagaggagagatcctgattggaggccagagcgtgaccatgggctactacaagaatgaggccaagaccaaggctgacttctttgaagatgaaaatggccagcgctggctgtgcaccggggacattggagaatttgagccagatggctgcctgaagatcatcgacaggaagaaggacctggtgaagctgcaggccggggagtatgtgtccctgggcaaggtggaggccgccctgaagaacctgcccctggtggacaacatctgtgcctatgccaacagctaccacagctatgtgattggatttgtggtgcccaaccagaaggagctgacagagctggccaggaagaagggcctgaagggcacctgggaggagctgtgcaacagctgtgagatggagaatgaggtgctgaaggtgctgtctgaggccgccatcagcgccagcctggagaagtttgagatccctgtgaagatccggctgagccctgagccctggaccccagagaccggcctggtgacagatgccttcaagctgaagaggaaggagctgaagacccactaccaggccgacattgaaagaatgtatggcaggaagtag

SEQ ID NO: 142494 - DNA, 2163 bp, Artificial Sequence; identical to SEQ ID NO: 142493
  Description of Artificial Sequence: Synthetic coding sequence

SEQ ID NO: 142495 - DNA, 267 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagccggcaggagaagagcaaccgcatcaaggccaagcctgtgaacagcaagccagacagcgcctacagatctgtgaacagcctggatggcctggcctctgtgctgtacccaggctgtgacaccctgtag

SEQ ID NO: 142496 - DNA, 288 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagccggcaggagaagagcaaccgcatcaaggccaagcctgtgaacagcaagccagacagcgcctacagatctgtgaacagcctggatggcctggcctctgtgctgtacccaggctgtgacaccctggacaaggtgttcacctacgcctag

SEQ ID NO: 142497 - DNA, 2052 bp, Artificial Sequence
  Description of Artificial Sequence: Synthetic coding sequence
atgctgttcatcttcaacttcctgttcagccccctgcccaccccagccctgatctgcatcctgacctttggagctgccatcttcctgtggctgatcacccggccccagcctgtgctgcccctgctggacctgaacaaccagagcgtgggcattgaaggaggagccaggaaaggagtgtcccagaagaacaatgacctgaccagctgctgcttcagtgatgccaagaccatgtatgaggtgttccagaggggcctggccgtgtctgacaatggcccctgcctgggctacaggaagcccaaccagccctaccgctggctgagctacaagcaggtgtctgacagagctgagtacctgggcagctgcctgctgcacaagggctacaagagcagcccagaccagtttgtgggcatctttgcccagaacagacctgagtggatcatcagcgagctggcctgctacacctacagcatggtggccgtgcccctgtatgacaccctgggccctgaggccatcgtgcacatcgtgaacaaggctgacatcgccatggtgatctgtgacaccccccagaaggccctggtgctgattggaaatgtggagaagggcttcacccccagcctgaaggtgatcatcctgatggacccctttgatgatgacctgaagcagagaggagagaagagcggcatcgagatcctgagcctgtatgatgctgagaacctgggcaaggagcacttcaggaagcctgtgccccccagccctgaggacctgagcgtcatctgcttcaccagcggcaccactggagaccccaagggggccatgatcacccaccagaacatcgtgtccaatgctgctgccttcctgaagtgtgtggagcacgcctatgagcccaccccagatgatgtggccatctcctacctgcccctggcccacatgtttgagcgcatcgtgcaggccgtggtgtacagctgtggggcccgggtgggcttcttccagggcgacatccggctgctggctgatgacatgaagaccctgaagcccaccctcttccctgctgtgccccggctgctgaaccgcatctatgacaaggtgcagaatgaggccaagacccccctgaagaagttcctgctgaagctggccgtgagcagcaagttcaaggagctgcagaagggcatcatcagacatgacagcttctgggacaagctgatctttgccaagatccaggacagcctgggcggccgggtgcgggtcatcgtgactggagctgcccccatgagcacctctgtgatgaccttcttccgggccgccatgggctgccaggtgtatgaggcctacggccagacagaatgtactggaggctgcaccttcaccctgcccggggactggaccagcggccacgtgggcgtgcccctggcctgcaactacgtgaagctggaggatgtggccgacatgaactacttcaccgtgaacaatgaaggagaggtgtgcatcaagggcaccaacgtgttcaagggctacctgaaggaccctgagaagacccaggaggccctggacagtgatggctggctgcacactggagacatcggccgctggctgcccaacggcaccctgaagatcatcgacaggaagaagaacatcttcaagctggcccagggcgagtacatcgcccctgagaagattgagaacatctacaacagaagccagcctgtgctgcagatctttgtgcacggggagagcctgcggagcagcctggtgggcgtggtggtgcctgacacagatgtgctgcccagctttgctgccaagctgggcgtgaagggcagctttgaggagctgtgccagaaccaggtggtgcgggaggccatcctggaggacctgcagaagattggcaaggagagcggcctgaagacctttgagcaggtgaaggccatcttcctgcaccctgagcccttcagcattgaaaatggcctgctgacccccaccctgaaggccaagagaggagagctgagcaagtacttccgcacccagattgacagcctgtatgagcacatccaggactag

SEQ ID NO: 142498 - DNA, 2052 bp, Artificial Sequence; identical to SEQ ID NO: 142497
  Description of Artificial Sequence: Synthetic coding sequence

SEQ ID NO: 142499 - DNA, 2220 bp, Artificial Sequence
  Description of Artificial Sequence: Synthetic coding sequence
atggatgccctgaagccaccctgcctgtggagaaatcatgagcggggcaagaaggaccgggacagctgtggcaggaagaacagcgagcccggcagcccccacagcctggaggccctgagagatgctgcccccagccagggcctgaacttcctgctgctcttcaccaagatgctgttcatcttcaacttcctgttcagccccctgcccaccccagccctgatctgcatcctgacctttggagctgccatcttcctgtggctgatcacccggccccagcctgtgctgcccctgctggacctgaacaaccagagcgtgggcattgaaggaggagccaggaaaggagtgtcccagaagaacaatgacctgaccagctgctgcttcagtgatgccaagaccatgtatgaggtgttccagaggggcctggccgtgtctgacaatggcccctgcctgggctacaggaagcccaaccagccctaccgctggctgagctacaagcaggtgtctgacagagctgagtacctgggcagctgcctgctgcacaagggctacaagagcagcccagaccagtttgtgggcatctttgcccagaacagacctgagtggatcatcagcgagctggcctgctacacctacagcatggtggccgtgcccctgtatgacaccctgggccctgaggccatcgtgcacatcgtgaacaaggctgacatcgccatggtgatctgtgacaccccccagaaggccctggtgctgattggaaatgtggagaagggcttcacccccagcctgaaggtgatcatcctgatggacccctttgatgatgacctgaagcagagaggagagaagagcggcatcgagatcctgagcctgtatgatgctgagaacctgggcaaggagcacttcaggaagcctgtgccccccagccctgaggacctgagcgtcatctgcttcaccagcggcaccactggagaccccaagggggccatgatcacccaccagaacatcgtgtccaatgctgctgccttcctgaagtgtgtggagcacgcctatgagcccaccccagatgatgtggccatctcctacctgcccctggcccacatgtttgagcgcatcgtgcaggccgtggtgtacagctgtggggcccgggtgggcttcttccagggcgacatccggctgctggctgatgacatgaagaccctgaagcccaccctcttccctgctgtgccccggctgctgaaccgcatctatgacaaggtgcagaatgaggccaagacccccctgaagaagttcctgctgaagctggccgtgagcagcaagttcaaggagctgcagaagggcatcatcagacatgacagcttctgggacaagctgatctttgccaagatccaggacagcctgggcggccgggtgcgggtcatcgtgactggagctgcccccatgagcacctctgtgatgaccttcttccgggccgccatgggctgccaggtgtatgaggcctacggccagacagaatgtactggaggctgcaccttcaccctgcccggggactggaccagcggccacgtgggcgtgcccctggcctgcaactacgtgaagctggaggatgtggccgacatgaactacttcaccgtgaacaatgaaggagaggtgtgcatcaagggcaccaacgtgttcaagggctacctgaaggaccctgagaagacccaggaggccctggacagtgatggctggctgcacactggagacatcggccgctggctgcccaacggcaccctgaagatcatcgacaggaagaagaacatcttcaagctggcccagggcgagtacatcgcccctgagaagattgagaacatctacaacagaagccagcctgtgctgcagatctttgtgcacggggagagcctgcggagcagcctggtgggcgtggtggtgcctgacacagatgtgctgcccagctttgctgccaagctgggcgtgaagggcagctttgaggagctgtgccagaaccaggtggtgcgggaggccatcctggaggacctgcagaagattggcaaggagagcggcctgaagacctttgagcaggtgaaggccatcttcctgcaccctgagcccttcagcattgaaaatggcctgctgacccccaccctgaaggccaagagaggagagctgagcaagtacttccgcacccagattgacagcctgtatgagcacatccaggactag

SEQ ID NO: 142500 - DNA, 1398 bp, Artificial Sequence
  Description of Artificial Sequence: Synthetic coding sequence
atgctgtttcctggggccagcatcgtgcctgagtgctggctgctggtgctgatccagaacctgggcaaggagcacttcaggaagcctgtgccccccagccctgaggacctgagcgtcatctgcttcaccagcggcaccactggagaccccaagggggccatgatcacccaccagaacatcgtgtccaatgctgctgccttcctgaagtgtgtggagcacgcctatgagcccaccccagatgatgtggccatctcctacctgcccctggcccacatgtttgagcgcatcgtgcaggccgtggtgtacagctgtggggcccgggtgggcttcttccagggcgacatccggctgctggctgatgacatgaagaccctgaagcccaccctcttccctgctgtgccccggctgctgaaccgcatctatgacaaggtgcagaatgaggccaagacccccctgaagaagttcctgctgaagctggccgtgagcagcaagttcaaggagctgcagaagggcatcatcagacatgacagcttctgggacaagctgatctttgccaagatccaggacagcctgggcggccgggtgcgggtcatcgtgactggagctgcccccatgagcacctctgtgatgaccttcttccgggccgccatgggctgccaggtgtatgaggcctacggccagacagaatgtactggaggctgcaccttcaccctgcccggggactggaccagcggccacgtgggcgtgcccctggcctgcaactacgtgaagctggaggatgtggccgacatgaactacttcaccgtgaacaatgaaggagaggtgtgcatcaagggcaccaacgtgttcaagggctacctgaaggaccctgagaagacccaggaggccctggacagtgatggctggctgcacactggagacatcggccgctggctgcccaacggcaccctgaagatcatcgacaggaagaagaacatcttcaagctggcccagggcgagtacatcgcccctgagaagattgagaacatctacaacagaagccagcctgtgctgcagatctttgtgcacggggagagcctgcggagcagcctggtgggcgtggtggtgcctgacacagatgtgctgcccagctttgctgccaagctgggcgtgaagggcagctttgaggagctgtgccagaaccaggtggtgcgggaggccatcctggaggacctgcagaagattggcaaggagagcggcctgaagacctttgagcaggtgaaggccatcttcctgcaccctgagcccttcagcattgaaaatggcctgctgacccccaccctgaaggccaagagaggagagctgagcaagtacttccgcacccagattgacagcctgtatgagcacatccaggactag

SEQ ID NO: 142501 - DNA, 2052 bp, Artificial Sequence; identical to SEQ ID NO: 142497
  Description of Artificial Sequence: Synthetic coding sequence

SEQ ID NO: 142502 - DNA, 1980 bp, Artificial Sequence
  Description of Artificial Sequence: Synthetic coding sequence
atgctgttcatcttcaacttcctgttcagccccctgcccaccccagccctgatctgcatcctgacctttggagctgccatcttcctgtggctgatcacccggccccagcctgtgctgcccctgctggacctgaacaaccagagcgtgggcattgaaggaggagccaggaaaggagtgtcccagaagaacaatgacctgaccagctgctgcttcagtgatgccaagaccatgtatgaggtgttccagaggggcctggccgtgtctgacaatggcccctgcctgggctacaggaagcccaaccagccctaccgctggctgagctacaagcaggtgtctgacagagctgagtacctgggcagctgcctgctgcacaagggctacaagagcagcccagaccagtttgtgggcatctttgcccagaacagacctgagtggatcatcagcgagctggcctgctacacctacagcatggtggccgtgcccctgtatgacaccctgggccctgaggccatcgtgcacatcgtgaacaaggctgacatcgccatggtgatctgtgacaccccccagaaggccctggtgctgattggaaatgtggagaagggcttcacccccagcctgaaggtgatcatcctgatggacccctttgatgatgacctgaagcagagaggagagaagagcggcatcgagatcctgagcctgtatgatgctgagaacctgggcaaggagcacttcaggaagcctgtgccccccagccctgaggacctgagcgtcatctgcttcaccagcggcaccactggagaccccaagggggccatgatcacccaccagaacatcgtgtccaatgctgctgccttcctgaagtgtgtggagcacgcctatgagcccaccccagatgatgtggccatctcctacctgcccctggcccacatgtttgagcgcatcgtgcaggccgtggtgtacagctgtggggcccgggtgggcttcttccagggcgacatccggctgctggctgatgacatgaagaccctgaagcccaccctcttccctgctgtgccccggctgctgaaccgcatctatgacaaggtgcagaatgaggccaagacccccctgaagaagttcctgctgaagctggccgtgagcagcaagttcaaggagctgcagaagggcatcatcagacatgacagcttctgggacaagctgatctttgccaagatccaggacagcctgggcggccgggtgcgggtcatcgtgactggagctgcccccatgagcacctctgtgatgaccttcttccgggccgccatgggctgccaggtgtatgaggcctacggccagacagaatgtactggaggctgcaccttcaccctgcccggggactggaccagcggccacgtgggcgtgcccctggcctgcaactacgtgaagctggaggatgtggccgacatgaactacttcaccgtgaacaatgaaggagaggtgtgcatcaagggcaccaacgtgttcaagggctacctgaaggaccctgagaagacccaggaggccctggacagtgatggctggctgcacactggagacatcggccgctggctgcccaacggcaccctgaagatcatcgacaggaagaagaacatcttcaagctggcccagggcgagtacatcgcccctgagaagattgagaacatctacaacagaagccagcctgtgctgcagatctttgtgcacggggagagcctgcggagcagcctggtgggcgtggtggtgcctgacacagatgtgctgcccagctttgctgccaagctgggcgtgaagggcagctttgaggagctgtgccagaaccaggtgaaggccatcttcctgcaccctgagcccttcagcattgaaaatggcctgctgacccccaccctgaaggccaagagaggagagctgagcaagtacttccgcacccagattgacagcctgtatgagcacatccaggactag

SEQ ID NO: 142503 - DNA, 2169 bp, Artificial Sequence
  Description of Artificial Sequence: Synthetic coding sequence
atgctgaccttcttcctggtgtctgggggcagcctgtggctgtttgtggagtttgtgctgagcctgctggagaagatgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggcccggcgcagcgtcatcggcagcggcccccagctgctgacccactactatgatgatgcccggaccatgtaccaggtgttccggcggggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagagagccagtgggcccccacctgtgctgatgtgcacatctcctacctgcccctggcccacatgtttgagaggatggtgcagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142504 - DNA, 1869 bp, Artificial Sequence
  Description of Artificial Sequence: Synthetic coding sequence
atgcagacccaggagatcctgcgcatcctgcggctgcctgagctgggggacctgggccagttcttccgcagcctgagcgccaccaccctggacagcggcggggcccggcgcagcgtcatcggcagcggcccccagctgctgacccactactatgatgatgcccggaccatgtaccaggtgttccggcggggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagaaggagacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142505 - DNA, 2094 bp, Artificial Sequence
  Description of Artificial Sequence: Synthetic coding sequence
atgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggccaggagatctgtgattggcagcggcccccagctgctgacccactactatgatgatgcccggaccatgtaccaggtgttcagaagaggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcacagtgattgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccaccggcaaccccaagggggccatgctgacccacggcaatgtggtggccgacttcagcggcttcctgaaggtgacagagaaggtgatcttcccccggcaggatgatgtgctgatctccttcctgcccctggcccacatgtttgagagggtcatccagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagagtgcacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcatggagacagcctgaaggccttcctggtgggcatcgtggtgcctgaccctgaggtgatgcccagctgggcccagaagaggggcatcgagggcacctacgccgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142506 - DNA, 2094 bp, Artificial Sequence
  Description of Artificial Sequence: Synthetic coding sequence
atgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggccaggagatctgtgattggcagcggcccccagctgctgacccactactatgatgatgcccggaccatgtaccaggtgttcagaagaggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcacagtgattgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccaccggcaaccccaagggggccatgctgacccacggcaatgtggtggccgacttcagcggcttcctgaaggtgacagagagccagtgggcccccacctgtgctgatgtgcacatctcctacctgcccctggcccacatgtttgagaggatggtgcagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagagtgcacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcatggagacagcctgaaggccttcctggtgggcatcgtggtgcctgaccctgaggtgatgcccagctgggcccagaagaggggcatcgagggcacctacgccgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142507 - DNA, 2127 bp, Artificial Sequence
  Description of Artificial Sequence: Synthetic coding sequence
atgcctgagtttgtgctgagcctgctggagaagatgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggcccggcgcagcgtcatcggcagcggcccccagctgctgacccactactatgatgatgcccggaccatgtaccaggtgttccggcggggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagagaaggtgatcttcccccggcaggatgatgtgctgatctccttcctgcccctggcccacatgtttgagagggtcatccagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142508 - DNA, 2004 bp, Artificial Sequence
  Description of Artificial Sequence: Synthetic coding sequence
atgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggccaggagatctgtgattggcagcggcccccagctgctgacccactactatgatgatgcccggaccatgtaccaggtgttcagaagaggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcacagtgattgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccaccggcaaccccaagggggccatgctgacccacggcaatgtggtggccgacttcagcggcttcctgaaggtgacagagagccagtgggcccccacctgtgctgatgtgcacatctcctacctgcccctggcccacatgtttgagaggatggtgcagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagagtgcacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcatggagacagcctgaaggccttcctggtgggcatcgtggtgcctgaccctgaggtgatgcccagctgggcccagaagaggggcatcgagggcacctacgccgacctgtgcaccaacaaggacctgaagaaggccatcctggaggacatggtgcggctgggcaaggagagcggcctgcacagctttgagcaggacctgccccagtgcctgatccagatcaaggtgttcagcaagtactag

SEQ ID NO: 142509 - DNA, 2169 bp, Artificial Sequence
  Description of Artificial Sequence: Synthetic coding sequence
atgctgaccttcttcctggtgtctgggggcagcctgtggctgtttgtggagtttgtgctgagcctgctggagaagatgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggcccggcgcagcgtcatcggcagcggcccccagctgctgacccactactatgatgatgcccggaccatgtaccaggtgttccggcggggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagagaaggtgatcttcccccggcaggatgatgtgctgatctccttcctgcccctggcccacatgtttgagagggtcatccagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142510 - DNA, 2139 bp, Artificial Sequence
  Description of Artificial Sequence: Synthetic coding sequence
atgcagacccaggagatcctgcgcatcctgcggctgcctgagctgggggacctgggccagttcttccgcagcctgagcgccaccaccctggtgtccatgggcgccctggccgccatcctggcctactggttcacccaccggcccaaggccctgcagcccccctgcaacctgctgatgcagagcgaggaggtggaggacagcggcggggccaggagatctgtgattggcagcggcccccagctgctgacccactactatgatgatgcccggaccatgtaccaggtgttcagaagaggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacaggcctgagctgccaggagggcgccagcgccacagccagcacccaggccgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagagaaggtgatcttcccccggcaggatgatgtgctgatctccttcctgcccctggcccacatgtttgagagggtcatccagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142511 - DNA, 2094 bp, Artificial Sequence; identical to SEQ ID NO: 142506
  Description of Artificial Sequence: Synthetic coding sequence

SEQ ID NO: 142512 - DNA, 1821 bp, Artificial Sequence
  Description of Artificial Sequence: Synthetic coding sequence
atgtaccaggtgttccggcggggcctgagcatctctggaaatggcccctgcctgggcttcaggaagcccaagcagccctaccagtggctgagctaccaggaggtggccgacagagctgagttcctgggcagcggcctgctgcagcacaactgcaaggcctgcacagaccagttcatcggcgtgtttgcccagaacagacctgagtggatcatcgtggagctggcctgctacacctacagcatggtggtggtgcccctgtatgacaccctgggccctggggccatccgctacatcatcaacacagctgacatcagcaccgtcatcgtggacaagccccagaaggctgtgctgctgctggagcacgtggagaggaaggagaccccaggcctgaagctgatcatcctgatggacccctttgaggaggccctgaaggagcggggccagaagtgtggggtggtgatcaagtccatgcaggccgtggaggactgtggccaggagaaccaccaggcccctgtgcccccccagccagatgacctgagcatcgtgtgcttcaccagcggcaccactggaaaccccaagggggccatgctgacccatggaaatgtggtggccgacttcagcggcttcctgaaggtgacagagaaggtgatcttcccccggcaggatgatgtgctgatctccttcctgcccctggcccacatgtttgagagggtcatccagagcgtggtgtactgccacggcggccgggtgggcttcttccagggcgacatccggctgctgagtgatgacatgaaggccctgtgccccaccatcttccctgtggtgccccggctgctgaacaggatgtatgacaagatcttcagccaggccaacacccccctgaagcgctggctgctggagtttgctgccaagaggaagcaggccgaggtgcgcagcggcatcatcagaaatgacagcatctgggatgagctgttcttcaacaagatccaggccagcctgggcggctgtgtgaggatgattgtgactggagctgccccagccagccccaccgtgctgggcttcctgcgggccgccctgggctgccaggtgtatgagggctacggccagacagaatgtacagctggctgcaccttcaccacccctggggactggaccagcggccacgtgggcgcccccctgccctgcaaccacatcaagctggtggatgtggaggagctgaactactgggcctgcaagggggagggggagatctgtgtgcggggccccaacgtgttcaagggctacctgaaggaccctgacaggaccaaggaggccctggacagtgatggctggctgcacactggagacatcggcaagtggctgcctgctggcaccctgaagatcatcgacaggaagaagcacatcttcaagctggcccagggcgagtatgtggcccctgagaagattgagaacatctacatccgcagccagcctgtggcccagatctacgtgcacggggacagcctgaaggccttcctggtgggcatcgtggtgcctgaccctgaggtgatgcccagctgggcccagaagaggggcatcgagggcacctatgctgacctgtgcaccaacaaggacctgaagaaggccatcctggaggacatggtgcggctgggcaaggagagcggcctgcacagctttgagcaggtgaaggccatccacatccacagcgacatgttttctgtgcagaatggcctgctgacccccaccctgaaggccaagaggcctgagctgcgggagtacttcaagaagcagatcgaggagctgtacagcatctccatgtag

SEQ ID NO: 142513 - DNA, 1386 bp, Artificial Sequence
  Description of Artificial Sequence: Synthetic coding sequence
atgagccggcaggtggtgcgcagcagcaagttcagacatgtgtttggccagcctgccaaggctgaccagtgctatgaagatgtgcgggtgtcccagaccacctgggacagcggcttctgtgctgtgaaccccaagtttgtggccctgatctgtgaggccagcggcggcggggccttcctggtgctgcccctgggcaagacaggccgggtggacaagaatgcccccaccgtgtgtggccacacagcccctgtgctggacatcgcctggtgcccccacaatgacaacgtgattgccagcggcagcgaggactgcaccgtgatggtgtgggagatcccagatggcggcctgatgctgcccctgcgggagcctgtggtgaccctggagggccacaccaagagggtgggcatcgtggcctggcacaccacagcccagaatgtgctgctgtctgctggctgtgacaacgtcatcatggtgtgggatgtgggcactggagctgccatgctgaccctgggccctgaggtgcacccagacaccatctacagcgtggactggagcagagatggcggcctcatctgcaccagctgccgggacaagagggtgcgcatcatcgagcccaggaaaggaacagtggtggccgagaaggaccggccccatgagggcaccaggcctgtgcgggctgtgtttgtgtctgagggcaagatcctgaccaccggcttcagcaggatgtctgagcggcaggtggccctgtgggacaccaagcacctggaggagcccctgagcctgcaggagctggacaccagcagcggcgtgctgctgcccttctttgatcctgacaccaacatcgtgtacctgtgtgggaaaggagacagcagcatccgctactttgagatcaccagcgaggcccccttcctgcactacctgtccatgttcagcagcaaggagagccagaggggcatgggctacatgcccaagaggggcctggaggtgaacaagtgtgagatcgcccgcttctacaagctgcatgaaagaagatgtgagcccatcgccatgacagtgcccaggaagagtgacctcttccaggaggacctgtacccacccacagctggccctgaccctgccctgacagctgaggagtggctgggcggcagagatgctggccccctgctgatcagcctgaaggatggctacgtgccccccaagagccgggagctgcgggtgaacagaggcctggacaccggcagaagaagagctgcccctgaggccagcggcacccccagcagtgatgctgtgtcccggctggaggaggagatgaggaagctgcaggccaccgtgcaggagctgcagaagaggctggaccggctggaggagaccgtgcaggccaagtag

SEQ ID NO: 142514 - DNA, 1734 bp, Artificial Sequence
  Description of Artificial Sequence: Synthetic coding sequence
atgcagtggctgatgaggttccgcaccctgtggggcatccacaagagcttccacaacatccacccagcccccagccagctgcgctgccgcagcctgtctgaatttggagccccccgctggaatgactatgaggtgcctgaggagttcaactttgccagctatgtgctggactactgggcccagaaggagaaggagggcaagaggggccccaacccagccttctggtgggtgaatggccagggagatgaggtgaagtggagcttccgggagatgggagacctgacccggcgggtggccaacgtgttcacccagacctgtggcctgcagcagggcgaccacctggccctgatgctgccccgggtgcctgagtggtggctggtggccgtgggctgcatgaggacaggcatcatcttcatcccagccaccatcctgctgaaggccaaggacatcctgtaccgcctgcagctgagcaaggccaagggcatcgtgaccattgatgccctggccagcgaggtggacagcatcgccagccagtgccccagcctgaagaccaagctgctggtgtctgaccacagccgggagggctggctggacttccgcagcctggtgaagagcgccagccctgagcacacctgtgtgaagagcaagaccctggaccccatggtgatcttcttcaccagcggcaccaccggcttccccaagatggccaagcacagccacggcctggccctgcagcccagcttccctggcagcaggaagctgcggagcctgaagaccagtgatgtgtcctggtgcctgagtgacagcggctggatcgtggccaccatctggaccctggtggagccctggacagctggctgcaccgtcttcatccaccacctgccccagtttgacaccaaggtgatcatccagaccctgctgaagtaccccatcaaccacttctggggcgtgagcagcatctacaggatgatcctgcagcaggacttcaccagcatccgcttccctgccctggagcactgctacacaggaggagaggtggtgctgcccaaggaccaggaggagtggaagagaagaacaggcctgctgctgtatgaaaattatggccagagcgagaccggcctcatctgtgccacctactggggcatgaagatcaagccaggcttcatgggcaaggccaccccaccctatgatgtgcaggtgattgatgacaagggcagcatcctgccccccaacacagagggcaacatcggcatccgcatcaagcctgtgcggcctgtgtccctcttcatgtgctatgaaggagaccctgagaagacagccaaggtggagtgtggggacttctacaacacaggagaccggggcaagatggatgaggagggctacatctgcttcctgggccgcagtgatgacatcatcaatgccagcggctacagaattggccctgctgaggtggagagcgccctggtggagcaccctgctgtggccgagagcgctgtggtgggcagcccagaccccatccggggggaggtggtgaaggccttcatcgtgctgaccccccagttcctgagccatgacaaggaccagctgaccaaggagctgcagcagcacgtgaagtctgtgacagccccctacaagtaccccaggaaggtggagtttgtgtctgagctgcccaagaccatcaccgggaagattgaaaggaaggagctgaggaagaaggagaccggccagatgtag

SEQ ID NO: 142515 - DNA, 1734 bp, Artificial Sequence; identical to SEQ ID NO: 142514
  Description of Artificial Sequence: Synthetic coding sequence

SEQ ID NO: 142516 - DNA, 465 bp, Artificial Sequence
  Description of Artificial Sequence: Synthetic coding sequence
atgcagtggctgatgaggttccgcaccctgtggggcatccacaagagcttccacaacatccacccagcccccagccagctgcgctgccgcagcctgtctgaatttggagccccccgctggaatgactatgaggtgcctgaggagttcaactttgccagctatgtgctggactactgggcccagaaggagaaggagggcaagaggggccccaacccagccttctggtgggtgaatggccagggagatgaggtgaagtggagcttccgggagatgggagacctgacccggcgggtggccaacgtgttcacccagacctgtggcctgcagcagggcgaccacctggccctgatgctgccccgggtgcctgagtggtggctggtggccgtgggctgcatgaggacaggcatcatcttcatcccagccaccatcctgctgaaggccaaggacatcctgtaccgcctgtag

SEQ ID NO: 142517 - DNA, 1533 bp, Artificial Sequence
  Description of Artificial Sequence: Synthetic coding sequence
atgaggcctggcctgtccttcctgctggccctgctcttcttcctgggccaggccgccggggacctgggagatgtgggcccccccatccccagccctggcttcagcagcttccctggggtggacagcagcagcagcttcagcagcagcagccgcagcggcagcagcagcagccgcagcctgggcagcggcggctctgtgtcccagctgttcagcaacttcaccggctctgtggatgaccggggcacctgccagtgcagcgtgtccctgcctgacaccaccttccctgtggacagagtggagcggctggagttcaccgcccacgtgctgagccagaagtttgagaaggagctgagcaaggtgcgggagtatgtgcagctgatctctgtgtatgagaagaagctgctgaacctgactgtgagaattgacatcatggagaaggacaccatctcctacacagagctggactttgagctgatcaaggtggaggtgaaggagatggagaagctggtgatccagctgaaggagagctttggaggcagcagcgagatcgtggaccagctggaggtggagatccggaacatgaccctgctggtggagaagctggagaccctggacaagaacaacgtgctggccatcagaagagagatcgtggccctgaagaccaagctgaaggaatgtgaggccagcaaggaccagaacacccctgtggtgcaccccccacccaccccaggcagctgtggccacggcggcgtggtgaacatcagcaagcccagcgtggtgcagctgaactggaggggcttctcctacctgtatggagcctggggccgggactacagcccccagcaccccaacaagggcctgtactgggtggcccccctgaacacagatggccgcctgctggagtactaccgcctgtacaacaccctggatgacctgctgctgtacatcaatgcccgggagctgcgcatcacctacggccagggcagcggcacagctgtgtacaacaacaacatgtatgtgaacatgtacaacacaggcaacatcgcccgggtgaacctgaccaccaacaccatcgctgtgacccagaccctgcccaatgctgcctacaacaaccgcttctcctatgccaacgtggcctggcaggacatcgactttgctgtggatgaaaatggcctgtgggtgatctacagcacagaggccagcacaggcaacatggtgatcagcaagctgaatgacaccaccctgcaggtgctgaacacctggtacaccaagcagtacaagcccagcgccagcaatgccttcatggtgtgtggggtgctgtatgccaccaggaccatgaacaccaggacagaggagatcttctactactatgacaccaacacaggcaaggagggcaagctggacatcgtgatgcacaagatgcaggagaaggtgcagagcatcaactacaacccctttgaccagaagctgtatgtgtacaatgatggctacctgctgaactatgacctgtctgtgctgcagaagccccagtag

SEQ ID NO: 142518 - DNA, 1734 bp, Artificial Sequence
  Description of Artificial Sequence: Synthetic coding sequence
atgcactggctgaggaaggtgcagggcctgtgcaccctgtggggcacccagatgagcagcaggaccctgtacatcaacagccggcagctggtgtccctgcagtggggccaccaggaggtgcctgccaagttcaactttgccagtgatgtgctggaccactgggccgacatggagaaggccggcaagaggctgcccagccctgccctgtggtgggtgaatggcaagggcaaggagctgatgtggaacttccgggagctgtctgagaacagccagcaggccgccaacgtgctgagcggggcctgtggcctgcagagaggagacagagtggccgtggtgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaagtcatccaggaggtggacacagtggcctctgaatgtcccagcctgcgcatcaagctgctggtgtctgagaagagctgtgatggctggctgaacttcaagaagctgctgaatgaggccagcaccacccaccactgtgtggagaccggcagccaggaggccagcgccatctacttcaccagcggcaccagcggcctgcccaagatggccgagcacagctacagcagcctgggcctgaaggccaagatggatgctggctggacaggcctgcaggccagtgacatcatgtggaccatcagtgacaccggctggatcctgaacatcctgtgcagcctgatggagccctgggccctgggcgcctgcacctttgtgcacctgctgcccaagtttgaccccctggtgatcctgaagaccctgagcagctaccccatcaagtccatgatgggcgcccccatcgtgtacaggatgctgctgcagcaggacctgagcagctacaagttcccccacctgcagaactgtgtgacagtgggggagagcctgctgcctgagaccctggagaactggagggcccagacaggcctggacatccgggagagctatggccagacagagaccggcctgacctgcatggtgtccaagaccatgaagatcaagccaggctacatgggcacagctgccagctgctatgatgtgcagatcattgatgacaagggaaatgtgctgcccccaggcacagaaggagacatcggcatccgggtgaagcccatccggcccatcggcatcttcagcggctacgtggacaacccagacaagacagctgccaacatccggggggacttctggctgctgggggaccggggcatcaaggatgaagatggctacttccagttcatgggccgggccaatgacatcatcaacagcagcggctacagaattggccccagcgaggtggagaatgccctgatggagcaccctgctgtggtggagacagctgtgatcagcagcccagaccctgtgcggggggaggtggtgaaggcctttgtggtgctggccagccagttcctgagccatgaccctgagcagctgaccaaggagctgcagcagcacgtgaagtctgtgacagccccctacaagtaccccaggaagattgaatttgtgctgaacctgcccaagacagtgacaggcaagatccagagggccaagctgcgggacaaggagtggaagatgtctgggaaggcccgggcccagtag

SEQ ID NO: 142519 - DNA, 1497 bp, Artificial Sequence
  Description of Artificial Sequence: Synthetic coding sequence
atgtggaacttccgggagctgtctgagaacagccagcaggccgccaacgtgctgagcggggcctgtggcctgcagagaggagacagagtggccgtggtgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaggtgatccaggaggtggacacagtggccagcgagtgccccagcctgcgcatcaagctgctggtgtctgagaagagctgtgatggctggctgaacttcaagaagctgctgaatgaggccagcaccacccaccactgtgtggagaccggcagccaggaggccagcgccatctacttcaccagcggcaccagcggcctgcccaagatggccgagcacagctacagcagcctgggcctgaaggccaagatggatgctggctggacaggcctgcaggccagtgacatcatgtggaccatcagtgacaccggctggatcctgaacatcctgtgcagcctgatggagccctgggccctgggcgcctgcacctttgtgcacctgctgcccaagtttgaccccctggtgatcctgaagaccctgagcagctaccccatcaagtccatgatgggcgcccccatcgtgtacaggatgctgctgcagcaggacctgagcagctacaagttcccccacctgcagaactgtgtgacagtgggggagagcctgctgcctgagaccctggagaactggagggcccagacaggcctggacatccgggagagctatggccagacagaaacaggcctgacctgcatggtgtccaagaccatgaagatcaagccaggctacatgggcacagctgccagctgctatgatgtgcagatcattgatgacaagggaaatgtgctgcccccaggcacagaaggagacatcggcatccgggtgaagcccatccggcccatcggcatcttcagcggctacgtggacaacccagacaagacagctgccaacatccggggggacttctggctgctgggggaccggggcatcaaggatgaagatggctacttccagttcatgggccgggccaatgacatcatcaacagcagcggctaccgcatcggccccagcgaggtggagaatgccctgatggagcaccctgctgtggtggagacagctgtgatcagcagcccagaccctgtgcggggggaggtggtgaaggcctttgtggtgctggccagccagttcctgagccatgaccctgagcagctgaccaaggagctgcagcagcacgtgaagtctgtgacagccccctacaagtaccccaggaagattgaatttgtgctgaacctgcccaagacagtgacaggcaagatccagagggccaagctgcgggacaaggagtggaagatgtctgggaaggcccgggcccagtag

SEQ ID NO: 142520 - DNA, 627 bp, Artificial Sequence
  Description of Artificial Sequence: Synthetic coding sequence
atgcactggctgaggaaggtgcagggcctgtgcaccctgtggggcacccagatgagcagcaggaccctgtacatcaacagccggcagctggtgtccctgcagtggggccaccaggaggtgcctgccaagttcaactttgccagtgatgtgctggaccactgggccgacatggagaaggccggcaagaggctgcccagccctgccctgtggtgggtgaatggcaagggcaaggagctgatgtggaacttccgggagctgtctgagaacagccagcaggccgccaacgtgctgagcggggcctgtggcctgcagagaggagacagagtggccgtggtgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaagtcatccaggaggtggacacagtggcctctgaatgtcccagcctgcgcatcaagctgctggtgtctgagaagagctgtgatggctggctgaacttcaagaagctgctgaagtacaaggtgcgccacagagatgtgaagtag

SEQ ID NO: 142521 - DNA, 1050 bp, Artificial Sequence
  Description of Artificial Sequence: Synthetic coding sequence
atgaggcaccccccactcatcaccgtgtggaggctggaggccaagatggatgctggctggacaggcctgcaggccagtgacatcatgtggaccatcagtgacaccggctggatcctgaacatcctgtgcagcctgatggagccctgggccctgggcgcctgcacctttgtgcacctgctgcccaagtttgaccccctggtgatcctgaagaccctgagcagctaccccatcaagtccatgatgggcgcccccatcgtgtacaggatgctgctgcagcaggacctgagcagctacaagttcccccacctgcagaactgtgtgacagtgggggagagcctgctgcctgagaccctggagaactggagggcccagacaggcctggacatccgggagagctatggccagacagagaccggcctgacctgcatggtgtccaagaccatgaagatcaagccaggctacatgggcacagctgccagctgctatgatgtgcagatcattgatgacaagggaaatgtgctgcccccaggcacagaaggagacatcggcatccgggtgaagcccatccggcccatcggcatcttcagcggctacgtggacaacccagacaagacagctgccaacatccggggggacttctggctgctgggggaccggggcatcaaggatgaagatggctacttccagttcatgggccgggccaatgacatcatcaacagcagcggctacagaattggccccagcgaggtggagaatgccctgatggagcaccctgctgtggtggagacagctgtgatcagcagcccagaccctgtgcggggggaggtggtgaaggcctttgtggtgctggccagccagttcctgagccatgaccctgagcagctgaccaaggagctgcagcagcacgtgaagtctgtgacagccccctacaagtaccccaggaagattgaatttgtgctgaacctgcccaagacagtgacaggcaagatccagagggccaagctgcgggacaaggagtggaagatgtctgggaaggcccgggcccagtag

SEQ ID NO: 142522 - DNA, 1734 bp, Artificial Sequence; identical to SEQ ID NO: 142518
  Description of Artificial Sequence: Synthetic coding sequence

SEQ ID NO: 142523 - DNA, 1734 bp, Artificial Sequence
  Description of Artificial Sequence: Synthetic coding sequence
atgcactggctgaggaaggtgcagggcctgtgcaccctgtggggcacccagatgagcagcaggaccctgtacatcaacagccggcagctggtgtccctgcagtggggccaccaggaggtgcctgccaagttcaactttgccagtgatgtgctggaccactgggccgacatggagaaggccggcaagaggctgcccagccctgccctgtggtgggtgaatggcaagggcaaggagctgatgtggaacttccgggagctgtctgagaacagccagcaggccgccaacatcctgagcggggcctgtggcctgcagagaggagacagagtggccgtgatgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaagtcatccaggaggtggacacagtggcctctgaatgtcccagcctgcgcatcaagctgctggtgtctgagaagagctgtgatggctggctgaacttcaagaagctgctgaatgaggccagcaccacccaccactgtgtggagaccggcagccaggaggccagcgccatctacttcaccagcggcaccagcggcctgcccaagatggccgagcacagctacagcagcctgggcctgaaggccaagatggatgctggctggacaggcctgcaggccagtgacatcatgtggaccatcagtgacaccggctggatcctgaacatcctgggcagcctgctggagagctggaccctgggcgcctgcacctttgtgcacctgctgcccaagtttgaccccctggtgatcctgaagaccctgagcagctaccccatcaagtccatgatgggcgcccccatcgtgtacaggatgctgctgcagcaggacctgagcagctacaagttcccccacctgcagaactgcctggccggcggggagagcctgctgcctgagaccctggagaactggagggcccagacaggcctggacatccgggagttctacggccagacagagaccggcctgacctgcatggtgtccaagaccatgaagatcaagccaggctacatgggcacagctgccagctgctatgatgtgcaggtgattgatgacaagggaaatgtgctgcccccaggcacagaaggagacatcggcatccgggtgaagcccatccggcccatcggcatcttcagcggctacgtggagaacccagacaagacagctgccaacatccggggggacttctggctgctgggggaccggggcatcaaggatgaagatggctacttccagttcatgggccgggcagatgacatcatcaacagcagcggctacagaattggccccagcgaggtggagaatgccctgatgaagcaccctgctgtggtggagacagctgtgatcagcagcccagaccctgtgcggggggaggtggtgaaggccttcgtcatcctggccagccagttcctgagccatgaccctgagcagctgaccaaggagctgcagcagcacgtgaagtctgtgacagccccctacaagtaccccaggaagattgaatttgtgctgaacctgcccaagacagtgacaggcaagatccagaggaccaagctgcgggacaaggagtggaagatgtctgggaaggcccgggcccagtag

SEQ ID NO: 142524 - DNA, 627 bp, Artificial Sequence
  Description of Artificial Sequence: Synthetic coding sequence
atgcactggctgaggaaggtgcagggcctgtgcaccctgtggggcacccagatgagcagcaggaccctgtacatcaacagccggcagctggtgtccctgcagtggggccaccaggaggtgcctgccaagttcaactttgccagtgatgtgctggaccactgggccgacatggagaaggccggcaagaggctgcccagccctgccctgtggtgggtgaatggcaagggcaaggagctgatgtggaacttccgggagctgtctgagaacagccagcaggccgccaacatcctgagcggggcctgtggcctgcagagaggagacagagtggccgtgatgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaagtcatccaggaggtggacacagtggcctctgaatgtcccagcctgcgcatcaagctgctggtgtctgagaagagctgtgatggctggctgaacttcaagaagctgctgaagtacaaggtgcgccaccgggaggtgaagtag

SEQ ID NO: 142525 - DNA, 1761 bp, Artificial Sequence
  Description of Artificial Sequence: Synthetic coding sequence
atgctggcccgggtgaccaggaagatgctgcggcatgccaagtgcttccagaggctggccatcttcggctctgtgcgggccctgcacaaggacaacagaacagccaccccccagaacttcagcaactatgaatccatgaagcaggacttcaagctgggcatccctgagtacttcaactttgccaaggatgtgctggaccagtggacagacaaggagaaggccggcaagaagcccagcaacccagccttctggtggatcaacagaaatggagaggagatgcgctggagctttgaggagctgggcagcctgagcaggaagtttgccaacatcctgtctgaggcctgcagcctgcagagaggagacagagtcatcctgatcctgccccgggtgcctgagtggtggctggccaacgtggcctgcctgaggactggaacagtgctgatccctggcaccacccagctgacccagaaggacatcctgtaccgcctgcagagcagcaaggccaactgcatcatcaccaatgatgtgctggccccagctgtggatgctgtggccagcaaatgtgagaacctgcacagcaagctgattgtgtctgagaacagccgggagggctggggcaacctgaaggagctgatgaagcacgccagtgacagccacacctgtgtgaagaccaagcacaatgagatcatggccatcttcttcaccagcggcaccagcggctaccccaagatgacagcccacacccacagcagctttggcctgggcctgtctgtgaatggccgcttctggctggacctgacccccagtgatgtgatgtggaacaccagtgacaccggctgggccaagagcgcctggagctctgtgttcagcccctggatccagggcgcctgtgtgttcacccaccacctgcccaggtttgagcccaccagcatcctgcagaccctgagcaagtaccccatcaccgtcttctgcagcgcccccaccgtgtacaggatgctggtgcagaatgacatcaccagctacaagttcaagagcctgaagcactgtgtgtctgctggggagcccatcaccccagatgtgacagagaagtggaggaacaagacaggcctggacatctatgagggctacggccagacagaaacagtgctgatctgtggcaacttcaagggcatgaagatcaagccaggctccatgggcaagcccagccctgcctttgatgtgaagatcgtggatgtgaatggaaatgtgctgcccccaggccaggagggggacatcggcatccaggtgctgcccaaccggcccttcggcctcttcacccactacgtggacaaccccagcaagacagccagcaccctgcggggcaacttctacatcactggagaccggggctacatggacaaggatggctacttctggtttgtggcccgggcagatgatgtgatcctgagcagcggctaccgcatcggcccctttgaggtggagaatgccctgaatgagcaccccagcgtggccgagagcgctgtggtgagcagcccagaccccatccggggggaggtggtgaaggcctttgtggtgctgaacccagactacaagagccatgaccaggagcagctgatcaaggagatccaggagcacgtgaagaagaccacagccccctacaagtaccccaggaaggtggagttcatccaggagctgcccaagaccatcagcggcaagaccaagagaaatgagctgaggaagaaggagtggaagaccatctag

SEQ ID NO: 142526 - DNA, 1317 bp, Artificial Sequence
  Description of Artificial Sequence: Synthetic coding sequence
atgctggcccgggtgaccaggaagatgctgcggcatgccaagtgcttccagaggctggccatcttcggctctgtgcgggccctgcacaaggacaacagaacagccaccccccagaacttcagcaactatgaatccatgaagcaggacttcaagctgggcatccctgagtacttcaactttgccaaggatgtgctggaccagtggacagacaaggagaaggccggcaagaagcccagcaacccagccttctggtggatcaacagaaatggagaggagatgcgctggagctttgaggagctgggcagcctgagcaggaagtttgccaacatcctgtctgaggcctgcagcctgcagagaggagacagagtcatcctgatcctgccccgggtgcctgagtggtggctggccaacgtggcctgcctgaggactggaacagtgctgatccctggcaccacccagctgacccagaaggacatcctgtaccgcctgcagagcagcaaggccaactgcatcatcaccaatgatgtgctggccccagctgtggatgctgtggccagcaaatgtgagaacctgcacagcaagctgattgtgtctgagaacagccgggagggctggggcaacctgaaggagctgatgaagcacgccagtgacagccacacctgtgtgaagaccaagcacaatgagatcatggccatcttcttcaccagcggcaccagcggctaccccaagatgacagcccacacccacagcagctttggcctgggcctgtctgtgaatggccgcttctggctggacctgacccccagtgatgtgatgtggaacaccagtgacaccggctgggccaagagcgcctggagctctgtgttcagcccctggatccagggcgcctgtgtgttcacccaccacctgcccaggtttgagcccaccagcatcctgcagaccctgagcaagtaccccatcaccgtcttctgcagcgcccccaccgtgtacaggatgctggtgcagaatgacatcaccagctacaagttcaagagcctgaagcactgtgtgtctgctggggagcccatcaccccagatgtgacagagaagtggaggaacaagacaggcctggacatctatgagggctacggccagacagaaacagtgctgatctgtggcaacttcaagggcatgaagatcaagccaggctccatgggcaagcccagccctgcctttgatgtgaaggtgtgcaccagccccagcaggaggatgttcaacaaccccatctgcaccctgcccacctaccgcctgcccccctacaagctgagcctgctgtag

SEQ ID NO: 142527 - DNA, 1737 bp, Artificial Sequence
  Description of Artificial Sequence: Synthetic coding sequence
atgaagcaggacttcaagctgggcatccctgagtacttcaactttgccaaggatgtgctggaccagtggacagacaaggagaaggccggcaagaagcccagcaacccagccttctggtggatcaacagaaatggagaggagatgcgctggagctttgaggagctgggcagcctgagcaggaagtttgccaacatcctgtctgaggcctgcagcctgcagagaggagacagagtcatcctgatcctgccccgggtgcctgagtggtggctggccaacgtggcctgcctgaggacaggcaccgtgctgatccctggcaccacccagctgacccagaaggacatcctgtaccgcctgcagagcagcaaggccaactgcatcatcaccaatgatgtgctggccccagctgtggatgctgtggccagcaaatgtgagaacctgcacagcaagctgattgtgtctgagaacagccgggagggctggggcaacctgaaggagctgatgaaggtgttcctgtgccaccctggctggagcacagtggcccgctcctggctgacagccaccagcaccagcctggtgcaggccatcctgagcctgctgagctcctgggactacagacatgccagtgacagccacacctgtgtgaagaccaagcacaatgagatcatggccatcttcttcaccagcggcaccagcggctaccccaagatgacagcccacacccacagcagctttggcctgggcctgtctgtgaatggccgcttctggctggacctgacccccagtgatgtgatgtggaacaccagtgacaccggctgggccaagagcgcctggagctctgtgttcagcccctggatccagggcgcctgtgtgttcacccaccacctgcccaggtttgagcccaccagcatcctgcagaccctgagcaagtaccccatcaccgtcttctgcagcgcccccaccgtgtacaggatgctggtgcagaatgacatcaccagctacaagttcaagagcctgaagcactgtgtgtctgctggggagcccatcaccccagatgtgacagagaagtggaggaacaagacaggcctggacatctatgagggctacggccagacagaaacagtgctgatctgtggcaacttcaagggcatgaagatcaagccaggctccatgggcaagcccagccctgcctttgatgtgaagatcgtggatgtgaatggaaatgtgctgcccccaggccaggagggggacatcggcatccaggtgctgcccaaccggcccttcggcctcttcacccactacgtggacaaccccagcaagacagccagcaccctgcggggcaacttctacatcactggagaccggggctacatggacaaggatggctacttctggtttgtggcccgggcagatgatgtgatcctgagcagcggctaccgcatcggcccctttgaggtggagaatgccctgaatgagcaccccagcgtggccgagagcgctgtggtgagcagcccagaccccatccggggggaggtggtgaaggcctttgtggtgctgaacccagactacaagagccatgaccaggagcagctgatcaaggagatccaggagcacgtgaagaagaccacagccccctacaagtaccccaggaaggtggagttcatccaggagctgcccaagaccatcagcggcaagaccaagagaaatgagctgaggaagaaggagtggaagaccatctag

SEQ ID NO: 142528 - DNA, 1740 bp, Artificial Sequence
  Description of Artificial Sequence: Synthetic coding sequence
atgaggccctggctgcggcacctggtgctgcaggccctgaggaacagccgggccttctgtggcagccacggcaagccagcccccctgcctgtgccccagaagatcgtggccacctgggaggccatcagcctgggccggcagctggtgcctgagtacttcaactttgcccatgatgtgctggatgtgtggagccggctggaggaggccggccacaggcctcccaacccagccttctggtgggtgaatggcaccggggctgagatcaagtggagctttgaggagctgggcaagcagagcaggaaggccgccaacgtgctgggcggggcctgtggcctgcagcccggggacaggatgatgctggtgctgccccggctgcctgagtggtggctggtgtctgtggcctgcatgaggacaggcaccgtgatgatccctggggtgacccagctgacagagaaggacctgaagtaccgcctgcaggccagccgggccaagagcatcatcaccagtgacagcctggccccccgggtggatgccatctctgctgagtgccccagcctgcagaccaagctgctggtgtctgacagcagccggcccggctggctgaacttccgggagctgctgcgggaggccagcacagagcacaactgcatgaggaccaagagccgggaccccctggccatctacttcaccagcggcaccaccggggcccccaagatggtggagcacagccagagcagctatggcctgggctttgtggccagcggccgccgctgggtggccctgacagaaagtgacatcttctggaacaccacagacaccggctgggtgaaggccgcctggaccctcttcagcgcctggcccaacggcagctgcatctttgtgcatgagctgccccgggtggatgccaaggtgatcctgaacaccctgagcaagttccccatcaccaccctgtgctgcgtgcccaccatcttccggctgctggtgcaggaggacctgacccgctaccagttccagagcctgcggcactgcctgactggaggagaggccctgaacccagatgtgcgggagaagtggaagcaccagacaggagtggagctgtatgagggctacggccagagcgagaccgtggtgatctgtgccaaccccaagggcatgaagatcaagagcggctccatgggcaaggccagccccccctatgatgtgcagatcgtggatgatgagggcaatgtgctgcccccaggagaggagggcaatgtggccgtgcgcatccggcccacccggcccttctgcttcttcaactgctacctggacaaccctgagaagacagctgccagcgagcagggcgacttctacatcactggagaccgggccaggatggacaaggatggctacttctggttcatgggcagaaatgatgatgtgatcaacagcagcagctaccgcatcggccctgtggaggtggagagcgccctggccgagcaccctgctgtgctggagagcgctgtggtgagcagcccagaccccatccggggggaggtggtgaaggccttcatcgtgctgaccccagcctacagcagccatgaccctgaggccctgacccgggagctgcaggagcacgtgaagagggtgacagccccctacaagtaccccaggaaggtggcctttgtgtctgagctgcccaagacagtgtctgggaagatccagaggagcaagctgcggagccaggagtggggcaagtag

SEQ ID NO: 142529 - DNA, 2070 bp, Artificial Sequence
  Description of Artificial Sequence: Synthetic coding sequence
atggccgcccggaccctgggccggggcgtgggccgcctgctgggcagcctgcggggcctgagcggccagcctgcccggcccccctgtggggtgtctgcccccaggagagctgccagcggccccagcggcagcgccccagctgtggccgctgctgctgcccagcccggcagctacccagccctgagcgcccaggccgcccgggagcctgctgccttctggggccccctggcccgggacaccctggtgtgggacaccccctaccacacagtgtgggactgtgacttcagcacaggcaagattggctggttcctgggcggccagctgaatgtgtctgtgaactgcctggaccagcacgtgaggaagagccctgagagcgtggccctgatctgggagagagatgagcctggaacagaggtgcgcatcacctaccgggagctgctggagaccacctgccgcctggccaacaccctgaagagacatggagtgcacagaggagacagagtggccatctacatgcctgtgagccccctggccgtggccgccatgctggcctgtgcccgcatcggggctgtgcacacagtcatctttgctggcttctctgctgagagcctggccggccgcatcaatgatgccaagtgcaaggtggtgatcaccttcaaccagggcctgcggggcggccgggtggtggagctgaagaagatcgtggatgaggccgtgaagcactgccccaccgtgcagcacgtgctggtggcccacaggacagacaacaaggtgcacatgggagacctggatgtgcccctggagcaggagatggccaaggaggaccctgtgtgtgcccctgagagcatgggcagcgaggacatgctgttcatgctgtacaccagcggcagcacaggcatgcccaagggcatcgtgcacacccaggccggctacctgctgtatgctgccctgacccacaagctggtgtttgaccaccagcccggggacatcttcggctgtgtggccgacatcggctggatcaccggccacagctatgtggtgtatggccccctgtgcaatggagccacctctgtgctgtttgagagcacccctgtgtacccaaatgccggccgctactgggagaccgtggagcggctgaagatcaaccagttctatggagcccccacagctgtgcggctgctgctgaagtatggagatgcctgggtgaagaagtatgacaggagcagcctgcggaccctgggctctgtgggggagcccatcaactgtgaggcctgggagtggctgcaccgggtggtgggggacagccgctgcaccctggtggacacctggtggcagacagagaccggcggcatctgcatcgccccccggcccagcgaggagggcgctgagatcctgcctgccatggccatgaggcccttcttcggcatcgtgcctgtgctgatggatgagaagggctctgtggtggagggcagcaatgtgtctggggccctgtgcatcagccaggcctggccaggcatggcccggaccatctatggagaccaccagagatttgtggatgcctacttcaaggcctacccaggctactacttcaccggagatggagcctacagaacagagggcggctactaccagatcaccggccgcatggatgatgtgatcaacatcagcggccaccggctgggcacagctgagattgaagatgccatcgctgaccaccctgctgtgcctgagagcgctgtgattggctacccccatgacatcaagggggaggccgcctttgccttcatcgtggtgaaggacagcgctggggacagtgatgtggtggtgcaggagctgaagtccatggtggccaccaagatcgccaagtatgctgtgcctgatgagatcctggtggtgaagaggctgcccaagaccaggtctgggaaggtgatgaggcggctgctgaggaagatcatcaccagcgaggcccaggagctgggggacaccaccaccctggaggaccccagcatcatcgccgagatcctgtctgtgtaccagaagtgcaaggacaagcaggccgccgccaagtag

SEQ ID NO: 142530 - DNA, 462 bp, Artificial Sequence
  Description of Artificial Sequence: Synthetic coding sequence
atggccgcccggaccctgggccggggcgtgggccgcctgctgggcagcctgcggggcctgagcggccagcctgcccggcccccctgtggggtgtctgcccccaggagagctgccagcggccccagcggcagcgccccagctgtggccgctgctgctgcccagcccggcagctacccagccctgagcgcccaggccgcccgggagcctgctgccttctggggccccctggcccgggacaccctggtgtgggacaccccctaccacacagtgtgggactgtgacttcagcacaggcaagattggctggttcctgggcggccagctgaatgtgtctgtgaactgcctggaccagcacgtgaggaagagccctgagagcgtggccctgatctgggagagagatgagcctggaacagaggtgcgcatcacctacagcccctggctgcagatgccctgtggcccctag

SEQ ID NO: 142531 - DNA, 1455 bp, Artificial Sequence
  Description of Artificial Sequence: Synthetic coding sequence
atggccgcccggaccctgggccggggcgtgggccgcctgctgggcagcctgcggggcctgagcggccagcctgcccggcccccctgtggggtgtctgcccccaggagagctgccagcggccccagcggcagcgccccagctgtggccgctgctgctgcccagcccggcagctacccagccctgagcgcccaggccgcccgggagcctgctgccttctggggccccctggcccgggacaccctggtgtgggacaccccctaccacacagtgtgggactgtgacttcagcacaggcaagattggctggttcctgggcggccagctgaatgtgtctgtgaactgcctggaccagcacgtgaggaagagccctgagagcgtggccctgatctgggagagagatgagcctggaacagaggtgcgcatcacctaccgggagctgctggagaccacctgccgcctggccaacaccctgaagagacatggagtgcacagaggagacagagtggccatctacatgcctgtgagccccctggccgtggccgccatgctggcctgtgcccgcatcggggctgtgcacacagtcatctttgctggcttctctgctgagagcctggccggccgcatcaatgatgtgggggagcccatcaactgtgaggcctgggagtggctgcaccgggtggtgggggacagccgctgcaccctggtggacacctggtggcagacagaaacaggaggcatctgcatcgccccccggcccagcgaggagggcgctgagatcctgcctgccatggccatgaggcccttctttggaattgtgcctgtgctgatggatgagaagggctctgtggtggagggcagcaatgtgtctggggccctgtgcatcagccaggcctggccaggcatggcccggaccatctacggggaccaccagagatttgtggatgcctacttcaaggcctacccaggctactacttcaccggagatggagcctacagaacagaaggaggctactaccagatcactggaaggatggatgatgtgatcaacatcagcggccaccggctgggcacagctgagattgaagatgccatcgctgaccaccctgctgtgcctgagagcgctgtgattggctacccccatgacatcaagggggaggccgcctttgccttcatcgtggtgaaggacagcgctggggacagtgatgtggtggtgcaggagctgaagtccatggtggccaccaagatcgccaagtatgctgtgcctgatgagatcctggtggtgaagaggctgcccaagaccaggtctgggaaggtgatgaggcggctgctgaggaagatcatcaccagcgaggcccaggagctgggggacaccaccaccctggaggaccccagcatcatcgccgagatcctgtctgtgtaccagaagtgcaaggacaagcaggccgccgccaagtag

SEQ ID NO: 142532 - DNA, 1728 bp, Artificial Sequence
  Description of Artificial Sequence: Synthetic coding sequence
atggccgcccggaccctgggccggggcgtgggccgcctgctgggcagcctgcggggcctgagcggccagcctgcccggcccccctgtggggtgtctgcccccaggagagctgccagcggccccagcggcagcgccccagctgtggccgctgctgctgcccagcccggcagctacccagccctgagcgcccaggccgcccgggagcctgctgccttctggggccccctggcccgggacaccctggtgtgggacaccccctaccacacagtgtgggactgtgacttcagcacaggcaagattggctggttcctgggcggccagctgaatgtgtctgtgaactgcctggaccagcacgtgaggaagagccctgagagcgtggccctgatctgggagagagatgagcctggaacagaggtgcgcatcacctaccgggagctgctggagaccacctgccgcctggccaacaccctgaagagacatggagtgcacagaggagacagagtggccatctacatgcctgtgagccccctggccgtggccgccatgctggcctgtgcccgcatcggggctgtgcacacagtcatctttgctggcttctctgctgagagcctggccggccgcatcaatgatgccaagtgcaaggtggtgatcaccttcaaccagggcctgcggggcggccgggtggtggagctgaagaagatcgtggatgaggccgtgaagcactgccccaccgtgcagcacgtgctggtggcccacaggacagacaacaaggtgcacatgggagacctggatgtgcccctggagcaggagatggccaaggaggaccctgtgtgtgcccctgagagcatgggcagcgaggacatgctgttcatgctgtacaccagcggcagcacaggcatgcccaagggcatcgtgcacacccaggccggctacctgctgtatgctgccctgacccacaagctggtgtttgaccaccagcccggggacatcttcggctgtgtggccgacatcggctggatcaccggccacagctatgtggtgtatggccccctgtgcaatggagccacctctgtgctgtttgagagcacccctgtgtacccaaatgccggccgctactgggagaccgtggagcggctgaagatcaaccagttctatggagcccccacagctgtgcggctgctgctgaagtatggagatgcctgggtgaagaagtatgacaggagcagcctgcggaccctgggctctgtgggggagcccatcaactgtgaggcctgggagtggctgcaccgggtggtgggggacagccgctgcaccctggtggacacctggtggcagacagagaccggcggcatctgcatcgccccccggcccagcgaggagggcgctgagatcctgcctgccatggccatgaggcccttcttcggcatcgtgcctgtgctgatggatgagaagggctctgtggtggagggcagcaatgtgtctggggccctgtgcatcagccaggcctggccaggcatggcccggaccatctatggagaccaccagagatttgtggatgcctacttcaaggcctacccaggctactacttcaccggagatggagcctacagaacagagggcggctactaccagatcaccggccgcatggatgatgtgatcaacatcctgcagatcgtgggcttcttccgggaggccatcagaaattctggggacctgctggagcactag

SEQ ID NO: 142533 - DNA, 1821 bp, Artificial Sequence
  Description of Artificial Sequence: Synthetic coding sequence
atgctgaagaccttcctgttcctggagaagtacttcccctgcatcaagtacagcagcgcctgcttccctggcaccggcctggatgtgtatgacatcaagtttgctgtgctgctgcacccccagacagccctgcacttcggccccccacccagcctgatggccttcagcagcctgtgctgccgggagctgctggagaccacctgccgcctggccaacaccctgaagagacatggagtgcacagaggagacagagtggccatctacatgcctgtgagccccctggccgtggccgccatgctggcctgtgccagaattggagctgtgcacacagtcatctttgctggcttctctgctgagagcctggccggccgcatcaatgatgccaagtgcaaggtggtgatcaccttcaaccagggcctgcggggcggccgggtggtggagctgaagaagatcgtggatgaagctgtgaagcactgccccaccgtgcagcacgtgctggtggcccacaggacagacaacaaggtgcacatgggagacctggatgtgcccctggagcaggagatggccaaggaggaccctgtgtgtgcccctgagagcatgggcagcgaggacatgctgttcatgctgtacaccagcggcagcacaggcatgcccaagggcatcgtgcacacccaggccggctacctgctgtatgctgccctgacccacaagctggtgtttgaccaccagcccggggacatcttcggctgtgtggccgacatcggctggatcaccggccacagctatgtggtgtatggccccctgtgcaatggagccacctctgtgctgtttgagagcacccctgtgtacccaaatgccggccgctactgggagaccgtggagcggctgaagatcaaccagttctacggggcccccacagctgtgcggctgctgctgaagtatggagatgcctgggtgaagaagtatgacaggagcagcctgcggaccctgggctctgtgggggagcccatcaactgtgaggcctgggagtggctgcaccgggtggtgggggacagccgctgcaccctggtggacacctggtggcagacagaaacaggaggcatctgcatcgccccccggcccagcgaggagggcgctgagatcctgcctgccatggccatgaggcccttctttggaattgtgcctgtgctgatggatgagaagggctctgtggtggagggcagcaatgtgtctggggccctgtgcatcagccaggcctggccaggcatggcccggaccatctacggggaccaccagagatttgtggatgcctacttcaaggcctacccaggctactacttcaccggagatggagcctacagaacagaaggaggctactaccagatcactggaaggatggatgatgtgatcaacatcagcggccaccggctgggcacagctgagattgaagatgccatcgctgaccaccctgctgtgcctgagagcgctgtgattggctacccccatgacatcaagggggaggccgcctttgccttcatcgtggtgaaggacagcgctggggacagtgatgtggtggtgcaggagctgaagtccatggtggccaccaagatcgccaagtatgctgtgcctgatgagatcctggtggtgaagaggctgcccaagaccaggtctgggaaggtgatgaggcggctgctgaggaagatcatcaccagcgaggcccaggagctgggggacaccaccaccctggaggaccccagcatcatcgccgagatcctgtctgtgtaccagaagtgcaaggacaagcaggccgccgccaagtag

SEQ ID NO: 142534 - DNA, 1707 bp, Artificial Sequence
  Description of Artificial Sequence: Synthetic coding sequence
atgagaagaaggaaggagcggcagccctgggaccgcttccacttcctgcactttgcccctcatggccgggagctgctggagaccacctgccgcctggccaacaccctgaagagacatggagtgcacagaggagacagagtggccatctacatgcctgtgagccccctggccgtggccgccatgctggcctgtgccagaattggagctgtgcacacagtcatctttgctggcttctctgctgagagcctggccggccgcatcaatgatgccaagtgcaaggtggtgatcaccttcaaccagggcctgcggggcggccgggtggtggagctgaagaagatcgtggatgaagctgtgaagcactgccccaccgtgcagcacgtgctggtggcccacaggacagacaacaaggtgcacatgggagacctggatgtgcccctggagcaggagatggccaaggaggaccctgtgtgtgcccctgagagcatgggcagcgaggacatgctgttcatgctgtacaccagcggcagcacaggcatgcccaagggcatcgtgcacacccaggccggctacctgctgtatgctgccctgacccacaagctggtgtttgaccaccagcccggggacatcttcggctgtgtggccgacatcggctggatcaccggccacagctatgtggtgtatggccccctgtgcaatggagccacctctgtgctgtttgagagcacccctgtgtacccaaatgccggccgctactgggagaccgtggagcggctgaagatcaaccagttctacggggcccccacagctgtgcggctgctgctgaagtatggagatgcctgggtgaagaagtatgacaggagcagcctgcggaccctgggctctgtgggggagcccatcaactgtgaggcctgggagtggctgcaccgggtggtgggggacagccgctgcaccctggtggacacctggtggcagacagaaacaggaggcatctgcatcgccccccggcccagcgaggagggcgctgagatcctgcctgccatggccatgaggcccttctttggaattgtgcctgtgctgatggatgagaagggctctgtggtggagggcagcaatgtgtctggggccctgtgcatcagccaggcctggccaggcatggcccggaccatctacggggaccaccagagatttgtggatgcctacttcaaggcctacccaggctactacttcaccggagatggagcctacagaacagaaggaggctactaccagatcactggaaggatggatgatgtgatcaacatcagcggccaccggctgggcacagctgagattgaagatgccatcgctgaccaccctgctgtgcctgagagcgctgtgattggctacccccatgacatcaagggggaggccgcctttgccttcatcgtggtgaaggacagcgctggggacagtgatgtggtggtgcaggagctgaagtccatggtggccaccaagatcgccaagtatgctgtgcctgatgagatcctggtggtgaagaggctgcccaagaccaggtctgggaaggtgatgaggcggctgctgaggaagatcatcaccagcgaggcccaggagctgggggacaccaccaccctggaggaccccagcatcatcgccgagatcctgtctgtgtaccagaagtgcaaggacaagcaggccgccgccaagtag

SEQ ID NO: 142535 - DNA, 2145 bp, Artificial Sequence
  Description of Artificial Sequence: Synthetic coding sequence
atgggcctgcctgaggagcgggtgcgcagcggcagcggcagccggggccaggaggaggccggggccggcggccgggcccgctcctggagccccccacctgaggtgagccgcagcgcccacgtgcccagcctgcagcgctaccgggagctgcaccggcgctctgtggaggagccccgggagttctggggagacatcgccaaggagttctactggaagaccccctgccccggccccttcctgcgctacaactttgatgtgaccaagggcaagatcttcatcgagtggatgaagggggccaccaccaacatctgctacaacgtgctggacagaaatgtgcatgagaagaagctgggggacaaggtggccttctactgggagggcaatgagcccggggagaccacccagatcacctaccaccagctgctggtgcaggtgtgccagttcagcaatgtgctgaggaagcagggcatccagaagggggacagagtggccatctacatgcccatgatccctgagctggtggtggccatgctggcctgtgccagaattggagccctgcacagcatcgtgtttgctggcttcagcagcgagagcctgtgtgagcgcatcctggacagcagctgcagcctgctgatcaccacagatgccttctacagaggagagaagctggtgaacctgaaggagctggctgatgaggccctgcagaagtgccaggagaagggcttccctgtgcgctgctgcatcgtggtgaagcacctgggccgggcagagctgggcatgggagacagcaccagccagagcccccccatcaagaggagctgcccagatgtgcagggcaagctgaaggagaagagcaagagggtgcagccccagatctcctggaaccagggcatcgacctgtggtggcatgagctgatgcaggaggccggagatgaatgtgagcctgagtggtgtgatgctgaggaccccctcttcatcctgtacaccagcggcagcacaggcaagcccaagggcgtggtgcacacagtgggcggctacatgctgtatgtggccaccaccttcaagtatgtgtttgacttccacgcagaagatgtgttctggtgcacagctgacatcggctggatcaccggccacagctatgtgacctacggccccctggccaacggggccacctctgtgctgtttgagggcatccccacctacccagatgtgaaccggctgtggagcatcgtggacaagtacaaggtgaccaagttctacacagcccccacagccatccggctgctgatgaagtttggagatgagcctgtgaccaagcacagccgggccagcctgcaggtgctgggcaccgtgggggagcccatcaaccctgaggcctggctgtggtaccaccgggtggtgggcgcccagcgctgccccatcgtggacaccttctggcagacagaaacaggaggccacatgctgacccccctgcccggggccacccccatgaagccaggcagcgccaccttccccttctttggagtggccccagccatcctgaatgaaagtggagaggagctggagggggaggccgagggctacctggtgttcaagcagccctggccaggcatcatgaggacagtgtatggcaaccacgagagatttgagaccacctacttcaagaagtttcctggctactacgtgactggagatggctgccagagggaccaggacggctactactggatcaccggcagaattgatgacatgctgaatgtgtctggccacctgctgagcacagctgaggtggagagcgccctggtggagcacgaggccgtggccgaggccgctgtggtgggccacccccaccctgtgaagggggagtgcctgtactgctttgtgaccctgtgtgatggccacaccttcagccccaagctgacagaggagctgaagaagcagatccgggagaagattggccccatcgccaccccagactacatccagaatgcccctggcctgcccaagaccaggtctgggaagatcatgagaagagtgctgaggaagatcgcccagaatgaccatgacctgggggacatgagcacagtggccgaccccagcgtcatcagccacctgttcagccaccgctgcctgaccatccagtag

SEQ ID NO: 142536 - DNA, 1956 bp, Artificial Sequence
  Description of Artificial Sequence: Synthetic coding sequence
atgatggtgcgctgggccctgctgtgtgagttctggggagacatcgccaaggagttctactggaagaccccctgccccggccccttcctgcgctacaactttgatgtgaccaagggcaagatcttcatcgagtggatgaagggggccaccaccaacatctgctacaacgtgctggacagaaatgtgcatgagaagaagctgggggacaaggtggccttctactgggagggcaatgagcccggggagaccacccagatcacctaccaccagctgctggtgcaggtgtgccagttcagcaatgtgctgaggaagcagggcatccagaagggggacagagtggccatctacatgcccatgatccctgagctggtggtggccatgctggcctgtgccagaattggagccctgcacagcatcgtgtttgctggcttcagcagcgagagcctgtgtgagcgcatcctggacagcagctgcagcctgctgatcaccacagatgccttctacagaggagagaagctggtgaacctgaaggagctggctgatgaggccctgcagaagtgccaggagaagggcttccctgtgcgctgctgcatcgtggtgaagcacctgggccgggcagagctgggcatgggagacagcaccagccagagcccccccatcaagaggagctgcccagatgtgcagatctcctggaaccagggcatcgacctgtggtggcatgagctgatgcaggaggccggagatgaatgtgagcctgagtggtgtgatgctgaggaccccctcttcatcctgtacaccagcggcagcacaggcaagcccaagggcgtggtgcacacagtgggcggctacatgctgtatgtggccaccaccttcaagtatgtgtttgacttccacgccgaggatgtgttctggtgcacagctgacatcggctggatcaccggccacagctatgtgacctacggccccctggccaatggagccacctctgtgctgtttgagggcatccccacctacccagatgtgaaccggctgtggagcatcgtggacaagtacaaggtgaccaagttctacacagcccccacagccatccggctgctgatgaagtttggagatgagcctgtgaccaagcacagccgggccagcctgcaggtgctgggcaccgtgggggagcccatcaaccctgaggcctggctgtggtaccaccgggtggtgggcgcccagcgctgccccatcgtggacaccttctggcagacagagaccggcggccacatgctgacccccctgcccggggccacccccatgaagccaggcagcgccaccttccccttcttcggcgtggccccagccatcctgaatgaaagtggagaggagctggagggggaggccgagggctacctggtgttcaagcagccctggccaggcatcatgaggacagtgtatggcaaccacgagagatttgagaccacctacttcaagaagtttcctggctactacgtgactggagatggctgccagagggaccaggacggctactactggatcaccggcagaattgatgacatgctgaatgtgtctggccacctgctgagcacagctgaggtggagagcgccctggtggagcatgaagctgtggccgaggccgctgtggtgggccacccccaccctgtgaagggagaatgtctgtactgctttgtgaccctgtgtgatggccacaccttcagccccaagctgacagaggagctgaagaagcagatccgggagaagattggccccatcgccaccccagactacatccagaatgcccctggcctgcccaagaccaggtctgggaagatcatgagaagagtgctgaggaagatcgcccagaatgaccatgacctgggggacatgagcacagtggccgaccccagcgtcatcagccacctgttcagccaccgctgcctgaccatccagtag

SEQ ID NO: 142537 - DNA, 2106 bp, Artificial Sequence
  Description of Artificial Sequence: Synthetic coding sequence
atgggcctgcctgaggagcgggtgcgcagcggcagcggcagccggggccaggaggaggccggggccggcggccgggcccgctcctggagccccccacctgaggtgagccgcagcgcccacgtgcccagcctgcagcgctaccgggagctgcaccggcgctctgtggaggagccccgggagttctggggagacatcgccaaggagttctactggaagaccccctgccccggccccttcctgcgctacaactttgatgtgaccaagggcaagatcttcatcgagtggatgaagggggccaccaccaacatctgctacaacgtgctggacagaaatgtgcatgagaagaagctgggggacaaggtggccttctactgggagggcaatgagcccggggagaccacccagatcacctaccaccagctgctggtgcaggtgtgccagttcagcaatgtgctgaggaagcagggcatccagaagggggacagagtggccatctacatgcccatgatccctgagctggtggtggccatgctggcctgtgccagaattggagccctgcacagcatcgtgtttgctggcttcagcagcgagagcctgtgtgagcgcatcctggacagcagctgcagcctgctgatcaccacagatgccttctacagaggagagaagctggtgaacctgaaggagctggctgatgaggccctgcagaagtgccaggagaagggcttccctgtgcgctgctgcatcgtggtgaagcacctgggccgggcagagctgggcatgggagacagcaccagccagagcccccccatcaagaggagctgcccagatgtgcagatctcctggaaccagggcatcgacctgtggtggcatgagctgatgcaggaggccggagatgaatgtgagcctgagtggtgtgatgctgaggaccccctcttcatcctgtacaccagcggcagcacaggcaagcccaagggcgtggtgcacacagtgggcggctacatgctgtatgtggccaccaccttcaagtatgtgtttgacttccacgccgaggatgtgttctggtgcacagctgacatcggctggatcaccggccacagctatgtgacctacggccccctggccaatggagccacctctgtgctgtttgagggcatccccacctacccagatgtgaaccggctgtggagcatcgtggacaagtacaaggtgaccaagttctacacagcccccacagccatccggctgctgatgaagtttggagatgagcctgtgaccaagcacagccgggccagcctgcaggtgctgggcaccgtgggggagcccatcaaccctgaggcctggctgtggtaccaccgggtggtgggcgcccagcgctgccccatcgtggacaccttctggcagacagagaccggcggccacatgctgacccccctgcccggggccacccccatgaagccaggcagcgccaccttccccttcttcggcgtggccccagccatcctgaatgaaagtggagaggagctggagggggaggccgagggctacctggtgttcaagcagccctggccaggcatcatgaggacagtgtatggcaaccacgagagatttgagaccacctacttcaagaagtttcctggctactacgtgactggagatggctgccagagggaccaggacggctactactggatcaccggcagaattgatgacatgctgaatgtgtctggccacctgctgagcacagctgaggtggagagcgccctggtggagcatgaagctgtggccgaggccgctgtggtgggccacccccaccctgtgaagggagaatgtctgtactgctttgtgaccctgtgtgatggccacaccttcagccccaagctgacagaggagctgaagaagcagatccgggagaagattggccccatcgccaccccagactacatccagaatgcccctggcctgcccaagaccaggtctgggaagatcatgagaagagtgctgaggaagatcgcccagaatgaccatgacctgggggacatgagcacagtggccgaccccagcgtcatcagccacctgttcagccaccgctgcctgaccatccagtag

SEQ ID NO: 142538 - DNA, 2100 bp, Artificial Sequence
  Description of Artificial Sequence: Synthetic coding sequence
atgggcctgcctgaggagcgggtgcgcagcggcagcggcagccggggccaggaggaggccggggccggcggccgggcccgctcctggagccccccacctgaggtgagccgcagcgcccacgtgcccagcctgcagcgctaccgggagctgcaccggcgctctgtggaggagccccgggagttctggggagacatcgccaaggagttctactggaagaccccctgccccggccccttcctgcgctacaactttgatgtgaccaagggcaagatcttcatcgagtggatgaagggggccaccaccaacatctgctacaacgtgctggacagaaatgtgcatgagaagaagctgggggacaaggtggccttctactgggagggcaatgagcccggggagaccacccagatcacctaccaccagctgctggtgcaggtgtgccagttcagcaatgtgctgaggaagcagggcatccagaagggggacagagtggccatctacatgcccatgatccctgagctggtggtggccatgctggcctgtgccagaattggagccctgcacagcatcgtgtttgctggcttcagcagcgagagcctgtgtgagcgcatcctggacagcagctgcagcctgctgatcaccacagatgccttctacagaggagagaagctggtgaacctgaaggagctggctgatgaggccctgcagaagtgccaggagaagggcttccctgtgcgctgctgcatcgtggtgaagcacctgggccgggcagagctgggcatgggagacagcaccagccagagcccccccatcaagaggagctgcccagatgtgcagatctcctggaaccagggcatcgacctgtggtggcatgagctgatgcaggaggccggagatgaatgtgagcctgagtggtgtgatgctgagcacagcagcagctgcacccctgtggccccccaggccaacccccgggtgtggttcacccagctgggcgccacctgctacgtggccaccaccttcaagtatgtgtttgacttccacgccgaggatgtgttctggtgcacagctgacatcggctggatcaccggccacagctatgtgacctacggccccctggccaatggagccacctctgtgctgtttgagggcatccccacctacccagatgtgaaccggctgtggagcatcgtggacaagtacaaggtgaccaagttctacacagcccccacagccatccggctgctgatgaagtttggagatgagcctgtgaccaagcacagccgggccagcctgcaggtgctgggcaccgtgggggagcccatcaaccctgaggcctggctgtggtaccaccgggtggtgggcgcccagcgctgccccatcgtggacaccttctggcagacagagaccggcggccacatgctgacccccctgcccggggccacccccatgaagccaggcagcgccaccttccccttcttcggcgtggccccagccatcctgaatgaaagtggagaggagctggagggggaggccgagggctacctggtgttcaagcagccctggccaggcatcatgaggacagtgtatggcaaccacgagagatttgagaccacctacttcaagaagtttcctggctactacgtgactggagatggctgccagagggaccaggacggctactactggatcaccggcagaattgatgacatgctgaatgtgtctggccacctgctgagcacagctgaggtggagagcgccctggtggagcatgaagctgtggccgaggccgctgtggtgggccacccccaccctgtgaagggagaatgtctgtactgctttgtgaccctgtgtgatggccacaccttcagccccaagctgacagaggagctgaagaagcagatccgggagaagattggccccatcgccaccccagactacatccagaatgcccctggcctgcccaagaccaggtctgggaagatcatgagaagagtgctgaggaagatcgcccagaatgaccatgacctgggggacatgagcacagtggccgaccccagcgtcatcagccacctgttcagccaccgctgcctgaccatccagtag

SEQ ID NO: 142539 - DNA, 1230 bp, Artificial Sequence
  Description of Artificial Sequence: Synthetic coding sequence
atgcaggaggccggagatgaatgtgagcctgagtggtgtgatgctgaggaccccctcttcatcctgtacaccagcggcagcacaggcaagcccaagggcgtggtgcacacagtgggcggctacatgctgtatgtggccaccaccttcaagtatgtgtttgacttccacgccgaggatgtgttctggtgcacagctgacatcggctggatcaccggccacagctatgtgacctacggccccctggccaatggagccacctctgtgctgtttgagggcatccccacctacccagatgtgaaccggctgtggagcatcgtggacaagtacaaggtgaccaagttctacacagcccccacagccatccggctgctgatgaagtttggagatgagcctgtgaccaagcacagccgggccagcctgcaggtgctgggcaccgtgggggagcccatcaaccctgaggcctggctgtggtaccaccgggtggtgggcgcccagcgctgccccatcgtggacaccttctggcagacagagaccggcggccacatgctgacccccctgcccggggccacccccatgaagccaggcagcgccaccttccccttcttcggcgtggccccagccatcctgaatgaaagtggagaggagctggagggggaggccgagggctacctggtgttcaagcagccctggccaggcatcatgaggacagtgtatggcaaccacgagagatttgagaccacctacttcaagaagtttcctggctactacgtgactggagatggctgccagagggaccaggacggctactactggatcaccggcagaattgatgacatgctgaatgtgtctggccacctgctgagcacagctgaggtggagagcgccctggtggagcatgaagctgtggccgaggccgctgtggtgggccacccccaccctgtgaagggagaatgtctgtactgctttgtgaccctgtgtgatggccacaccttcagccccaagctgacagaggagctgaagaagcagatccgggagaagattggccccatcgccaccccagactacatccagaatgcccctggcctgcccaagaccaggtctgggaagatcatgagaagagtgctgaggaagatcgcccagaatgaccatgacctgggggacatgagcacagtggccgaccccagcgtcatcagccacctgttcagccaccgctgcctgaccatccagtag

SEQ ID NO: 142540 - DNA, 114 bp, Artificial Sequence
  Description of Artificial Sequence: Synthetic coding sequence
atgatggtgcgctgggccctgctgtgtggagaatgtcgcatcctgggccgccactgccagggcatcctgctggaggacagcatgccctggcccatccccagcgtgcagctgtag

SEQ ID NO: 142541 - DNA, 2061 bp, Artificial Sequence
  Description of Artificial Sequence: Synthetic coding sequence
atgaagcccagctggctgcagtgcaggaaggtgaccagcgctgggggcctgggcggccccctgcccggcagcagccctgcccggggggccggggccgccctgcgggccctggtggtgcccggcccccggggcggcctgggcggccggggctgccgggccctgagcagcggcagcggcagcgagtacaagacccactttgctgcctctgtgacagatcctgagcgcttctggggcaaggctgctgagcagatctcctggtacaagccctggaccaagaccctggagaacaagcacagccccagcacccgctggtttgtggagggcatgctgaacatctgctacaatgctgtggacagacacattgaaaatggaaaaggagacaagatcgccatcatctatgacagccctgtgaccaacaccaaggccaccttcacctacaaggaggtgctggagcaggtgtccaagctggccggcgtgctggtgaagcacggcatcaagaagggggacacagtggtgatctacatgcccatgatcccccaggccatgtacaccatgctggcctgtgccagaattggagccatccacagcctcatctttggaggctttgccagcaaggagctgagcagcagaattgaccacgtgaagcccaaggtggtggtgacagccagctttggcatcgagcccggccggcgggtggagtatgtgcccctggtggaggaggccctgaagattggccagcacaagccagacaagatcctgatctacaaccggcccaacatggaggccgtgcccctggcccctggccgggacctggactgggatgaggagatggccaaggcccagagccatgactgtgtgcctgtgctgtctgagcaccccctgtacatcctgtacaccagcggcaccaccggcctgcccaagggcgtcatccggcccactggaggctatgctgtgatgctgcactggagcatgagcagcatctacggcctgcagcccggggaggtgtggtgggccgccagtgacctgggctgggtggtgggccacagctacatctgctacggccccctgctgcacggcaacaccaccgtgctgtatgagggcaagcctgtgggcaccccagatgctggggcctacttccgggtgctggccgagcacggcgtggccgccctcttcaccgcccccacagccatccgggccatccggcagcaggaccctggagctgccctgggcaagcagtacagcctgacccgcttcaagaccctgtttgtggccggggagcgctgtgatgtggagaccctggagtggagcaagaatgtgttccgggtgcctgtgctggaccactggtggcagacagaaacaggcagccccatcacagccagctgtgtgggcctgggcaacagcaagaccccacctcctggccaggccggcaagtctgtgcccggctacaacgtgatgatcctggatgacaacatgcagaagctgaaggcccgctgcctgggcaacatcgtggtgaagctgcccctgcccccaggggccttcagcggcctgtggaagaaccaggaggccttcaagcacctgtactttgagaagtttcctggctactatgacaccatggatgctggctacatggatgaggagggctacctgtatgtgatgagccgggtggatgatgtgatcaacgtggccggccaccgcatctctgctggggccatcgaggagagcatcctgagccacggcaccgtggccgactgtgctgtggtgggcaaggaggaccccctgaagggccacgtgcccctggccctgtgtgtgctgaggaaggacatcaatgccacagaggagcaggtgctggaggagatcgtgaagcacgtgcggcagaacatcggccctgtggccgccttcagaaatgctgtgtttgtgaagcagctgcccaagaccaggtctgggaagatccccaggtctgccctgagcgccatcgtgaatggcaagccctacaagatcaccagcaccatcgaggaccccagcatcttcggccacgtggaggagatgctgaagcaggcctag

SEQ ID NO: 142542 - DNA, 1107 bp, Artificial Sequence
  Description of Artificial Sequence: Synthetic coding sequence
atgctgcactggagcatgagcagcatctacggcctgcagcccggggaggtgtggtgggccgccagtgacctgggctgggtggtgggccacagctacatctgctacggccccctgctgcacggcaacaccaccgtgctgtatgagggcaagcctgtgggcaccccagatgctggggcctacttccgggtgctggccgagcacggcgtggccgccctcttcaccgcccccacagccatccgggccatccggcagcaggaccctggagctgccctgggcaagcagtacagcctgacccgcttcaagaccctgtttgtggccggggagcgctgtgatgtggagaccctggagtggagcaagaatgtgttccgggtgcctgtgctggaccactggtggcagacagaaacaggcagccccatcacagccagctgtgtgggcctgggcaacagcaagaccccacctcctggccaggccggcaagtctgtgcccggctacaacgtgatgatcctggatgacaacatgcagaagctgaaggcccgctgcctgggcaacatcgtggtgaagctgcccctgcccccaggggccttcagcggcctgtggaagaaccaggaggccttcaagcacctgtactttgagaagtttcctggctactatgacaccatggatgctggctacatggatgaggagggctacctgtatgtgatgagccgggtggatgatgtgatcaacgtggccggccaccgcatctctgctggggccatcgaggagagcatcctgagccacggcaccgtggccgactgtgctgtggtgggcaaggaggaccccctgaagggccacgtgcccctggccctgtgtgtgctgaggaaggacatcaatgccacagaggagcaggtgctggaggagatcgtgaagcacgtgcggcagaacatcggccctgtggccgccttcagaaatgctgtgtttgtgaagcagctgcccaagaccaggtctgggaagatccccaggtctgccctgagcgccatcgtgaatggcaagccctacaagatcaccagcaccatcgaggaccccagcatcttcggccacgtggaggagatgctgaagcaggcctag

SEQ ID NO: 142543 - DNA, 1266 bp, Artificial Sequence
  Description of Artificial Sequence: Synthetic coding sequence
atggccgccaccctcatcctggagcccgccggccgctgctgctgggatgagcctgtgagaattgctgtgcggggcctggcccctgagcagcctgtgaccctgcgggccagcctgagagatgagaagggggccctcttccaggcccacgcccgctacagagctgacaccctgggggagctggacctggagcgggccccagccctgggcggcagctttgctggcctggagcccatgggcctgctgtgggccctggagcctgagaagcccctggtgcggctggtgaagagagatgtgaggacccccctggccgtggagctggaggtgctggatggccatgaccctgaccccggccgcctgctgtgccgggtgagacatgagcgctacttcctgcccccaggagtgagaagagagcctgtgcgggccggccgggtgcggggcaccctcttcctgcccccagagcccggccccttccctggcatcgtggacatgtttggcaccggcggcggcctgctggagtaccgggccagcctgctggccgggaaaggatttgctgtgatggccctggcctactacaactatgaggacctgcccaagaccatggagaccctgcacctggagtactttgaggaggccgtgaactacctgctgagccaccctgaggtgaagggccctggggtgggcctgctgggcatcagcaaaggaggagagctgtgcctgtccatggccagcttcctgaagggcatcacagctgctgtggtgatcaatggatctgtggccaacgtgggcggcaccctgcgctacaagggggagaccctgccccctgtgggcgtgaacagaaaccgcatcaaggtgaccaaggatggctacgccgacatcgtggatgtgctgaacagccccctggagggccctgaccagaagagcttcatccctgtggagcgggcagagagcaccttcctgttcctggtgggccaggatgaccacaactggaagtctgagttctacgccaatgaggcctgcaagaggctgcaggcccatggaagaaggaagccccagatcatctgctacccagagaccggccactacatcgagcccccctacttccccctgtgccgggccagcctgcacgccctggtgggcagccccatcatctggggcggggagccccgggcccacgccatggcccaggtggatgcctggaagcagctgcagaccttcttccacaagcacctgggcggccacgagggcaccatccccagcaaggtgtag

SEQ ID NO: 142544 - DNA, 1785 bp, Artificial Sequence
  Description of Artificial Sequence: Synthetic coding sequence
atgatccagaatgtgggcaaccacctgcggcggggcctggcctctgtgttcagcaacagaaccagcaggaagagcgccctgcgggctggaaatgattctgccatggctgatggagagggctacagaaaccccacagaggtgcagatgagccagctggtgctgccctgccacaccaaccagagaggagagctgtctgtgggccagctgctgaagtggattgacaccacagcctgcctgtctgctgagagacatgctggctgcccctgtgtgacagcctccatggatgacatctactttgagcacaccatctctgtgggccaggtggtgaacatcaaggccaaggtgaacagagccttcaacagctccatggaggtgggcatccaggtggccagcgaggacctgtgcagcgagaagcagtggaatgtgtgcaaggccctggccacctttgtggcccggcgggagatcaccaaggtgaagctgaagcagatcacccccaggacagaggaggagaagatggagcacagcgtggccgctgagaggaggaggatgaggctggtgtatgctgacaccatcaaggacctgctggccaactgtgccatccagggcgacctggagagccgggactgcagcaggatggtgcctgctgagaagaccagggtggagagcgtggagctggtgctgcccccccacgccaaccaccagggcaacaccttcggcggccagatcatggcctggatggagaatgtggccaccatcgccgccagccggctgtgccgggcccaccccaccctgaaggccatcgagatgttccacttccggggccccagccaggtgggggaccggctggtgctgaaggccatcgtgaacaatgccttcaagcacagcatggaggtgggcgtgtgtgtggaggcctaccggcaggaggccgagacccacagaagacacatcaacagcgccttcatgacctttgtggtgctggatgctgatgaccagccccagctgctgccctggatccggccccagcctggagatggagagcggcgctaccgggaggccagcgccaggaagaagatccggctggacaggaagtacatcgtgtcctgcaagcagacagaggtgcccctgtctgtgccctgggaccccagcaaccaggtgtacctgagctacaacaacgtgagcagcctgaagatgctggtggccaaggacaactgggtgctgagcagcgagatcagccaggtgcggctgtacaccctggaggatgacaagttcctgtccttccacatggagatggtggtgcacgtggatgctgcccaggccttcctgctgctgagtgacctgcggcagaggcctgagtgggacaagcactacagatctgtggagctggtgcagcaggtggatgaagatgatgccatctaccacgtgaccagccctgccctgggcggccacaccaagccccaggactttgtgatcctggccagcaggaggaagccctgtgacaacggggacccctacgtgattgccctgcggtctgtgaccctgcccacccaccgggagaccccagagtacagaagaggagagaccctgtgcagcggcttctgcctgtggagggagggggaccagctgaccaaggtgtcctactacaaccaggccaccccaggagtgctgaactacgtgaccaccaacgtggccggcctgagcagcgagttctacaccaccttcaaggcctgtgagcagttcctgctggacaacagaaatgacctggcccccagcctgcagaccctgtag

SEQ ID NO: 142545 - DNA, 1824 bp, Artificial Sequence
  Description of Artificial Sequence: Synthetic coding sequence
atgatccagaatgtgggcaaccacctgcggcggggcctggcctctgtgttcagcaacagaaccagcaggaagagcgccctgcgggctggaaatgattctgccatggctgatggagagggctacagaaaccccacagaggtgcagatgagccagctggtgctgccctgccacaccaaccagagaggagagctgtctgtgggccagctgctgaagtggattgacaccacagcctgcctgtctgctgagagacatgctggctgcccctgtgtgacagcctccatggatgacatctactttgagcacaccatctctgtgggccaggtggtgaacatcaaggccaaggtgaacagagccttcaacagctccatggaggtgggcatccaggtggccagcgaggacctgtgcagcgagaagcagtggaatgtgtgcaaggccctggccacctttgtggcccggcgggagatcaccaaggtgaagctgaagcagatcacccccaggacagaggaggagaagatggagcacagcgtggccgctgagaggaggaggatgaggctggtgtatgctgacaccatcaaggacctgctggccaactgtgccatccagggcgacctggagagccgggactgcagcaggatggtgcctgctgagaagaccagggtggagagcgtggagctggtgctgcccccccacgccaaccaccagggcaacaccttcggcggccagatcatggcctggatggagaatgtggccaccatcgccgccagccggctgtgccgggcccaccccaccctgaaggccatcgagatgttccacttccggggccccagccaggtgggggaccggctggtgctgaaggccatcgtgaacaatgccttcaagcacagcatggaggtgggcgtgtgtgtggaggcctaccggcaggaggccgagacccacagaagacacatcaacagcgccttcatgacctttgtggtgctggatgctgatgaccagccccagctgctgccctggatccggccccagcctggagatggagagcggcgctaccgggaggccagcgccaggaagaagatccggctggacaggaagtacatcgtgtcctgcaagcagacagaggtgcccctgtctgtgccctgggaccccagcaaccaggtgtacctgagctacaacaacgtgagcagcctgaagatgctggtggccaaggacaactgggtgctgagcagcgagatcagccaggtgcggctgtacaccctggaggatgacaagttcctgtccttccacatggagatggtggtgcacgtggatgctgcccaggccttcctgctgctgagtgacctgcggcagaggcctgagtgggacaagcactacagatctgtggagctggtgcagcaggtggatgaagatgatgccatctaccacgtgaccagccctgccctgggcggccacaccaagccccaggactttgtgatcctggccagcaggaggaagccctgtgacaacggggacccctacgtgattgccctgcggtctgtgaccctgcccacccaccgggagaccccagagtacagaagaggagagaccctgtgcagcggcttctgcctgtggagggagggggaccagctgaccaagtgctgctgggtgcgggtgtccctgacagagctggtgtctgccagcggcttctacagctggggcctggagagccgcagcaagggccgccgcagtgatggctggaatggcaagctggccggcggccacctgagcaccctgaaggccatccctgtggccaagatcaacagcagatttggctacctgcaggacacctag

SEQ ID NO: 142546 - DNA, 1668 bp, Artificial Sequence
  Description of Artificial Sequence: Synthetic coding sequence
atggagaggcctgcccctggagaggtggtgatgagccaggccatccagcctgcccacgccacagcccggggggagctgtctgctggccagctgctgaagtggattgacaccacagcctgcctggccgctgagaagcatgctggggtgtcctgtgtgacagcctctgtggatgacatccagtttgaggagacagcccgggtgggccaggtgatcaccatcaaggccaaggtgacccgggccttcagcacctccatggagatcagcatcaaggtgatggtgcaggacatgctgaccggcatcgagaagctggtgtctgtggccttcagcacctttgtggccaagcctgtgggcaaggagaagatccacctgaagcctgtgaccctgctgacagagcaggaccacgtggagcacaacctggccgctgagaggaggaaggtgcggctgcagcacgaggacaccttcaacaacctgatgaaggagagcagcaagtttgatgacctgatctttgatgaggaggagggcgctgtgtccacccggggcacctctgtgcagagcattgagctggtgctgccccctcatgccaaccaccacggcaacacctttggaggccagatcatggcctggatggagaccgtggccaccatcagcgccagccggctgtgctgggcccaccccttcctgaagtctgtggacatgttcaagttccggggccccagcacagtgggggaccggctggtgttcaccgccatcgtgaacaacaccttccagacctgtgtggaggtgggcgtgcgggtggaggcctttgactgccaggagtgggccgagggccggggccgccacatcaacagcgccttcctgatctacaatgctgctgatgacaaggaaaatctcatcaccttcccccgcatccagcccatcagcaaggatgacttccgccgctacagaggagccatcgccaggaagaggatccggctgggcaggaaatatgtgatcagccacaaggaggaggtgcccctgtgcatccactgggacatcagcaagcaggccagcctgagtgacagcaatgtggaggccctgaagaagctggccgccaagaggggctgggaggtgaccagcacagtggagaagatcaagatctacaccctggaggagcatgatgtgctgtctgtgtgggtggagaagcacgtgggcagccctgcccacctggcctaccgcctgctgagtgacttcaccaagaggcccctgtgggacccccactttgtgtcctgtgaggtgattgactgggtgtctgaagatgaccagctgtaccacatcacctgccccatcctgaatgatgacaagcccaaggacctggtggtgctggtgtccaggaggaagcccctgaaggatggcaacacctacacagtggccgtgaagagcgtcatcctgcccagcgtgccccccagcccccagtacatccgctctgagatcatctgtgccggcttcctgatccacgccatcgacagcaacagctgcatcgtgtcctacttcaaccacatgtctgccagcatcctgccctactttgctggcaacctgggcggctggagcaagagcattgaggagacagctgccagctgcatccagttcctggagaaccccccagatgatggctttgtgtccaccttctag

SEQ ID NO: 142547 - DNA, 1452 bp, Artificial Sequence
  Description of Artificial Sequence: Synthetic coding sequence
atgagcaacaagctgctgagcccccacccccacagcgtggtgctgcggtctgagttcaagatggccagcagccctgctgtgctgcgggccagccggctgtaccagtggagcctgaagagcagcgcccagttcctgggcagcccccagctgcggcaggtgggccagatcatccgggtgcctgccaggatggccgccaccctcatcctggagcccgccggccgctgctgctgggatgagcctgtgagaattgctgtgcggggcctggcccctgagcagcctgtgaccctgcgggccagcctgagagatgagaagggggccctcttccaggcccacgcccgctacagagctgacaccctgggggagctggacctggagcgggccccagccctgggcggcagctttgctggcctggagcccatgggcctgctgtgggccctggagcctgagaagcccctggtgcggctggtgaagagagatgtgaggacccccctggccgtggagctggaggtgctggatggccatgaccctgaccccggccgcctgctgtgccagaccaggcatgagcgctacttcctgcccccaggagtgagaagagagcctgtgcgggtgggccgggtgcggggcaccctcttcctgcccccagagcccggccccttccctggcatcgtggacatgtttggcaccggcggcggcctgctggagtaccgggccagcctgctggccgggaaaggatttgctgtgatggccctggcctactacaactatgaggacctgcccaagaccatggagaccctgcacctggagtactttgaggaggccatgaactacctgctgagccaccctgaggtgaagggccctggggtgggcctgctgggcatcagcaaaggaggagagctgtgcctgtccatggccagcttcctgaagggcatcacagctgctgtggtgatcaatggatctgtggccaacgtgggcggcaccctgcactacaagggggagaccctgccccctgtgggcgtgaacagaaaccgcatcaaggtgaccaaggatggctacgccgacatcgtggatgtgctgaacagccccctggagggccctgaccagaagagcttcatccctgtggagcgggcagagagcaccttcctgttcctggtgggccaggatgaccacaactggaagtctgagttctacgccaatgaggcctgcaagaggctgcaggcccatggaagaaggaagccccagatcatctgctacccagagaccggccactacatcgagcccccctacttccccctgtgccgggccagcctgcacgccctggtgggcagccccatcatctggggcggggagccccgggcccacgccatggcccaggtggatgcctggaagcagctgcagaccttcttccacaagcacctgggcggccacgagggcaccatccccagcaaggtgtag

SEQ ID NO: 142548 - DNA, 1266 bp, Artificial Sequence
  Description of Artificial Sequence: Synthetic coding sequence
atgtctgccaccctcatcctggagcccccaggccgctgctgctggaatgaacctgtgagaattgctgtgcggggcctggcccctgagcagagggtgaccctgcgggccagcctgagagatgagaagggggccctcttccgggcccacgcccgctactgtgctgatgcccggggggagctggacctggagcgggccccagccctgggcggcagctttgctggcctggagcccatgggcctgctgtgggccctggagcctgagaagcccttctggaggttcctgaagagagatgtgcagatcccctttgtggtggagctggaggtgctggatggccatgaccctgagcccggccgcctgctgtgccaggcccagcacgagcggcacttcctgcccccaggagtgcggcggcagagcgtgcgggccggccgggtgcgggccaccctcttcctgcccccaggccctggccccttccctggcatcatcgacatcttcggcatcggcggcggcctgctggagtaccgggccagcctgctggccggccacggctttgccaccctggccctggcctactacaactttgaggacctgcccaacaacatggacaacatcagcctggagtactttgaggaggccgtgtgctacatgctgcagcacccccaggtgaagggccctggcatcggcctgctgggcatcagcctgggcgctgacatctgcctgtccatggccagcttcctgaagaatgtgtctgccaccgtgtccatcaatggaagtggcatcagcggcaacacagccatcaactacaagcacagcagcatcccccccctgggctatgacctgcggcgcatcaaggtggccttcagcggcctggtggacatcgtggacatcagaaatgccctggtgggcggctacaagaaccccagcatgatccccatcgagaaggcccagggccccatcctgctgattgtgggccaggatgaccacaactggaggtctgagctgtatgcccagacagtgtctgagcggctgcaggcccacggcaaggagaagccccagatcatctgctacccaggcaccggccactacatcgagcccccctacttccccctgtgcccagccagcctgcaccggctgctgaacaagcacgtgatctggggcggggagccccgggcccacagcaaggcccaggaggatgcctggaagcagatcctggccttcttctgcaagcacctgggcggcacccagaagacagctgtgcccaagctgtag

SEQ ID NO: 142549 - DNA, 624 bp, Artificial Sequence
  Description of Artificial Sequence: Synthetic coding sequence
atgctgcagcaccccaaggtgaagggccccagcatcgccctgctgggcttcagcaaaggaggagacctgtgcctgtccatggccagcttcctgaagggcatcacagccaccgtgctgatcaatgcctgtgtggccaacacagtggcccccctgcactacaaggacatgatcatccccaagctggtggatgacctgggcaaggtgaagatcaccaagagcggcttcctgaccttcatggacacctggagcaaccccctggaggagcacaaccaccagagcctggtgcccctggagaaggcccaggtgcccttcctgttcatcgtgggcatggatgaccagagctggaagtctgagttctacgcccagatcgccagcgagcggctgcaggcccacggcaaggagcggccccagatcatctgctacccagagaccggccactgcatcgaccccccctacttcccccccagccgggcctctgtgcatgctgtgctgggggaggccatcttctacggcggggagcccaaggcccacagcaaggcccaggtggatgcctggcagcagatccagaccttcttccacaagcacctgaatggcaagaagtctgtgaagcacagcaagatctag

SEQ ID NO: 142550 - DNA, 507 bp, Artificial Sequence
  Description of Artificial Sequence: Synthetic coding sequence
atgctgcagcaccccaaggtgaagggccccagcatcgccctgctgggcttcagcaaaggaggagacctgtgcctgtccatggccagcttcctgaagggcatcacagccaccgtgctgatcaatgcctgtgtggccaacacagtggcccccctgcactacaaggacatgatcatccccaagctggtggatgacctgggcaaggtgaagatcaccaagagcggcttcctgaccttcatggacacctggagcaaccccctggaggagcacaaccaccagagcctggtgcccctggagaaggcccaggtgcccttcctgttcatcgtgggcatggatgaccagagctggaagtctgagttctacgcccagatcgccagcgagcggctgcaggcccacggcaaggagcggccccagatcatctgctacccagagaccggccactgcatcgaccccccctacttcccccccagccgggcctctgtgcatgctgtgctgggggaggccatctag

SEQ ID NO: 142551 - DNA, 1113 bp, Artificial Sequence
  Description of Artificial Sequence: Synthetic coding sequence
atggcccggcccggcctcatccacagcgcccctggcctgcctgacacctgtgccctgctgcagcccccagctgccagcgctgctgctgcccccagcatgagcggcccagatgtggagacccccagcgccatccagatctgccgcatcatgaggccagatgatgccaacgtggccggaaatgtgcacggcggcaccatcctgaagatgattgaggaggccggggccatcatcagcaccaggcactgcaacagccagaatggagagcgctgtgtggccgccctggcccgggtggagaggacagacttcctgagccccatgtgcatcggggaggtggcccacgtgtctgctgagatcacctacaccagcaagcacagcgtggaggtgcaggtgaatgtgatgtctgagaacatcctgactggagccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcacggcggcgtgaccatgaagctgatggatgaggtggccggcatcgtggccgcccggcactgcaagaccaacatcgtgacagcctctgtggatgccatcaacttccatgacaagatcaggaagggctgcgtcatcaccatcagcggccgcatgaccttcaccagcaacaagtccatggagattgaggtgctggtggatgctgaccctgtggtggacagcagccagaagcgctacagagctgccagcgccttcttcacctacgtgtccctgagccaggagggccgcagcctgcctgtgccccagctggtgcctgagacagaagatgagaagaagagatttgaggagggcaagggccgctacctgcagatgaaggccaagaggcagggccacgccgagccccagccctag

SEQ ID NO: 142552 - DNA, 990 bp, Artificial Sequence
  Description of Artificial Sequence: Synthetic coding sequence
atggccttccagctgagccgcatcatgaggccagatgatgccaacgtggccggaaatgtgcatggaggcaccatcctgaagatgattgaggaggccggggccatcatcagcaccaggcactgcaacagccagaatggagagcgctgtgtggccgccctggcccgggtggagaggacagacttcctgagccccatgtgcattggagaggtggcccacgtgtctgctgagatcacctacaccagcaagcacagcgtggaggtgcaggtgaatgtgatgtctgagaacatcctgaccggggccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcatggaggagtgaccatgaagctgatggatgaggtggccggcatcgtggccgcccggcactgcaagaccaacatcgtgacagcctctgtggatgccatcaacttccatgacaagatcaggaagggctgtgtgatcaccatcagcggccgcatgaccttcaccagcaacaagtccatggagattgaggtgctggtggatgctgaccctgtggtggacagcagccagaagcgctaccgggccgccagcgccttcttcacctacgtgtccctgagccaggagggccgcagcctgcctgtgccccagctggtgcctgagacagaagatgagaagaagagatttgaggagggcaagggccgctacctgcagatgaaggccaagaggcagggccatgctgagccccagccctag

SEQ ID NO: 142553 - DNA, 1053 bp, Artificial Sequence
  Description of Artificial Sequence: Synthetic coding sequence
atgctgctgctgcggcgcagcctgagcctgaatgtgctgaggaaggaggtggaccgggcctgcttcggggagaaggccaagcagatcatgaggccagatgatgccaacgtggccggaaatgtgcacggcggcaccatcctgaagatgattgaggaggccggggccatcatcagcaccaggcactgcaacagccagaatggagagcgctgtgtggccgccctggcccgggtggagaggacagacttcctgagccccatgtgcatcggggaggtggcccacgtgtctgctgagatcacctacaccagcaagcacagcgtggaggtgcaggtgaatgtgatgtctgagaacatcctgactggagccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcacggcggcgtgaccatgaagctgatggatgaggtggccggcatcgtggccgcccggcactgcaagaccaacatcgtgacagcctctgtggatgccatcaacttccatgacaagatcaggaagggctgcgtcatcaccatcagcggccgcatgaccttcaccagcaacaagtccatggagattgaggtgctggtggatgctgaccctgtggtggacagcagccagaagcgctacagagctgccagcgccttcttcacctacgtgtccctgagccaggagggccgcagcctgcctgtgccccagctggtgcctgagacagaagatgagaagaagagatttgaggagggcaagggccgctacctgcagatgaaggccaagaggcagggccacgccgagccccagccctag

SEQ ID NO: 142554 - DNA, 1143 bp, Artificial Sequence
  Description of Artificial Sequence: Synthetic coding sequence
atgaagctgctggcccgggccctgcggctgtgtgaatttggccggcaggccagcagccggcggctggtggccggccagggctgtgtgggcccccggcggggctgctgtgcccctgtgcaggtggtgggccccagggctgacctgcccccctgtggggcctgcatcaccggccgcatcatgaggccagatgatgccaacgtggccggaaatgtgcacggcggcaccatcctgaagatgattgaggaggccggggccatcatcagcaccaggcactgcaacagccagaatggagagcgctgtgtggccgccctggcccgggtggagaggacagacttcctgagccccatgtgcatcggggaggtggcccacgtgtctgctgagatcacctacaccagcaagcacagcgtggaggtgcaggtgaatgtgatgtctgagaacatcctgactggagccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcacggcggcgtgaccatgaagctgatggatgaggtggccggcatcgtggccgcccggcactgcaagaccaacatcgtgacagcctctgtggatgccatcaacttccatgacaagatcaggaagggctgcgtcatcaccatcagcggccgcatgaccttcaccagcaacaagtccatggagattgaggtgctggtggatgctgaccctgtggtggacagcagccagaagcgctacagagctgccagcgccttcttcacctacgtgtccctgagccaggagggccgcagcctgcctgtgccccagctggtgcctgagacagaagatgagaagaagagatttgaggagggcaagggccgctacctgcagatgaaggccaagaggcagggccacgccgagccccagccctag

SEQ ID NO: 142555 - DNA, 672 bp, Artificial Sequence
  Description of Artificial Sequence: Synthetic coding sequence
atgctgctgctgcggcgcagcctgagcctgaatgtgctgaggaaggaggtggaccgggcctgcttcggggagaaggccaagcagatcatgaggccagatgatgccaacgtggccggaaatgtgcacggcggcaccatcctgaagatgattgaggaggccggggccatcatcagcaccaggcactgcaacagccagaatggagagcgctgtgtggccgccctggcccgggtggagaggacagacttcctgagccccatgtgcatcggggaggtggcccacgtgtctgctgagatcacctacaccagcaagcacagcgtggaggtgcaggtgaatgtgatgtctgagaacatcctgactggagccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcacggcggcggcgtggacttccactag

SEQ ID NO: 142556 - DNA, 798 bp, Artificial Sequence
  Description of Artificial Sequence: Synthetic coding sequence
atgtgcattggagaggtggcccacgtgtctgctgagatcacctacaccagcaagcacagcgtggaggtgcaggtgaatgtgatgtctgagaacatcctgaccggggccaagaagctgaccaacaaggccaccctgtggtacgtgcccctgagcctgaagaatgtggacaaggtgctggaggtgccccctgtggtgtacagccggcaggagcaggaggaggagggcaggaagagatatgaggcccagaagctggagaggatggagaccaagtggagaaatggagacatcgtgcagcctgtgctgaaccctgagcccaacacagtgtcctacagccagagcagcctcatccacctggtgggccccagcgactgcaccctgcacggctttgtgcatggaggagtgaccatgaagctgatggatgaggtggccggcatcgtggccgcccggcactgcaagaccaacatcgtgacagcctctgtggatgccatcaacttccatgacaagatcaggaagggctgtgtgatcaccatcagcggccgcatgaccttcaccagcaacaagtccatggagattgaggtgctggtggatgctgaccctgtggtggacagcagccagaagcgctaccgggccgccagcgccttcttcacctacgtgtccctgagccaggagggccgcagcctgcctgtgccccagctggtgcctgagacagaagatgagaagaagagatttgaggagggcaagggccgctacctgcagatgaaggccaagaggcagggccatgctgagccccagccctag

SEQ ID NO: 142557 - DNA, 1308 bp, Artificial Sequence
  Description of Artificial Sequence: Synthetic coding sequence
atggccgcccccctggtgctggtgctggtggtggccgtgacagtgcgggccgccctcttccgcagcagcctggccgagttcatcagcgagcgggtggaggtggtgagccccctgagctcctggaagagggtggtggagggcctgagcctgctggacctgggcgtgagcccctacagcggggctgtgttccacgagacccccctcatcatctacctgttccacttcctgattgattatgcagagctggtgttcatgatcacagatgccctgacagccatcgccctgtactttgccatccaggacttcaacaaggtggtgttcaagaagcagaagctgctgctggagctggaccagtatgccccagatgtggccgagctgatccgcacccccatggagatgagatacatccccctgaaggtggccctcttctacctgctgaacccctacaccatcctgagctgtgtggccaagagcacctgtgccatcaacaacaccctgattgccttcttcatcctgaccaccatcaagggcagcgccttcctgagcgccatcttcctggccctggccacctaccagagcctgtaccccctgaccctgtttgtgcccggcctgctgtacctgctgcagaggcagtacatccctgtgaagatgaagagcaaggccttctggatcttctcctgggagtatgccatgatgtatgtgggcagcctggtggtgatcatctgcctgtccttcttcctgctgagctcctgggacttcatcccagctgtgtatggcttcatcctgtctgtgcctgacctgacccccaacatcggcctcttctggtacttctttgctgagatgtttgagcacttcagcctcttctttgtgtgtgtgttccagatcaacgtgttcttctacaccatccccctggccatcaagctgaaggagcaccccatcttcttcatgttcatccagattgctgtgattgccatcttcaagagctaccccaccgtgggagatgtggccctgtacatggccttcttccctgtgtggaaccacctgtaccgcttcctgaggaacatctttgtgctgacctgcatcatcatcgtgtgcagcctgctcttccctgtgctgtggcacctgtggatctatgccggcagcgccaacagcaacttcttctacgccatcaccctgaccttcaacgtgggccagatcctgctgatcagtgactacttctacgccttcctgcggcgggagtactacctgacccacggcctgtacctgacagccaaggatggaacagaggccatgctggtgctgaagtag

SEQ ID NO: 142558 - DNA, 342 bp, Artificial Sequence
  Description of Artificial Sequence: Synthetic coding sequence
atgagcagcccccaggccccagaagatggccagggctgtggggacagaggagaccccccaggggacctgcggtctgtgctggtgaccaccgtgctgaacctggagcccctggatgaagatctcttccggggccgccactactgggtgcctgccaagaggctgtttggaggccagatcgtgggccaggccctggtggccgccgccaagtctgtgtctgaagatgtgcacgtgcacagcctgcactgctactttgtgcgggcagagcagatgcccagctgtgtgctgcggcgcagccctgctgagaagagcctgtggaccttcaccgtgtgtgacctgtactag

SEQ ID NO: 142559 - DNA, 1320 bp, Artificial Sequence
  Description of Artificial Sequence: Synthetic coding sequence
atgaggcgggccgccctgcggctgtgtgccctgggcaagggccagctgaccccaggccggggcctgacccagggcccccagaaccccaagaagcagggcatcttccacatccacgaggtgcgggacaagctgcgggagatcgtgggcgccagcaccaactggagggaccacgtgaaggccatggaggagaggaagctgctgcacagcttcctggccaagagccaggacggcctgccccccaggaggatgaaggacagctacatcgaggtgctgctgcccctgggcagcgagcctgagctgcgggagaagtacctgactgtgcagaacacagtgcgcttcggccgcatcctggaggacctggacagcctgggcgtgctgatctgctacatgcacaacaagatccacagcgccaagatgagccccctgagcatcgtgacagccctggtggacaagattgacatgtgcaagaagagcctgagccctgagcaggacatcaagttcagcggccacgtgtcctgggtgggcaagacctccatggaggtgaagatgcagatgttccagctgcatggagatgagttctgccctgtgctggatgccacctttgtgatggtggcccgggacagtgaaaataaaggacctgcctttgtgaaccccctcatccctgagagccctgaggaggaggagctgttccggcagggcgagctgaacaagggcagaagaattgccttcagcagcaccagcctgctgaagatggcccccagcgctgaggagaggaccaccatccacgagatgttcctgagcaccctggaccccaagaccatctccttccgcagccgggtgctgcccagcaatgctgtgtggatggagaacagcaagctgaagagcctggagatctgccacccccaggagaggaacatcttcaaccgcatctttggaggcttcctgatgaggaaggcctatgagctggcctgggccacagcctgcagctttggaggcagccggccctttgtggtggccgtggatgacatcatgttccagaagcctgtggaggtgggcagcctgctcttcctgagcagccaggtgtgcttcacccagaacaactacatccaggtgcgggtgcacagcgaggtggccagcctgcaggagaagcagcacaccaccaccaacgtgttccacttcaccttcatgtctgagaaggaggtgcccctggtgttccccaagacctatggagagagcatgctgtacctggatggccagaggcacttcaacagcatgagcggccctgccaccctgaggaaggactacctggtggagccctag

SEQ ID NO: 142560 - DNA, 1140 bp, Artificial Sequence
  Description of Artificial Sequence: Synthetic coding sequence
atggaggagaggaagctgctgcacagcttcctggccaagagccaggacggcctgccccccaggaggatgaaggacagctacatcgaggtgctgctgcccctgggcagcgagcctgagctgcgggagaagtacctgactgtgcagaacacagtgcgcttcggccgcatcctggaggacctggacagcctgggcgtgctgatctgctacatgcacaacaagatccacagcgccaagatgagccccctgagcatcgtgacagccctggtggacaagattgacatgtgcaagaagagcctgagccctgagcaggacatcaagttcagcggccacgtgtcctgggtgggcaagacctccatggaggtgaagatgcagatgttccagctgcatggagatgagttctgccctgtgctggatgccacctttgtgatggtggcccgggacagtgaaaataaaggacctgcctttgtgaaccccctcatccctgagagccctgaggaggaggagctgttccggcagggcgagctgaacaagggcagaagaattgccttcagcagcaccagcctgctgaagatggcccccagcgctgaggagaggaccaccatccacgagatgttcctgagcaccctggaccccaagaccatctccttccgcagccgggtgctgcccagcaatgctgtgtggatggagaacagcaagctgaagagcctggagatctgccacccccaggagaggaacatcttcaaccgcatctttggaggcttcctgatgaggaaggcctatgagctggcctgggccacagcctgcagctttggaggcagccggccctttgtggtggccgtggatgacatcatgttccagaagcctgtggaggtgggcagcctgctcttcctgagcagccaggtgtgcttcacccagaacaactacatccaggtgcgggtgcacagcgaggtggccagcctgcaggagaagcagcacaccaccaccaacgtgttccacttcaccttcatgtctgagaaggaggtgcccctggtgttccccaagacctatggagagagcatgctgtacctggatggccagaggcacttcaacagcatgagcggccctgccaccctgaggaaggactacctggtggagccctag

SEQ ID NO: 142561 - DNA, 1347 bp, Artificial Sequence
  Description of Artificial Sequence: Synthetic coding sequence
atgaggcgggccgccctgcggctgtgtgccctgggcaagggccagctgaccccaggccggggcctgacccagggcccccagaaccccaagaagcagggcatcttccacatccacgaggcctgcagcagcatccacgtgaaccacgtgcgggacaagctgcgggagatcgtgggcgccagcaccaactggagggaccacgtgaaggccatggaggagaggaagctgctgcacagcttcctggccaagagccaggacggcctgccccccaggaggatgaaggacagctacatcgaggtgctgctgcccctgggcagcgagcctgagctgcgggagaagtacctgactgtgcagaacacagtgcgcttcggccgcatcctggaggacctggacagcctgggcgtgctgatctgctacatgcacaacaagatccacagcgccaagatgagccccctgagcatcgtgacagccctggtggacaagattgacatgtgcaagaagagcctgagccctgagcaggacatcaagttcagcggccacgtgtcctgggtgggcaagacctccatggaggtgaagatgcagatgttccagctgcatggagatgagttctgccctgtgctggatgccacctttgtgatggtggcccgggacagcgagaacaagggccctgcctttgtgaaccccctcatccctgagagccctgaggaggaggagctgttccggcagggcgagctgaacaagggccgccgcatcgccttcagcagcaccagcctgctgaagatggcccccagcgctgaggagaggaccaccatccacgagatgttcctgagcaccctggaccccaagaccatctccttccgcagccgggtgctgcccagcaatgctgtgtggatggagaacagcaagctgaagagcctggagatctgccacccccaggagaggaacatcttcaaccgcatctttggaggcttcctgatgaggaaggcctatgagctggcctgggccacagcctgcagctttggaggcagccggccctttgtggtggccgtggatgacatcatgttccagaagcctgtggaggtgggcagcctgctcttcctgagcagccaggtgtgcttcacccagaacaactacatccaggtgcgggtgcacagcgaggtggccagcctgcaggagaagcagcacaccaccaccaacgtgttccacttcaccttcatgtctgagaaggaggtgcccctggtgttccccaagacctacggggagagcatgctgtacctggatggccagaggcacttcaacagcatgagcggccctgccaccctgaggaaggactacctggtggagccctag

SEQ ID NO: 142562 - DNA, 1269 bp, Artificial Sequence
  Description of Artificial Sequence: Synthetic coding sequence
atgaccgtcttcttcaagaccctgaggaaccactggaagaagaccacagctggcctgtgcctgctgacctggggcggccactggctgtatggcaagcactgtgacaacctgctgcggcgggccgcctgccaggaggcccaggtgtttggaaaccagctgatccccccaaatgcccaggtgaagaaggccaccgtcttcctgaacccagctgcctgcaagggcaaggcccggaccctgtttgagaagaatgctgcccccatcctgcacctgagcggcatggatgtgaccatcgtgaagacagattatgagggccaggccaagaagctgctggagctgatggagaacacagatgtgatcatcgtggccggaggagatggcaccctgcaggaggtggtgactggagtgctgcggaggacagatgaggccaccttcagcaagatccccatcggcttcatccccctgggggagaccagcagcctgagccacaccctgtttgctgagagcggcaacaaggtgcagcacatcacagatgccaccctggccatcgtgaagggggagaccgtgcccctggatgtgctgcagatcaagggggagaaggagcagcctgtgtttgccatgacaggcctgcgctggggcagcttcagagatgctggggtgaaggtgtccaagtactggtacctgggccccctgaagatcaaggccgcccacttcttcagcaccctgaaggagtggccccagacccaccaggccagcatctcctacacaggccccacagagcggcccccaaatgaacctgaggagacccctgtgcagaggcccagcctgtaccgccgcatcctgcggcggctggccagctactgggcccagccccaggatgccctgagccaggaggtgtccccagaggtgtggaaggatgtgcagctgagcaccatcgagctgagcatcaccaccaggaacaaccagctggaccccaccagcaaggaggacttcctgaacatctgcattgaaccagacaccatcagcaagggggacttcatcaccatcggcagcaggaaggtgaggaaccccaagctgcacgtggagggcacagagtgcctgcaggccagccagtgcaccctgctgatccctgagggcgccggcggcagcttcagcattgattctgaggagtatgaggccatgcctgtggaggtgaagctgctgcccaggaagctgcagttcttctgtgaccccaggaagcgggagcagatgctgaccagccccacccagtag

SEQ ID NO: 142563 - DNA, 198 bp, Artificial Sequence
  Description of Artificial Sequence: Synthetic coding sequence
atgaccgtcttcttcaagaccctgaggaaccactggaagaagaccacagctggcctgtgcctgctgacctggggcggccactggctgtatggcaagcactgtgacaacctgctgcggcgggccgcctgccaggaggcccagcactaccaggatgagagccgctgggagcccaccctgagcaggaccccaggcagctag

SEQ ID NO: 142564 - DNA, 198 bp, Artificial Sequence; identical to SEQ ID NO: 142563
  Description of Artificial Sequence: Synthetic coding sequence

SEQ ID NO: 142565 - DNA, 735 bp, Artificial Sequence
  Description of Artificial Sequence: Synthetic coding sequence
atgaccgtcttcttcaagaccctgaggaaccactggaagaagaccacagctggcctgtgcctgctgacctggggcggccactggctgtatggcaagcactgtgacaacctgctgcggcgggccgcctgccaggaggcccaggtgtttggaaaccagctgatccccccaaatgcccaggtgaagaaggccaccgtcttcctgaacccagctgcctgcaagggcaccctgtttgagaagaatgctgcccccatcctgcacctgagcggcatggatgtgaccatcgtgaagacagattatgagggccaggccaagaagctgctggagctgatggagaacacagatgtgatcatcgtggccggaggagatggcaccctgcaggaggtggtgactggagtgctgcggaggacagatgaggccaccttcagcaagatccccatcggcttcatccccctgggggagaccagcagcctgagccacaccctgtttgctgagagcggcaacaaggtgcagcacatcacagatgccaccctggccatcgtgaagggggagaccgtgcccctggatgtgctgcagatcaagggggagaaggagcagcctgtgtttgccatgacaggcctgcgctggggcagcttcagagatgctggggtgaaggtgtccaagtactggtacctgggccccctgaagatcaaggccgcccacttcttcagcaccctgaagcccttccccaagaggtag

SEQ ID NO: 142566 - DNA, 1728 bp, Artificial Sequence
  Description of Artificial Sequence: Synthetic coding sequence
atgcagagcccctggaagatcctgactgtggcccccctcttcctgctgctgagcctgcagagcagcgccagccctgccaatgatgaccagagccggcccagcctgagcaatggccacacctgtgtgggctgtgtgctggtggtgtctgtgattgagcagctggcccaggtgcacaacagcacagtgcaggcctccatggagcggctgtgcagctacctgcctgagaagctgttcctgaagaccacctgctacctggtgattgacaagtttggaagtgacatcatcaagctgctgtctgctgacatgaatgctgatgtggtgtgccacaccctggagttctgcaagcagaacacaggccagcccctgtgccacctgtaccccctgcccaaggagacctggaagttcaccctgcagaaggcccggcagatcgtgaagaagagccccatcctgaagtacagccgcagcggcagtgacatctgcagcctgcctgtgctggccaagatctgccagaagatcaagctggccatggagcagagcgtgcccttcaaggatgtggacagcgacaagtacagcgtcttccccaccctgcggggctaccactggaggggccgggactgcaatgacagtgatgagagcgtgtacccaggaagaagacccaacaactgggatgtgcaccaggacagcaactgcaatggcatctggggcgtggaccccaaggatggagtgccctatgagaagaagttctgtgagggcagccagccccggggcatcatcctgctgggggacagcgctggggcccacttccacatcagccctgagtggatcacagccagccagatgagcctgaacagcttcatcaacctgcccacagccctgaccaatgagctggactggccccagctgagcggggccaccggcttcctggacagcacagtgggcatcaaggagaagagcatctacctgcggctgtggaagaggaaccactgcaaccaccgggactaccagaacatcagcagaaatggagccagcagcaggaacctgaagaagttcatcgagagcctgagcaggaacaaggtgctggactacccagccatcgtcatctatgccatgattggaaatgatgtgtgcagcggcaagagtgaccctgtgcctgccatgaccaccccagagaagctgtacagcaatgtgatgcagaccctgaagcacctgaacagccacctgcccaacggcagccacgtgatcctgtatggcctgcctgatggcaccttcctgtgggacaacctgcacaaccgctaccaccccctgggccagctgaacaaggacatgacctacgcccagctgtacagcttcctgaactgcctgcaggtgagcccctgccacggctggatgagcagcaacaagaccctgcggaccctgaccagcgagagagctgagcagctgagcaacaccctgaagaagattgctgccagcgagaagttcaccaacttcaacctcttctacatggactttgccttccacgagatcatccaggagtggcagaagaggggcggccagccctggcagctgattgagcctgtggatggcttccaccccaatgaggtggccctgctgctgctggccgaccacttctggaagaaggtgcagctgcagtggccccagatcctgggcaaggagaaccccttcaacccccagatcaagcaggtgtttggagaccagggcggccactag

SEQ ID NO: 142567 - DNA, 1632 bp, Artificial Sequence
  Description of Artificial Sequence: Synthetic coding sequence
atgcagagcccctggaagatcctgactgtggcccccctcttcctgctgctgagcctgcagagcagcgccagccctgccaatgatgaccagagccggcccagcctgagcaatggccacacctgtgtggagaagctgttcctgaagaccacctgctacctggtgattgacaagtttggaagtgacatcatcaagctgctgtctgctgacatgaatgctgatgtggtgtgccacaccctggagttctgcaagcagaacacaggccagcccctgtgccacctgtaccccctgcccaaggagacctggaagttcaccctgcagaaggcccggcagatcgtgaagaagagccccatcctgaagtacagccgcagcggcagtgacatctgcagcctgcctgtgctggccaagatctgccagaagatcaagctggccatggagcagagcgtgcccttcaaggatgtggacagcgacaagtacagcgtcttccccaccctgcggggctaccactggaggggccgggactgcaatgacagtgatgagagcgtgtacccaggaagaagacccaacaactgggatgtgcaccaggacagcaactgcaatggcatctggggcgtggaccccaaggatggagtgccctatgagaagaagttctgtgagggcagccagccccggggcatcatcctgctgggggacagcgctggggcccacttccacatcagccctgagtggatcacagccagccagatgagcctgaacagcttcatcaacctgcccacagccctgaccaatgagctggactggccccagctgagcggggccaccggcttcctggacagcacagtgggcatcaaggagaagagcatctacctgcggctgtggaagaggaaccactgcaaccaccgggactaccagaacatcagcagaaatggagccagcagcaggaacctgaagaagttcatcgagagcctgagcaggaacaaggtgctggactacccagccatcgtcatctatgccatgattggaaatgatgtgtgcagcggcaagagtgaccctgtgcctgccatgaccaccccagagaagctgtacagcaatgtgatgcagaccctgaagcacctgaacagccacctgcccaacggcagccacgtgatcctgtatggcctgcctgatggcaccttcctgtgggacaacctgcacaaccgctaccaccccctgggccagctgaacaaggacatgacctacgcccagctgtacagcttcctgaactgcctgcaggtgagcccctgccacggctggatgagcagcaacaagaccctgcggaccctgaccagcgagagagctgagcagctgagcaacaccctgaagaagattgctgccagcgagaagttcaccaacttcaacctcttctacatggactttgccttccacgagatcatccaggagtggcagaagaggggcggccagccctggcagctgattgagcctgtggatggcttccaccccaatgaggtggccctgctgctgctggccgaccacttctggaagaaggtgcagctgcagtggccccagatcctgggcaaggagaaccccttcaacccccagatcaagcaggtgtttggagaccagggcggccactag

SEQ ID NO: 142568 - DNA, 894 bp, Artificial Sequence
  Description of Artificial Sequence: Synthetic coding sequence
atgaagctgaagaacagcttcatcaacctgcccacagccctgaccaatgagctggactggccccagctgagcggggccaccggcttcctggacagcacagtgggcatcaaggagaagagcatctacctgcggctgtggaagaggaaccactgcaaccaccgggactaccagaacatcagcagaaatggagccagcagcaggaacctgaagaagttcatcgagagcctgagcaggaacaaggtgctggactacccagccatcgtcatctatgccatgattggaaatgatgtgtgcagcggcaagagtgaccctgtgcctgccatgaccaccccagagaagctgtacagcaatgtgatgcagaccctgaagcacctgaacagccacctgcccaacggcagccacgtgatcctgtatggcctgcctgatggcaccttcctgtgggacaacctgcacaaccgctaccaccccctgggccagctgaacaaggacatgacctacgcccagctgtacagcttcctgaactgcctgcaggtgagcccctgccacggctggatgagcagcaacaagaccctgcggaccctgaccagcgagagagctgagcagctgagcaacaccctgaagaagattgctgccagcgagaagttcaccaacttcaacctcttctacatggactttgccttccacgagatcatccaggagtggcagaagaggggcggccagccctggcagctgattgagcctgtggatggcttccaccccaatgaggtggccctgctgctgctggccgaccacttctggaagaaggtgcagctgcagtggccccagatcctgggcaaggagaaccccttcaacccccagatcaagcaggtgtttggagaccagggcggccactag

SEQ ID NO: 142569 - DNA, 2061 bp, Artificial Sequence
  Description of Artificial Sequence: Synthetic coding sequence
atgcagagcccctggaagatcctgactgtggcccccctcttcctgctgctgagcctgcagagcagcgccagccctgccaatgatgaccagagccggcccagcctgagcaatggccacacctgtgtgggctgtgtgctggtggtgtctgtgattgagcagctggcccaggtgcacaacagcacagtgcaggcctccatggagcggctgtgcagctacctgcctgagaagctgttcctgaagaccacctgctacctggtgattgacaagtttggaagtgacatcatcaagctgctgtctgctgacatgaatgctgatgtggtgtgccacaccctggagttctgcaagcagaacacaggccagcccctgtgccacctgtaccccctgcccaaggagacctggaagttcaccctgcagaaggcccggcagatcgtgaagaagagccccatcctgaagtacagccgcagcggcagtgacatctgcagcctgcctgtgctggccaagatctgccagaagatcaagctggccatggagcagagcgtgcccttcaaggatgtggacagcgacaagtacagcgtcttccccaccctgcggggctaccactggaggggccgggactgcaatgacagtgatgagagcgtgtacccaggaagaagacccaacaactgggatgtgcaccaggacagcaactgcaatggcatctggggcgtggaccccaaggatggagtgccctatgagaagaagttctgtgagggcagccagccccggggcatcatcctgctgggggacagcgctggggcccacttccacatcagccctgagtggatcacagccagccagatgagcctgaacagcttcatcaacctgcccacagccctgaccaatgagctggactggccccagctgagcggggccaccggcttcctggacagcacagtgggcatcaaggagaagagcatctacctgcggctgtggaagaggaaccactgcaaccaccgggactaccagaacatcagcagaaatggagccagcagcaggaacctgaagaagttcatcgagagcctgagcaggaacaaggtgctggactacccagccatcgtcatctatgccatgattggaaatgatgtgtgcagcggcaagagtgaccctgtgcctgccatgaccaccccagagaagctgtacagcaatgtgatgcagaccctgaagcacctgaacagccacctgcccaacggcagccacgtgatcctgtatggcctgcctgatggcaccttcctgtgggacaacctgcacaaccgctaccaccccctgggccagctgaacaaggacatgacctacgcccagctgtacagcttcctgaactgcctgcaggtgagcccctgccacggctggatgagcagcaacaagaccctgcggaccctgaccagcgagagagctgagcagctgagcaacaccctgaagaagattgctgccagcgagaagttcaccaacttcaacctcttctacatggactttgccttccacgagatcatccaggagtggcagaagaggggcggccagccctggcagctgattgagcctgtggatggcttccaccccaatgaaaggaagagcatcctgctgaagggcatcctgatgaccagccagaccctggacaaccaggagtggacccagctgacctcctggatcaagggcaacctgacctgtgacagcaggacccgggagtggctgtgctgctgctggaggatcatcagcggcaagcgctgcagcagcagcggccccaagtcctgggagcggcgcatccgcagcaccccccggctgaaccgctgcctggagaccaaggccggcacagagcccctgcgctccatgcacccctggggcgcccagggcggccggggcctgggcaagctgatcccccagctgtggggcctgcccaggcaccggcccaagggcctcttcttcagcagcatcttcaagtgcctgagcctgaatgaggagcacatctggaccaccgtgcagtgctgcgtgctgcccggctctgtgaccctgcccctcttcctgaagtag

SEQ ID NO: 142570 - DNA, 1992 bp, Artificial Sequence
  Description of Artificial Sequence: Synthetic coding sequence
atgcagagcccctggaagatcctgactgtggcccccctcttcctgctgctgagcctgcagagcagcgccagccctgccaatgatgaccagagccggcccagcctgagcaatggccacacctgtgtgggctgtgtgctggtggtgtctgtgattgagcagctggcccaggtgcacaacagcacagtgcaggcctccatggagcggctgtgcagctacctgcctgagaagctgttcctgaagaccacctgctacctggtgattgacaagtttggaagtgacatcatcaagctgctgtctgctgacatgaatgctgatgtggtgtgccacaccctggagttctgcaagcagaacacaggccagcccctgtgccacctgtaccccctgcccaaggagacctggaagttcaccctgcagaaggcccggcagatcgtgaagaagagccccatcctgaagtacagccgcagcggcagtgacatctgcagcctgcctgtgctggccaagatctgccagaagatcaagctggccatggagcagagcgtgcccttcaaggatgtggacagcgacaagtacagcgtcttccccaccctgcggggctaccactggaggggccgggactgcaatgacagtgatgagagcgtgtacccaggaagaagacccaacaactgggatgtgcaccaggacagcaactgcaatggcatctggggcgtggaccccaaggatggagtgccctatgagaagaagttctgtgagggcagccagccccggggcatcatcctgctgggggacagcgctggggcccacttccacatcagccctgagtggatcacagccagccagatgagcctgaacagcttcatcaacctgcccacagccctgaccaatgagctggactggccccagctgagcggggccaccggcttcctggacagcacagtgggcatcaaggagaagagcatctacctgcggctgtggaagaggaaccactgcaaccaccgggactaccagaacatcagcagaaatggagccagcagcaggaacctgaagaagttcatcgagagcctgagcaggaacaaggtgctggactacccagccatcgtcatctatgccatgattggaaatgatgtgtgcagcggcaagagtgaccctgtgcctgccatgaccaccccagagaagctgtacagcaatgtgatgcagaccctgaagcacctgaacagccacctgcccaacggcagccacgtgatcctgtatggcctgcctgatggcaccttcctgtgggacaacctgcacaaccgctaccaccccctgggccagctgaacaaggacatgacctacgcccagctgtacagcttcctgaactgcctgcaggtgagcccctgccacggctggatgagcagcaacaagaccctgcggaccctgaccagcgagagagctgagcagctgagcaacaccctgaagaagattgctgccagcgagaagttcaccaacttcaacctcttctacatggactttgccttccacgagatcatccaggagtggcagaagaggggcggccagccctggcagctgattgagcctgtggatggcttccaccccaatgaaaggaagagcatcctgctgaagggcatcctgatgaccagccagaccctggacaaccaggagtggacccagctgacctcctggatcaagggcaacctgacctgtgacagcaggacccgggagtggctgtgctgctgctggaggatcatcagcggcaagcgctgcagcagcagcggccccaagtcctgggagcggcgcatccgcagcaccccccggctgaaccgctgcctggagaccaaggccggcacagagcccctgcgctccatgcacccctggggcgcccagggcggccggggcctgggcaagctgatcccccagccctacggcggctgccacgtgacaggccccaaggacagcagcagcgctgccagcctgcagatgtccttcagccagtag

SEQ ID NO: 142571 - DNA, 300 bp, Artificial Sequence
  Description of Artificial Sequence: Synthetic coding sequence
atggccgagggcaacaccctcatctctgtggactatgagatctttgggaaggtgcagggcgtcttcttcaggaagcacacccaggccgagggcaagaagctgggcctggtgggctgggtgcagaacacagaccggggcaccgtgcagggccagctgcagggccccatcagcaaggtgcgccacatgcaggagtggctggagacccggggcagccccaagagccacatcgacaaggccaacttcaacaatgagaaggtgatcctgaagctggactacagcgacttccagatcgtgaagtag

SEQ ID NO: 142572 - DNA, 168 bp, Artificial Sequence
  Description of Artificial Sequence: Synthetic coding sequence
atggccgagggcaacaccctcatctctgtggactatgagatctttgggaaggtgcagggcgtcttcttcaggaagcacacccaggagatgacagtggagaacagaattgctgagacccacagcaagagctgtgtgcctgtgtcctttgccaccagctatgccggctag

SEQ ID NO: 142573 - DNA, 300 bp, Artificial Sequence; identical to SEQ ID NO: 142571
  Description of Artificial Sequence: Synthetic coding sequence

SEQ ID NO: 142574 - DNA, 300 bp, Artificial Sequence
  Description of Artificial Sequence: Synthetic coding sequence
atgagcacagcccagagcctgaagtctgtggactatgaggtgtttggccgggtgcagggcgtgtgcttcaggatgtacacagaagatgaggccaggaagattggagtggtgggctgggtgaagaacaccagcaaaggaacagtgacaggccaggtgcagggccctgaggacaaggtgaacagcatgaagtcctggctgagcaaggtgggcagccccagcagcagaattgacaggaccaacttcagcaatgagaagaccatcagcaagctggagtacagcaacttcagcatccgctactag

SEQ ID NO: 142575 - DNA, 294 bp, Artificial Sequence
  Description of Artificial Sequence: Synthetic coding sequence
atgtgccccctgcccctggccgctgctgctgtggccgccccccgggcccccctgcggctgctgaacagaggcctggccgccgccatgagcacagcccagagcctgaagtctgtggactatgaggtgtttggccgggtgcagggcgtgtgcttcaggatgtacacagaagatgaggccaggaagattggagtggtgggctgggtgaagaacaccagcaaaggaacagtgacaggccaggtgcagggccctgaggacaaggtgaacagcatgctggagtgcagcggcctcatctag

SEQ ID NO: 142576 - DNA, 2247 bp, Artificial Sequence
  Description of Artificial Sequence: Synthetic coding sequence
atggtgctgctgcgggtgctgatcctgctgctgtcctgggccgccggcatgggcggccagtatggcaaccccctgaacaagtacatccgccactatgagggcctgagctacaacgtggacagcctgcaccagaagcaccagagggccaagagagctgtgtcccatgaggaccagttcctgcggctggacttccacgcccacggccgccacttcaacctgaggatgaagagggacaccagcctcttcagtgatgagttcaaggtggagaccagcaacaaggtgctggactatgacaccagccacatctacacaggccacatctacggggaggagggcagcttcagccacggctctgtgattgatggccgctttgagggcttcatccagacccggggcggcaccttctacgtggagcctgctgagcgctacatcaaggacaggaccctgcccttccacagcgtcatctaccatgaagatgacatcaactacccccacaagtatggcccccagggcggctgtgccgaccacagcgtgtttgagaggatgaggaagtaccagatgactggagtggaggaggtgacccagatcccccaggaggagcacgccgccaacggccctgagctgctgaggaagaagaggaccaccagcgctgagaagaacacctgccagctgtacatccagacagaccacctgttcttcaagtactacggcacccgggaggccgtgattgcccagatcagcagccacgtgaaggccatcgacaccatctaccagaccacagacttcagcggcatccggaacatctccttcatggtgaagaggatccgcatcaacaccacagcagatgagaaggaccccaccaaccccttccgcttccccaacattggagtggagaagttcctggagctgaacagcgagcagaaccatgatgactactgcctggcctacgtgttcacagaccgggactttgatgatggagtgctgggcctggcctgggtgggcgcccccagcggcagcagcggcggcatctgtgagaagagcaagctgtacagtgatggcaagaagaagagcctgaacacaggcatcatcaccgtgcagaactacggcagccacgtgccccccaaggtgagccacatcacctttgcccacgaggtgggccacaactttggcagcccccatgattctggaacagagtgcaccccaggagagagcaagaacctgggccagaaggaaaatggaaactacatcatgtatgcccgggccaccagcggggacaagctgaacaacaacaagttcagcctgtgcagcatccggaacatcagccaggtgctggagaagaagaggaacaactgctttgtggagagcggccagcccatctgtggaaatggcatggtggagcagggcgaggagtgtgactgtggctacagcgaccagtgcaaggatgagtgctgctttgatgccaaccagcctgagggcaggaagtgcaagctgaagccaggcaagcagtgcagccccagccagggcccctgctgcacagcccagtgtgccttcaagagcaagtctgagaagtgcagagatgacagcgactgtgcccgggagggcatctgcaatggcttcaccgccctgtgcccagccagtgaccccaagcccaacttcacagactgcaacagacacacccaggtgtgcatcaatggccagtgtgccggcagcatctgtgagaagtatggcctggaggagtgcacctgtgccagcagtgatggcaaggatgacaaggagctgtgccacgtgtgctgcatgaagaagatggaccccagcacctgtgccagcacaggctctgtgcagtggagccgccacttcagcggccgcaccatcaccctgcagcccggcagcccctgcaatgacttccggggctactgtgatgtgttcatgcgctgccgcctggtggatgctgatggccccctggcccggctgaagaaggccatcttcagccctgagctgtatgagaacattgctgagtggatcgtggcccactggtgggccgtgctgctgatgggcatcgccctgatcatgctgatggccggcttcatcaagatctgcagcgtgcacacccccagcagcaaccccaagctgcccccacccaagcccctgcccggcaccctgaagagaagaagaccaccccagcccatccagcagccccagaggcagaggccccgggagagctaccagatgggccacatgagaagatag

SEQ ID NO: 142577 - DNA, 1344 bp, Artificial Sequence
  Description of Artificial Sequence: Synthetic coding sequence
atggtgctgctgcgggtgctgatcctgctgctgtcctgggccgccggcatgggagaccgggactttgatgatggagtgctgggcctggcctgggtgggcgcccccagcggcagcagcggcggcatctgtgagaagagcaagctgtacagtgatggcaagaagaagagcctgaacacaggcatcatcaccgtgcagaactacggcagccacgtgccccccaaggtgagccacatcacctttgcccacgaggtgggccacaactttggcagcccccatgacagcggcacagaatgtaccccaggagagagcaagaacctgggccagaaggaaaatggaaactacatcatgtatgcccgggccaccagcggggacaagctgaacaacaacaagttcagcctgtgcagcatccggaacatcagccaggtgctggagaagaagaggaacaactgctttgtggagagcggccagcccatctgtggaaatggcatggtggagcagggcgaggagtgtgactgtggctacagcgaccagtgcaaggatgagtgctgctttgatgccaaccagcctgagggcaggaagtgcaagctgaagccaggcaagcagtgcagccccagccagggcccctgctgcacagcccagtgtgccttcaagagcaagtctgagaagtgcagagatgacagcgactgtgcccgggagggcatctgcaatggcttcaccgccctgtgcccagccagtgaccccaagcccaacttcacagactgcaacagacacacccaggtgtgcatcaatggccagtgtgccggcagcatctgtgagaagtatggcctggaggagtgcacctgtgccagcagtgatggcaaggatgacaaggagctgtgccacgtgtgctgcatgaagaagatggaccccagcacctgtgccagcactggatctgtgcagtggagccgccacttcagcggccgcaccatcaccctgcagcccggcagcccctgcaatgacttccggggctactgtgatgtgttcatgcgctgccgcctggtggatgctgatggccccctggcccggctgaagaaggccatcttcagccctgagctgtatgaaaatattgctgagtggatcgtggcccactggtgggccgtgctgctgatgggcatcgccctgatcatgctgatggccggcttcatcaagatctgcagcgtgcacacccccagcagcaaccccaagctgcccccacccaagcccctgcccggcaccctgaagagaagaagaccaccccagcccatccagcagccccagaggcagaggccccgggagagctaccagatgggccacatgagaagatag

SEQ ID NO: 142578 - DNA, 2310 bp, Artificial Sequence
  Description of Artificial Sequence: Synthetic coding sequence
atgaggctgctgcggcgctgggcctttgctgccctgctgctgagcctgctgcccaccccaggcctgggcacccagggccctgctggggccctgcgctggggcggcctgccccagctgggcggccctggggcccctgaggtgacagagcccagccggctggtgcgggagagcagcggcggggaggtgaggaagcagcagctggacaccagggtgcggcaggagcccccaggcggcccccctgtgcacctggcccaggtgtcctttgtgatcccagccttcaacagcaacttcaccctggacctggagctgaaccaccacctgctgagcagccagtatgtggagcggcacttcagccgggagggcaccacccagcacagcactggagctggggaccactgctactaccagggcaagctgcggggcaacccccacagctttgctgccctgagcacctgccagggcctgcacggcgtcttcagtgatggcaacctgacctacatcgtggagccccaggaggtggccggcccctggggcgccccccagggccccctgccccacctgatctaccgcacccccctgctgcctgaccccctgggctgccgggagcccggctgcctgtttgctgtgcctgcccagagcgccccacccaaccggccccggctgcggaggaagaggcaggtgcggcggggccaccccaccgtgcacagcgagaccaagtatgtggagctgattgtcatcaatgaccaccagctgtttgagcagatgaggcagagcgtggtgctgaccagcaactttgccaagtctgtggtgaacctggctgatgtgatctacaaggagcagctgaacaccagaattgtgctggtggccatggagacctgggcagatggagacaagatccaggtgcaggatgacctgctggagaccctggcccggctgatggtgtaccgccgggagggcctgcctgagcccagtgatgccacccacctgttcagcggccgcaccttccagagcaccagcagcggggccgcctacgtgggcggcatctgcagcctgagccatggaggcggcgtgaatgaatatggcaacatgggcgccatggctgtgaccctggcccagaccctgggccagaacctgggcatgatgtggaacaagcacaggagcagcgctggggactgcaagtgcccagacatctggctgggctgcatcatggaggacaccggcttctacctgcccaggaagttcagccgctgcagcattgatgagtacaaccagttcctgcaggagggcggcggcagctgcctcttcaacaagcccctgaagctgctggaccccccagaatgtggaaatggatttgtggaggccggggaggagtgtgactgtggctctgtgcaggagtgcagcagagctgggggcaactgctgcaagaagtgcaccctgacccatgatgccatgtgcagtgatggcctgtgctgccgccgctgcaagtatgagccccggggcgtgtcctgccgggaggccgtgaatgaatgtgacattgctgagacctgcacaggagacagcagccagtgcccccccaacctgcacaagctggatggctactactgtgaccacgagcagggccgctgctatggaggccgctgcaagacccgggaccggcagtgccaggtgctgtggggccatgctgctgctgaccgcttctgctatgagaagctgaatgtggagggcacagagcggggcagctgtggcaggaagggcagcggctgggtgcagtgcagcaagcaggatgtgctgtgtggcttcctgctgtgtgtgaacatcagcggggccccccggctgggggacctggtgggggacatcagctctgtgaccttctaccaccagggcaaggagctggactgccggggcggccacgtgcagctggctgatggcagtgacctgtcctatgtggaggatggaacagcctgtggccccaacatgctgtgcctggaccaccgctgcctgcctgccagcgccttcaacttcagcacctgccccggcagcggggagcggcgcatctgcagccaccacggcgtgtgcagcaatgaaggcaagtgcatctgccagcctgactggacaggcaaggactgcagcatccacaaccccctgcccaccagccccccaactggagaaacagagcgctacaagggccccagcggcaccaacatcatcatcggcagcattgctggagctgtgctggtggccgccatcgtgctgggcggcaccggctggggcttcaagaacatccggcggggccgcagcggcggggcctag

SEQ ID NO: 142579 - DNA, 1572 bp, Artificial Sequence
  Description of Artificial Sequence: Synthetic coding sequence
tgctggggcagcggccacctgctgagcagccagtatgtggagcggcacttcagccgggagggcaccacccagcacagcactggagctggggaccactgctactaccagggcaagctgcggggcaacccccacagctttgctgccctgagcacctgccagggcctgcacggcgtcttcagtgatggcaacctgacctacatcgtggagccccaggaggtggccggcccctggggcgccccccagggccccctgccccacctgatctaccgcacccccctgctgcctgaccccctgggctgccgggagcccggctgcctgtttgctgtgcctgcccagagcgccccacccaaccggccccggctgcggaggaagaggcaggtgcggcggggccaccccaccgtgcacagcgagaccaagtatgtggagctgattgtcatcaatgaccaccagctgtttgagcagatgaggcagagcgtggtgctgaccagcaactttgccaagtctgtggtgaacctggctgatgtgatctacaaggagcagctgaacaccagaattgtgctggtggccatggagacctgggcagatggagacaagatccaggtgcaggatgacctgctggagaccctggcccggctgatggtgtaccgccgggagggcctgcctgagcccagtgatgccacccacctgttcagcggccgcaccttccagagcaccagcagcggggccgcctacgtgggcggcatctgcagcctgagccatggaggcggcgtgaatgaatatggcaacatgggcgccatggctgtgaccctggcccagaccctgggccagaacctgggcatgatgtggaacaagcacaggagcagcgctggggactgcaagtgcccagacatctggctgggctgcatcatggaggacaccggcttctacctgcccaggaagttcagccgctgcagcattgatgagtacaaccagttcctgcaggagggcggcggcagctgcctcttcaacaagcccctgaagctgctggaccccccagaatgtggaaatggatttgtggaggccggggaggagtgtgactgtggctctgtgcaggagtgcagcagagctgggggcaactgctgcaagaagtgcaccctgacccatgatgccatgtgcagtgatggcctgtgctgccgccgctgcaagtatgagccccggggcgtgtcctgccgggaggccgtgaatgaatgtgacattgctgagacctgcacaggagacagcagccagtgcccccccaacctgcacaagctggatggctactactgtgaccacgagcagggccgctgctatggaggccgctgcaagacccgggaccggcagtgccaggtgctgtggggccatgctgctgctgaccgcttctgctatgagaagctgaatgtggagggcacagagcggggcagctgtggcaggaagggcagcggctgggtgcagtgcagcaagcagccccagcagggccgggctgtgtggctgccccccctgtgccagcacctgtggagcagcagcgcccggggccctgggggccgccaccagtag

SEQ ID NO: 142580 - DNA, 1710 bp, Artificial Sequence
  Description of Artificial Sequence: Synthetic coding sequence
atgcagggcacccggctgcctgtgtgctgtgcctgccctgtgggcagcagcaagccagctgaggccgagaaggagaaggtgcggcggggccaccccaccgtgcacagcgagaccaagtatgtggagctgattgtcatcaatgaccaccagctgtttgagcagatgaggcagagcgtggtgctgaccagcaactttgccaagtctgtggtgaacctggctgatgtgatctacaaggagcagctgaacaccagaattgtgctggtggccatggagacctgggcagatggagacaagatccaggtgcaggatgacctgctggagaccctggcccggctgatggtgtaccgccgggagggcctgcctgagcccagtgatgccacccacctgttcagcggccgcaccttccagagcaccagcagcggggccgcctacgtgggcggcatctgcagcctgagccatggaggcggcgtgaatgaatatggcaacatgggcgccatggctgtgaccctggcccagaccctgggccagaacctgggcatgatgtggaacaagcacaggagcagcgctggggactgcaagtgcccagacatctggctgggctgcatcatggaggacaccggcttctacctgcccaggaagttcagccgctgcagcattgatgagtacaaccagttcctgcaggagggcggcggcagctgcctcttcaacaagcccctgaagctgctggaccccccagaatgtggaaatggatttgtggaggccggggaggagtgtgactgtggctctgtgcaggagtgcagcagagctgggggcaactgctgcaagaagtgcaccctgacccatgatgccatgtgcagtgatggcctgtgctgccgccgctgcaagtatgagccccggggcgtgtcctgccgggaggccgtgaatgaatgtgacattgctgagacctgcacaggagacagcagccagtgcccccccaacctgcacaagctggatggctactactgtgaccacgagcagggccgctgctatggaggccgctgcaagacccgggaccggcagtgccaggtgctgtggggccatgctgctgctgaccgcttctgctatgagaagctgaatgtggagggcacagagcggggcagctgtggcaggaagggcagcggctgggtgcagtgcagcaagcaggatgtgctgtgtggcttcctgctgtgtgtgaacatcagcggggccccccggctgggggacctggtgggggacatcagctctgtgaccttctaccaccagggcaaggagctggactgccggggcggccacgtgcagctggctgatggcagtgacctgtcctatgtggaggatggaacagcctgtggccccaacatgctgtgcctggaccaccgctgcctgcctgccagcgccttcaacttcagcacctgccccggcagcggggagcggcgcatctgcagccaccacggcgtgtgcagcaatgaaggcaagtgcatctgccagcctgactggacaggcaaggactgcagcatccacaaccccctgcccaccagccccccaactggagaaacagagcgctacaagggccccagcggcaccaacatcatcatcggcagcattgctggagctgtgctggtggccgccatcgtgctgggcggcaccggctggggcttcaagaacatccggcggggccgcagcggcggggcctag

SEQ ID NO: 142581 - DNA, 2217 bp, Artificial Sequence
  Description of Artificial Sequence: Synthetic coding sequence
atggccgcccggcccctgcctgtgtccccagcccgggccctgctgctggccctggccggggccctgctggccccctgtgaggcccggggcgtgtccctgtggaaccagggccgggcagatgaggtggtgtctgcctctgtgggcagcggggacctgtggatccctgtgaagagctttgacagcaagaaccaccctgaggtgctgaacatccggctgcagcgggagagcaaggagctgatcatcaacctggagagaaatgaaggcctcatcgccagcagcttcacagagacccactacctgcaggacggcacagatgtgtccctggccaggaactacaccgtcatcctgggccactgctactaccacggccacgtgcggggctacagcgacagcgctgtgtccctgagcacctgcagcggcctgcggggcctgattgtgtttgaaaatgaaagctatgtgctggagcccatgaagagcgccaccaaccgctacaagctgtttcctgccaagaagctgaagtctgtgcggggcagctgtggcagccaccacaacacccccaacctggccgccaagaatgtgtttcctccacccagccagacctgggcccggcggcacaagcgggagaccctgaaggccaccaagtatgtggagctggtgattgtggccgacaaccgggagttccagaggcagggcaaggacctggagaaggtgaagcagaggctcatcgagatcgccaaccacgtggacaagttctaccggcccctgaacatcagaattgtgctggtgggcgtggaggtgtggaatgacatggacaagtgcagcgtgtcccaggaccccttcaccagcctgcacgagttcctggactggaggaagatgaagctgctgcccaggaagagccatgacaatgcccagctggtgtctggagtgtacttccagggcaccaccatcggcatggcccccatcatgtccatgtgcacagctgaccagagcggcggcatcgtgatggaccacagcgacaaccccctgggcgctgctgtgaccctggcccacgagctgggccacaactttggcatgaaccacgacaccctggaccggggctgcagctgccagatggctgtggagaagggcggctgcatcatgaatgccagcacaggctaccccttccccatggtgttcagcagctgcagcaggaaggacctggagaccagcctggagaagggcatgggcgtgtgcctcttcaacctgcctgaggtgcgggagagctttggaggccagaagtgtggcaacagatttgtggaggagggggaggagtgtgactgtggggagcctgaggagtgcatgaaccgctgctgcaatgccaccacctgcaccctgaagccagatgctgtgtgtgcccacggcctgtgctgtgaggactgccagctgaagccagctggaacagcctgccgggacagcagcaacagctgtgacctgcctgagttctgcaccggggccagcccccactgcccagccaacgtgtacctgcatgatggccacagctgccaggatgtggatggctactgctacaacggcatctgccagacccatgagcagcagtgtgtgaccctgtggggccctggggccaagccagcccctggcatctgctttgagcgggtgaacagcgctggggacccctacggcaactgtgggaaggtgtccaagagcagctttgccaagtgtgagatgagagatgccaagtgtgggaagatccagtgccagggcggggccagcaggcctgtgattggcaccaatgctgtgtccattgagaccaacatccccctgcagcagggcggccgcatcctgtgccggggcacccacgtgtacctgggagatgacatgccagaccccggcctggtgctggccggcaccaagtgtgctgatggcaagatctgcctgaaccggcagtgccagaacatctctgtgtttggagtgcatgaatgtgccatgcagtgccacggccggggcgtgtgcaacaacaggaagaactgccactgtgaggcccactgggccccacccttctgtgacaagtttggatttggaggcagcacagacagcggccccatccggcaggccgaggcccggcaggaggccgctgagagcaaccgggagcggggccagggccaggagcctgtgggcagccaggagcacgccagcacagccagcctgaccctcatctag

SEQ ID NO: 142582 - DNA, 2730 bp, Artificial Sequence
  Description of Artificial Sequence: Synthetic coding sequence
atggccgcccggcccctgcctgtgtccccagcccgggccctgctgctggccctggccggggccctgctggccccctgtgaggcccggggcgtgtccctgtggaaccagggccgggcagatgaggtggtgtctgcctctgtgggcagcggggacctgtggatccctgtgaagagctttgacagcaagaaccaccctgaggtgctgaacatccggctgcagcgggagagcaaggagctgatcatcaacctggagagaaatgaaggcctcatcgccagcagcttcacagagacccactacctgcaggacggcacagatgtgtccctggccaggaactacaccgtcatcctgggccactgctactaccacggccacgtgcggggctacagcgacagcgctgtgtccctgagcacctgcagcggcctgcggggcctgattgtgtttgaaaatgaaagctatgtgctggagcccatgaagagcgccaccaaccgctacaagctgtttcctgccaagaagctgaagtctgtgcggggcagctgtggcagccaccacaacacccccaacctggccgccaagaatgtgtttcctccacccagccagacctgggcccggcggcacaagcgggagaccctgaaggccaccaagtatgtggagctggtgattgtggccgacaaccgggagttccagaggcagggcaaggacctggagaaggtgaagcagaggctcatcgagatcgccaaccacgtggacaagttctaccggcccctgaacatcagaattgtgctggtgggcgtggaggtgtggaatgacatggacaagtgcagcgtgtcccaggaccccttcaccagcctgcacgagttcctggactggaggaagatgaagctgctgcccaggaagagccatgacaatgcccagctggtgtctggagtgtacttccagggcaccaccatcggcatggcccccatcatgtccatgtgcacagctgaccagagcggcggcatcgtgatggaccacagcgacaaccccctgggcgctgctgtgaccctggcccacgagctgggccacaactttggcatgaaccacgacaccctggaccggggctgcagctgccagatggctgtggagaagggcggctgcatcatgaatgccagcacaggctaccccttccccatggtgttcagcagctgcagcaggaaggacctggagaccagcctggagaagggcatgggcgtgtgcctcttcaacctgcctgaggtgcgggagagctttggaggccagaagtgtggcaacagatttgtggaggagggggaggagtgtgactgtggggagcctgaggagtgcatgaaccgctgctgcaatgccaccacctgcaccctgaagccagatgctgtgtgtgcccacggcctgtgctgtgaggactgccagctgaagccagctggaacagcctgccgggacagcagcaacagctgtgacctgcctgagttctgcaccggggccagcccccactgcccagccaacgtgtacctgcatgatggccacagctgccaggatgtggatggctactgctacaacggcatctgccagacccatgagcagcagtgtgtgaccctgtggggccctggggccaagccagcccctggcatctgctttgagcgggtgaacagcgctggggacccctacggcaactgtgggaaggtgtccaagagcagctttgccaagtgtgagatgagagatgccaagtgtgggaagatccagtgccagggcggggccagcaggcctgtgattggcaccaatgctgtgtccattgagaccaacatccccctgcagcagggcggccgcatcctgtgccggggcacccacgtgtacctgggagatgacatgccagaccccggcctggtgctggccggcaccaagtgtgctgatggcaagatctgcctgaaccggcagtgccagaacatctctgtgtttggagtgcatgaatgtgccatgcagtgccacggccggggcgtgtgcaacaacaggaagaactgccactgtgaggcccactgggccccacccttctgtgacaagtttggatttggaggcagcacagacagcggccccatccggcaggccgacaaccagggcctgaccatcggcatcctggtgaccatcctgtgcctgctggccgccggctttgtggtgtacctgaagaggaagaccctcatccggctgctcttcaccaacaagaagaccaccatcgagaagctgcgctgtgtgcggcccagcaggcctccccggggcttccagccctgccaggcccacctgggccacctgggcaagggcctgatgaggaagcccccagacagctacccacccaaggacaacccccggcggctgctgcagtgccagaatgtggacatcagccggcccctgaatggcctgaatgtgccccagccccagagcacccagagggtgctgccccccctgcaccgggccccccgggcccccagcgtgcctgcccggcccctgcctgccaagccagccctgcggcaggcccagggcacctgcaagcccaaccccccccagaagcccctgcctgctgaccccctggcccggaccacccggctgacccacgccctggcccggaccccaggccagtgggagaccggcctgcggctggcccccctgcggcctgccccccagtacccccaccaggtgcccaggagcacccacacagcctacatcaagtag

SEQ ID NO: 142583 - DNA, 837 bp, Artificial Sequence
  Description of Artificial Sequence: Synthetic coding sequence
atggccgcccggcccctgcctgtgtccccagcccgggccctgctgctggccctggccggggccctgctggccccctgtgaggcccggggcgtgtccctgtggaaccagggccgggcagatgaggtggtgtctgcctctgtgggcagcggggacctgtggatccctgtgaagagctttgacagcaagaaccaccctgaggtgctgaacatccggctgcagcgggagagcaaggagctgatcatcaacctggagagaaatgaaggcctcatcgccagcagcttcacagagacccactacctgcaggacggcacagatgtgtccctggccaggaactacacaggccactgctactaccacggccacgtgcggggctacagcgacagcgctgtgtccctgagcacctgcagcggcctgcggggcctcatcgtgtttgaaaatgaaagctatgtgctggagcccatgaagagcgccaccaaccgctacaagctgtttcctgccaagaagctgaagtctgtgcggggcagctgtggcagccaccacaacacccccaacctggccgccaagaatgtgttccccccacccagccagacctgggcccggcggcacaagcgggagaccctgaaggccaccaagtatgtggagctggtgattgtggccgacaaccgggagttccagaggcagggcaaggacctggagaaggtgaagcagaggctgattgaaattgccaaccacgtggacaagttctaccggcccctgaacatccgcatcgtgctggtgggcgtggaggtgtggaatgacatggacaagtgcagcgtgtcccaggaccccttcacctag

SEQ ID NO: 142584 - DNA, 2445 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaagagccagggccctgccaagcccccaccacccaggaagcccctgcctgctgacccccagggccgctgccccagcggggacctgcccggccctggagctggcatcccccccctggtggtgcccagcaggcctgcccctcctccacccaccgtgagcagcctgtacctgtag

SEQ ID NO: 142585 - DNA, 2520 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaagcaggccagcgccctgtccttccctgccccacccagccggcccctgcccccagaccctgtgtccaagaggctgcagagccagggccctgccaagcccccaccacccaggaagcccctgcctgctgacccccagggccgctgccccagcggggacctgcccggccctggggccggcatcccccccctggtggtgcccagcaggcctgcccctcctccacccaccgtgagcagcctgtacctgtag

SEQ ID NO: 142586 - DNA, 2592 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaagcaggccagcgccctgtccttccctgccccacccagccggcccctgcccccagaccctgtgtccaagaggctgcaggccgagctggccgaccggcccaacccccccacccggcccctgcctgctgaccctgtggtgcgcagccccaagagccagggccctgccaagcccccaccacccaggaagcccctgcctgctgacccccagggccgctgccccagcggggacctgcccggccctggggccggcatcccccccctggtggtgcccagcaggcctgcccctcctccacccaccgtgagcagcctgtacctgtag

SEQ ID NO: 142587 - DNA, 2517 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaaggccgagctggccgaccggcccaacccccccacccggcccctgcctgctgaccctgtggtgcgcagccccaagagccagggccctgccaagcccccaccacccaggaagcccctgcctgctgacccccagggccgctgccccagcggggacctgcccggccctggagctggcatcccccccctggtggtgcccagcaggcctgcccctcctccacccaccgtgagcagcctgtacctgtag

SEQ ID NO: 142588 - DNA, 2319 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagcctgcggggccagcccagcccccacccccagggcagccactgcctgcccaccccccgggccggggcccaccgggtgacctgcccagcccagggcctggagagccggccctag

SEQ ID NO: 142589 - DNA, 1563 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaacagaagcttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaagagccagggccctgccaagcccccaccacccaggaagcccctgcctgctgacccccagggccgctgccccagcggggacctgcccggccctggagctggcatcccccccctggtggtgcccagcaggcctgcccctcctccacccaccgtgagcagcctgtacctgtag

SEQ ID NO: 142590 - DNA, 2589 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaaggccagcgccctgtccttccctgccccacccagccggcccctgcccccagaccctgtgtccaagaggctgcaggccgagctggccgaccggcccaacccccccacccggcccctgcctgctgaccctgtggtgcgcagccccaagagccagggccctgccaagcccccaccacccaggaagcccctgcctgctgacccccagggccgctgccccagcggggacctgcccggccctggagctggcatcccccccctggtggtgcccagcaggcctgcccctcctccacccaccgtgagcagcctgtacctgtag

SEQ ID NO: 142591 - DNA, 2391 bp, Artificial Sequence
  Description of Artificial Sequence: Synthetic coding sequence
atgaggctggccctgctgtgggccctgggcctgctgggcgccggcagccccctgcccagctggcccctgcccaacatcggcggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtaccgcctggtgctgagcgccagccggccccccctgcccggccgctgccgcctgaccctgtgcccccgggacagcagcctgcggggccagcccagcccccacccccagggcagccactgcctgcccaccccccgggccggggcccaccgggtgacctgcccagcccagggcctggagagccggccctag

SEQ ID NO: 142592 - DNA, 2475 bp, Artificial Sequence
  Description of Artificial Sequence: Synthetic coding sequence
atgaggctggccctgctgtgggccctgggcctgctgggcgccggcagccccctgcccagctggcccctgcccaacatcgtgctgtcctggggcgtgctgggccctgctgggggcacagaggagcagcaggccgagagcgagaaggccccccgggagcccctggagccccaggtgctgcaggatgacctgcccatcagcctgaagaaggtgctgcagaccagcctgcctgagcccctgcgcatcaagctggagctggatggagacagccacatcctggagctgctgcagaaccgggagctggtgcccggccggcccaccctggtgtggtaccagccagatggcaccagggtggtgtctgagggccacaccctggagaactgctgctaccagggccgggtgcggggctacgccggctcctgggtgtccatctgcacctgcagcggcctgcggggcctggtggtgctgaccccagagaggagctacaccctggagcagggccctggggacctgcagggcccccccatcatcagccgcatccaggacctgcacctgcccggccacacctgtgccctgtcctggagggagagcgtgcacacccagaagcccccagagcaccccctgggccagaggcacatcagaagaagaagagatgtggtgacagagaccaagacagtggagctggtgattgtggccgaccacagcgaggcccagaagtacagagacttccagcacctgctgaacagaaccctggaggtggccctgctgctggacaccttcttccggcccctgaatgtgcgggtggccctggtgggcctggaggcctggacccagagggacctggtggagatcagccccaacccagctgtgaccctggagaacttcctgcactggaggcgggcccacctgctgccccggctgccccatgacagcgcccagctggtgacaggcaccagcttcagcggccccaccgtgggcatggccatccagaacagcatctgcagcccagacttcagcggcggcgtgaacatggaccacagcaccagcatcctgggcgtggccagcagcatcgcccacgagctgggccacagcctgggcctggaccatgacctgcccggcaacagctgcccctgccccggccctgccccagccaagacctgcatcatggaggccagcacagacttcctgcccggcctgaacttcagcaactgcagcagaagagccctggagaaggccctgctggatggcatgggcagctgcctgtttgagcggctgcccagcctgccccccatggccgccttctgtggcaacatgtttgtggagcctggagagcagtgtgactgtggcttcctggatgactgtgtggacccctgctgtgacagcctgacctgccagctgcggcctggggcccagtgtgccagtgatggcccctgctgccagaactgccagctgcggcccagcggctggcagtgccggcccaccaggggggactgtgacctgcctgagttctgccctggggacagcagccagtgccccccagatgtgtccctgggagatggagagccctgtgccggcggccaggccgtgtgcatgcacggccgctgtgccagctatgcccagcagtgccagagcctgtggggccctggggcccagcctgctgcccccctgtgcctgcagacagccaacaccagaggaaatgccttcggcagctgtggcaggaaccccagcggcagctatgtgtcctgcaccccaagagatgccatctgtggccagctgcagtgccagacaggccgcacccagcccctgctgggcagcatccgggacctgctgtgggagaccattgatgtgaatggaacagagctgaactgctcctgggtgcacctggacctgggcagtgatgtggcccagcccctgctgaccctgcctggaacagcctgtggccctggcctggtgtgcatcgaccaccgctgccagagggtggacctgctgggcgcccaggagtgccgcagcaagtgccacggccacggcgtgtgtgacagcaacagacactgctactgtgaggagggctgggcccccccagactgcaccacccagctgaaggccaccagcagcctgaccaccggcctgctgctgagcctgctggtgctgctggtgctggtgatgctgggcgccagctactggtaccgggcccggctgcaccagaggctgtgccagctgaagggccccacctgccagtacagagctgcccagagcggccccagcgagcggcccggccccccccagagggccctgctggcccggggcaccaagagccagggccctgccaagcccccaccacccaggaagcccctgcctgctgacccccagggccgctgccccagcggggacctgcccggccctggagctggcatcccccccctggtggtgcccagcaggcctgcccctcctccacccaccgtgagcagcctgtacctgtag

SEQ ID NO: 142593 - DNA, 2757 bp, Artificial Sequence
  Description of Artificial Sequence: Synthetic coding sequence
atgcctgggggcgctggggccgcccggctgtgcctgctggcctttgccctgcagcccctgcggccccgggccgcccgggagcccggctggacccggggcagcgaggagggcagccccaagctgcagcacgagctgatcatcccccagtggaagaccagcgagagccctgtgcgggagaagcaccccctgaaggccgagctgcgggtgatggccgagggccgggagctgatcctggacctggagaagaatgagcagctgtttgcccccagctacacagagacccactacaccagcagcggcaacccccagaccaccaccaggaagctggaggaccactgcttctaccacggcaccgtgcgggagacagagctgagctctgtgaccctgagcacctgccggggcatccggggcctcatcaccgtgagcagcaacctgtcctatgtgattgagcccctgcctgacagcaagggccagcacctgatctacagaagtgagcacctgaagcccccacctggcaactgtggctttgagcacagcaagcccaccacccgggactgggccctgcagttcacccagcagaccaagaagaggcccaggaggatgaagcgggaggacctgaacagcatgaagtatgtggagctgtacctggtggccgactacctggagttccagaagaacagaagagaccaggatgccaccaagcacaagctgattgagatcgccaactacgtggacaagttctaccgcagcctgaacatcagaattgccctggtgggcctggaggtgtggacccacggcaacatgtgtgaggtgtctgagaacccctacagcaccctgtggagcttcctgtcctggaggaggaagctgctggcccagaagtaccatgacaatgcccagctgatcaccggcatgtccttccacggcaccaccatcggcctggcccccctgatggccatgtgcagcgtgtaccagagcggaggagtgaacatggaccacagtgaaaatgccatcggcgtggccgccaccatggcccacgagatgggccacaactttggcatgacccatgattctgctgactgctgcagcgccagcgctgctgatggcggctgcatcatggccgccgccaccggccaccccttccccaaggtgttcaacggctgcaacagaagagagctggaccgctacctgcagagcggcggcggcatgtgcctgagcaacatgccagacaccaggatgctgtatggaggaagaagatgtggaaatggctacctggaggatggagaagaatgtgactgtggggaggaggaggagtgcaacaacccctgctgcaatgccagcaactgcaccctgcggcctggagcagaatgtgcccacggcagctgctgccaccagtgcaagctgctggcccctggcaccctgtgccgggagcaggcccggcagtgtgacctgcctgagttctgcaccgggaagagcccccactgccccaccaacttctaccagatggatggcaccccctgtgagggcggccaggcctactgctacaacggcatgtgcctgacctaccaggagcagtgccagcagctgtggggccctggggcccggcctgccccagacctgtgctttgagaaggtgaatgtggccggggacacctttggaaactgtgggaaggacatgaatggagagcacaggaagtgcaacatgagagatgccaagtgtgggaagatccagtgccagagcagcgaggcccggcccctggagagcaatgctgtgcccatcgacaccaccatcatcatgaatggccggcagatccagtgccggggcacccacgtgtaccggggccctgaggaggagggggacatgctggaccccggcctggtgatgacaggcaccaagtgtggctacaaccacatctgctttgagggccagtgcaggaacaccagcttctttgaaacagagggctgtgggaagaagtgcaatggacatggagtgtgcaacaacaaccagaactgccactgcctgcccggctgggccccacccttctgcaacaccccaggccacggcggcagcattgacagcggccccatgcctcctgagagcgtgggccctgtggtggccggcgtgctggtggccatcctggtgctggccgtgctgatgctgatgtactactgctgccggcagaacaacaagctgggccagctgaagcccagcgccctgcccagcaagctgcggcagcagttcagctgccccttccgggtgtcccagaacagcggcaccggccacgccaaccccaccttcaagctgcagaccccccagggcaagaggaaggtgatcaacaccccagagatcctgaggaagcccagccagcccccacccaggcctcctccagactacctgcggggcggcagccccccagcccccctgcctgcccacctgagccgggccgccaggaacagccctggccctggcagccagattgaaagaacagagagcagccggcggcccccacccagccggcccatccccccagcccccaactgcatcgtgtcccaggacttcagccggcccaggcctccccagaaggccctgcctgccaaccctgtgcccggccgccgcagcctgcccaggcctgggggcgccagccccctgcggcccccaggagctggcccccagcagagccggcccctggccgccctggcccccaagtttcctgagtaccgcagccagagagctgggggcatgatcagcagcaagatctag

SEQ ID NO: 142594 - DNA, 2763 bp, Artificial Sequence
  Description of Artificial Sequence: Synthetic coding sequence
atgcctgggggcgctggggccgcccggctgtgcctgctggcctttgccctgcagcccctgcggccccgggccgcccgggagcccggctggaccatcagccggggcagcgaggagggcagccccaagctgcagcacgagctgatcatcccccagtggaagaccagcgagagccctgtgcgggagaagcaccccctgaaggccgagctgcgggtgatggccgagggccgggagctgatcctggacctggagaagaatgagcagctgtttgcccccagctacacagagacccactacaccagcagcggcaacccccagaccaccaccaggaagctggaggaccactgcttctaccacggcaccgtgcgggagacagagctgagctctgtgaccctgagcacctgccggggcatccggggcctcatcaccgtgagcagcaacctgtcctatgtgattgagcccctgcctgacagcaagggccagcacctgatctacagaagtgagcacctgaagcccccacctggcaactgtggctttgagcacagcaagcccaccacccgggactgggccctgcagttcacccagcagaccaagaagaggcccaggaggatgaagcgggaggacctgaacagcatgaagtatgtggagctgtacctggtggccgactacctggagttccagaagaacagaagagaccaggatgccaccaagcacaagctgattgagatcgccaactacgtggacaagttctaccgcagcctgaacatcagaattgccctggtgggcctggaggtgtggacccacggcaacatgtgtgaggtgtctgagaacccctacagcaccctgtggagcttcctgtcctggaggaggaagctgctggcccagaagtaccatgacaatgcccagctgatcaccggcatgtccttccacggcaccaccatcggcctggcccccctgatggccatgtgcagcgtgtaccagagcggaggagtgaacatggaccacagtgaaaatgccatcggcgtggccgccaccatggcccacgagatgggccacaactttggcatgacccatgattctgctgactgctgcagcgccagcgctgctgatggcggctgcatcatggccgccgccaccggccaccccttccccaaggtgttcaacggctgcaacagaagagagctggaccgctacctgcagagcggcggcggcatgtgcctgagcaacatgccagacaccaggatgctgtatggaggaagaagatgtggaaatggctacctggaggatggagaagaatgtgactgtggggaggaggaggagtgcaacaacccctgctgcaatgccagcaactgcaccctgcggcctggagcagaatgtgcccacggcagctgctgccaccagtgcaagctgctggcccctggcaccctgtgccgggagcaggcccggcagtgtgacctgcctgagttctgcaccgggaagagcccccactgccccaccaacttctaccagatggatggcaccccctgtgagggcggccaggcctactgctacaacggcatgtgcctgacctaccaggagcagtgccagcagctgtggggccctggggcccggcctgccccagacctgtgctttgagaaggtgaatgtggccggggacacctttggaaactgtgggaaggacatgaatggagagcacaggaagtgcaacatgagagatgccaagtgtgggaagatccagtgccagagcagcgaggcccggcccctggagagcaatgctgtgcccatcgacaccaccatcatcatgaatggccggcagatccagtgccggggcacccacgtgtaccggggccctgaggaggagggggacatgctggaccccggcctggtgatgacaggcaccaagtgtggctacaaccacatctgctttgagggccagtgcaggaacaccagcttctttgaaacagagggctgtgggaagaagtgcaatggacatggagtgtgcaacaacaaccagaactgccactgcctgcccggctgggccccacccttctgcaacaccccaggccacggcggcagcattgacagcggccccatgcctcctgagagcgtgggccctgtggtggccggcgtgctggtggccatcctggtgctggccgtgctgatgctgatgtactactgctgccggcagaacaacaagctgggccagctgaagcccagcgccctgcccagcaagctgcggcagcagttcagctgccccttccgggtgtcccagaacagcggcaccggccacgccaaccccaccttcaagctgcagaccccccagggcaagaggaaggtgatcaacaccccagagatcctgaggaagcccagccagcccccacccaggcctcctccagactacctgcggggcggcagccccccagcccccctgcctgcccacctgagccgggccgccaggaacagccctggccctggcagccagattgaaagaacagagagcagccggcggcccccacccagccggcccatccccccagcccccaactgcatcgtgtcccaggacttcagccggcccaggcctccccagaaggccctgcctgccaaccctgtgcccggccgccgcagcctgcccaggcctgggggcgccagccccctgcggcccccaggagctggcccccagcagagccggcccctggccgccctggcccccaagtttcctgagtaccgcagccagagagctgggggcatgatcagcagcaagatctag

SEQ ID NO: 142595 - DNA, 1917 bp, Artificial Sequence
  Description of Artificial Sequence: Synthetic coding sequence
atgtgtgaggtgtctgagaacccctacagcaccctgtggagcttcctgtcctggaggaggaagctgctggcccagaagtaccatgacaatgcccagctgatcaccggcatgtccttccacggcaccaccatcggcctggcccccctgatggccatgtgcagcgtgtaccagagcggcggcgtgaacatggaccacagtgaaaatgccatcggcgtggccgccaccatggcccacgagatgggccacaactttggcatgacccatgacagcgctgactgctgcagcgccagcgctgctgatggcggctgcatcatggctgctgccaccggccaccccttccccaaggtgttcaacggctgcaacagaagagagctggaccgctacctgcagagcggcggcggcatgtgcctgagcaacatgccagacaccaggatgctgtatggaggccgccgctgtggaaatggctacctggaggatggagaggagtgtgactgtggggaggaggaggagtgcaacaacccctgctgcaatgccagcaactgcaccctgcggcctggagcagaatgtgcccacggcagctgctgccaccagtgcaagctgctggcccctggcaccctgtgccgggagcaggcccggcagtgtgacctgcctgagttctgcaccgggaagagcccccactgccccaccaacttctaccagatggatggcaccccctgtgagggcggccaggcctactgctacaacggcatgtgcctgacctaccaggagcagtgccagcagctgtggggccctggggcccggcctgccccagacctgtgctttgagaaggtgaatgtggccggggacaccttcggcaactgtgggaaggacatgaatggagagcacaggaagtgcaacatgagagatgccaagtgtgggaagatccagtgccagagcagcgaggcccggcccctggagagcaatgctgtgcccatcgacaccaccatcatcatgaatggccggcagatccagtgccggggcacccacgtgtaccggggccctgaggaggagggggacatgctggaccccggcctggtgatgacaggcaccaagtgtggctacaaccacatctgctttgagggccagtgcaggaacaccagcttctttgaaacagagggctgcggcaagaagtgcaatggccacggcgtgtgcaacaacaaccagaactgccactgcctgcccggctgggccccacccttctgcaacaccccaggccatggaggcagcattgattctggccccatgcctcctgagagcgtgggccctgtggtggccggcgtgctggtggccatcctggtgctggccgtgctgatgctgatgtactactgctgccggcagaacaacaagctgggccagctgaagcccagcgccctgcccagcaagctgcggcagcagttcagctgccccttccgggtgtcccagaacagcggcactggacatgccaaccccaccttcaagctgcagaccccccagggcaagaggaaggtgatcaacaccccagagatcctgaggaagcccagccagcccccaccccggcccccaccagactacctgcggggcggcagccccccagcccccctgcctgcccacctgagcagagctgccaggaacagccctggccctggcagccagatcgagaggacagagagcagcagaagacctccacccagccggcccatccccccagcccccaactgcatcgtgtcccagaagtgcctgctgcccccagccatgatcctgcgggccccccagcccagcggcaccgtggtgtgcctggtgatctccttcaacatggccttctaccgctccatgaggatcagaattgagcccggcatcaagaccaagctgctggtgctgctggtgtggaagcagttctag

SEQ ID NO: 142596 - DNA, 2868 bp, Artificial Sequence
  Description of Artificial Sequence: Synthetic coding sequence
atgcctgggggcgctggggccgcccggctgtgcctgctggcctttgccctgcagcccctgcggccccgggccgcccgggagcccggctggacccggggcagcgaggagggcagccccaagctgcagcacgagctgatcatcccccagtggaagaccagcgagagccctgtgcgggagaagcaccccctgaaggccgagctgcgggtgatggccgagggccgggagctgatcctggacctggagaagaatgagcagctgtttgcccccagctacacagagacccactacaccagcagcggcaacccccagaccaccaccaggaagctggaggaccactgcttctaccacggcaccgtgcgggagacagagctgagctctgtgaccctgagcacctgccggggcatccggggcctcatcaccgtgagcagcaacctgtcctatgtgattgagcccctgcctgacagcaagggccagcacctgatctacagaagtgagcacctgaagcccccacctggcaactgtggctttgagcacagcaagcccaccacccgggactgggccctgcagttcacccagcagaccaagaagaggcccaggaggatgaagcgggaggacctgaacagcatgaagtatgtggagctgtacctggtggccgactacctggagttccagaagaacagaagagaccaggatgccaccaagcacaagctgattgagatcgccaactacgtggacaagttctaccgcagcctgaacatcagaattgccctggtgggcctggaggtgtggacccacggcaacatgtgtgaggtgtctgagaacccctacagcaccctgtggagcttcctgtcctggaggaggaagctgctggcccagaagtaccatgacaatgcccagctgatcaccggcatgtccttccacggcaccaccatcggcctggcccccctgatggccatgtgcagcgtgtaccagagcggaggagtgaacatggaccacagtgaaaatgccatcggcgtggccgccaccatggcccacgagatgggccacaactttggcatgacccatgattctgctgactgctgcagcgccagcgctgctgatggcggctgcatcatggccgccgccaccggccaccccttccccaaggtgttcaacggctgcaacagaagagagctggaccgctacctgcagagcggcggcggcatgtgcctgagcaacatgccagacaccaggatgctgtatggaggaagaagatgtggaaatggctacctggaggatggagaagaatgtgactgtggggaggaggaggagtgcaacaacccctgctgcaatgccagcaactgcaccctgcggcctggagcagaatgtgcccacggcagctgctgccaccagtgcaagctgctggcccctggcaccctgtgccgggagcaggcccggcagtgtgacctgcctgagttctgcaccgggaagagcccccactgccccaccaacttctaccagatggatggcaccccctgtgagggcggccaggcctactgctacaacggcatgtgcctgacctaccaggagcagtgccagcagctgtggggccctggggcccggcctgccccagacctgtgctttgagaaggtgaatgtggccggggacacctttggaaactgtgggaaggacatgaatggagagcacaggaagtgcaacatgagagatgccaagtgtgggaagatccagtgccagagcagcgaggcccggcccctggagagcaatgctgtgcccatcgacaccaccatcatcatgaatggccggcagatccagtgccggggcacccacgtgtaccggggccctgaggaggagggggacatgctggaccccggcctggtgatgacaggcaccaagtgtggctacaaccacatctgctttgagggccagtgcaggaacaccagcttctttgaaacagagggctgtgggaagaagtgcaatggacatggagtgtgcaacaacaaccagaactgccactgcctgcccggctgggccccacccttctgcaacaccccaggccacggcggcagcattgacagcggccccatgcctcctgagagcgtgggccctgtggtggccggcgtgctggtggccatcctggtgctggccgtgctgatgctgatgtactactgctgccggcagaacaacaagctgggccagctgaagcccagcgccctgcccagcaagctgcggcagcagttcagctgccccttccgggtgtcccagaacagcggcaccggccacgccaaccccaccttcaagctgcagaccccccagggcaagaggaaggtgatcaacaccccagagatcctgaggaagcccagccagcccccacccaggcctcctccagactacctgcggggcggcagccccccagcccccctgcctgcccacctgagccgggccgccaggaacagccctggccctggcagccagattgaaagaacagagagcagccggcggcccccacccagccggcccatccccccagcccccaactgcatcgtgtcccaggacttcagccggcccaggcctccccagaaggccctgcctgccaaccctgtgcccggccgccgcagcctgcccaggcctgggggcgccagccccctgcggcccccaggagctggcccccagcagagccggcccctggccgccctggcccccaaggtgagcccccgggaggccctgaaggtgaaggccggcacccggggcctgcagggcggccgctgccgggtggagaagaccaagcagttcatgctgctggtggtgtggacagagctgcctgagcagaagccccgggccaagcacagctgcttcctggtgcctgcctag

SEQ ID NO: 142597 - DNA, 2208 bp, Artificial Sequence
  Description of Artificial Sequence: Synthetic coding sequence
atgtggagggtgctcttcctgctgagcggcctgggcggcctgaggatggacagcaactttgacagcctgcctgtgcagatcaccgtgcctgagaagatccgcagcatcatcaaggagggcatcgagagccaggccagctacaagatcgtgattgagggcaagccctacacagtgaacctgatgcagaagaacttcctgccccacaacttccgggtgtacagctacagcggcaccggcatcatgaagcccctggaccaggacttccagaacttctgccactaccagggctacatcgagggctaccccaagtctgtggtgatggtgtccacctgcaccggcctgcggggcgtgctgcagtttgaaaatgtgtcctatggaattgagcccctggagagctctgtgggctttgagcacgtgatctaccaggtgaagcacaagaaggcagatgtgtccctgtacaatgagaaggacatcgagagccgggacctgtccttcaagctgcagagcgtggagccccagcaggactttgccaagtacatcgagatgcacgtgattgtggagaagcagctgtacaaccacatgggcagtgacaccaccgtggtggcccagaaggtgttccagctgattggcctgaccaatgccatctttgtgtccttcaacatcaccatcatcctgagcagcctggagctgtggattgatgagaacaagatcgccaccaccggggaggccaatgagctgctgcacaccttcctgcgctggaagaccagctacctggtgctgcggccccatgatgtggccttcctgctggtgtaccgggagaagagcaactacgtgggcgccaccttccagggcaagatgtgtgatgccaactatgctgggggcgtggtgctgcaccccaggaccatcagcctggagagcctggccgtcatcctggcccagctgctgagcctgtccatgggcatcacctatgatgacatcaacaagtgccagtgcagcggggctgtgtgcatcatgaaccctgaggccatccacttcagcggcgtgaagatcttcagcaactgcagctttgaagattttgcccacttcatcagcaagcagaagagccagtgcctgcacaaccagccccggctggaccccttcttcaagcagcaggccgtgtgtggaaatgccaagctggaggccggggaggagtgtgactgtggcacagagcaggactgtgccctgattggagagacctgctgtgacatcgccacctgccgcttcaaggccggcagcaactgtgccgagggcccctgctgtgagaactgcctcttcatgagcaaggagaggatgtgccggcccagctttgaagaatgtgacctgcctgagtactgcaatggcagcagcgccagctgcccagagaaccactacgtgcagacaggccacccctgtggcctgaaccagtggatctgcattgatggagtgtgcatgtctggggacaagcagtgcacagacaccttcggcaaggaggtggagtttggccccagcgagtgctacagccacctgaacagcaagacagatgtgtctggcaactgtggcatcagtgacagcggctacacccagtgtgaggccgacaacctgcagtgtgggaagctgatctgcaagtatgtgggcaagttcctgctgcagatcccccgggccaccatcatctatgccaacatcagcggccacctgtgcatcgctgtggagtttgccagtgaccacgccgacagccagaagatgtggatcaaggatggcaccagctgtggcagcaacaaggtgtgcaggaaccagagatgtgtgagcagcagctacctgggctatgactgcaccacagacaagtgcaatgacagaggagtgtgcaacaacaagaagcactgccactgcagcgccagctacctgcccccagactgcagcgtgcagagcgacctgtggccaggcggcagcattgacagcggcaacttcccccctgtggccatcccagcccggctgcctgagcggcgctacatcgagaacatctaccacagcaagcccatgcgctggcccttcttcctgttcatccccttcttcatcatcttctgtgtgctgattgccatcatggtgaaggtgaacttccagaggaagaagtggaggacagaggactacagcagtgatgagcagcctgagagcgagagcgagcccaagggctag

SEQ ID NO: 142598 - DNA, 2151 bp, Artificial Sequence
  Description of Artificial Sequence: Synthetic coding sequence
atgtggagggtgctcttcctgctgagcggcctgggcggcctgaggatggacagcaactttgacagcctgcctgtgcagatcaccgtgcctgagaagatccgcagcatcatcaaggagggcatcgagagccaggccagctacaagatcgtgattgagggcaagccctacacagtgaacctgatgcagaagaacttcctgccccacaacttccgggtgtacagctacagcggcaccggcatcatgaagcccctggaccaggacttccagaacttctgccactaccagggctacatcgagggctaccccaagtctgtggtgatggtgtccacctgcaccggcctgcggggcgtgctgcagtttgaaaatgtgtcctatggaattgagcccctggagagctctgtgggctttgagcacgtgatctaccaggtgaagcacaagaaggcagatgtgtccctgtacaatgagaaggacatcgagagccgggacctgtccttcaagctgcagagcgtggagtacaaccacatgggcagtgacaccaccgtggtggcccagaaggtgttccagctgattggcctgaccaatgccatctttgtgtccttcaacatcaccatcatcctgagcagcctggagctgtggattgatgagaacaagatcgccaccactggagaggccaatgagctgctgcacaccttcctgcgctggaagaccagctacctggtgctgcggccccatgatgtggccttcctgctggtgtaccgggagaagagcaactacgtgggcgccaccttccagggcaagatgtgtgatgccaactatgctgggggcgtggtgctgcaccccaggaccatcagcctggagagcctggccgtcatcctggcccagctgctgagcctgtccatgggcatcacctatgatgacatcaacaagtgccagtgcagcggggctgtgtgcatcatgaaccctgaggccatccacttctctggagtgaagatcttcagcaactgcagctttgaggactttgcccacttcatcagcaagcagaagagccagtgcctgcacaaccagccccggctggaccccttcttcaagcagcaggccgtgtgtggaaatgccaagctggaggccggggaggagtgtgactgtggcacagagcaggactgtgccctgattggagagacctgctgtgacatcgccacctgccgcttcaaggccggcagcaactgtgccgagggcccctgctgtgagaactgcctcttcatgagcaaggagaggatgtgccggcccagctttgaggagtgtgacctgcctgagtactgcaatggcagcagcgccagctgcccagagaaccactacgtgcagacaggccacccctgtggcctgaaccagtggatctgcattgatggagtgtgcatgtctggggacaagcagtgcacagacaccttcggcaaggaggtggagtttggccccagcgagtgctacagccacctgaacagcaagacagatgtgtctggcaactgtggcatcagtgacagcggctacacccagtgtgaggccgacaacctgcagtgtgggaagctgatctgcaagtatgtgggcaagttcctgctgcagatcccccgggccaccatcatctatgccaacatcagcggccacctgtgcatcgctgtggagtttgccagtgaccatgctgacagccagaagatgtggatcaaggatggcaccagctgtggcagcaacaaggtgtgcaggaaccagagatgtgtgagcagcagctacctgggctatgactgcaccacagacaagtgcaatgaccggggcgtgtgcaacaacaagaagcactgccactgcagcgccagctacctgcccccagactgcagcgtgcagagcgacctgtggccaggcggcagcattgattctggcaacttcccccctgtggccatcccagcccggctgcctgagcggcgctacatcgagaacatctaccacagcaagcccatgcgctggcccttcttcctgttcatccccttcttcatcatcttctgtgtgctgattgccatcatggtgaaggtgaacttccagaggaagaagtggaggacagaggactacagcagtgatgagcagcctgagagcgagagcgagcccaagggctag

SEQ ID NO: 142599 - DNA, 2331 bp, Artificial Sequence
  Description of Artificial Sequence: Synthetic coding sequence
atggtgcagctgcaccaggacacagacccccagatccccaagggccagccctgcaccctgaacagcagcgagggcggggcccggcctgctgtgccccacaccctcttcagcagcgccctggaccgctggctgcacaatgacagcttcatcatggctgtgggggagcccctggtgcacatccgggtgaccctgctgctgctgtggtttggcatgttcctgagcatcagcggccacagccaggcccggcccagccagtacttcaccagccctgaggtggtgatccccctgaaggtgatcagccggggccgcggggccaaggcccctggctggctgagctacagcctgcgctttggaggccagcgctacatcgtgcacatgagggtgaacaagctgctgtttgctgcccacctgcccgtcttcacctacacagagcagcacgccctgctgcaggaccagcccttcatccaggatgactgctactaccacggctacgtggagggcgtgcctgagagcctggtggccctgagcacctgcagcggcggcttcctgggcatgctgcagatcaatgacctggtgtatgagatcaagcccatctctgtgtctgccacctttgagcacctggtgtacaagattgacagtgatgacacccagtttcctcccatgagatgtggcctgacagaggagaagatcgcccaccagatggagctgcagctgagctacaacttcaccctgaagcagagcagctttgtgggctggtggacccaccagagatttgtggagctggtggtggtggtggacaacatccgctacctgttcagccagagcaatgccaccaccgtgcagcacgaggtgttcaacgtggtgaacatcgtggacagcttctaccaccccctggaggtggatgtgatcctgactggaattgacatctggacagccagcaaccccctgcccaccagcggggacctggacaacgtgctggaggacttcagcatctggaagaactacaacctgaacaaccggctgcagcatgatgtggcccacctgttcatcaaggacacccagggcatgaagctgggcgtggcctacgtgaagggcatctgccagaaccccttcaacacaggagtggatgtgtttgaggacaaccggctggtggtgtttgccatcaccctgggccacgagctgggccacaacctgggcatgcagcacgacacccagtggtgtgtgtgtgagctgcagtggtgcatcatgcacgcctacaggaaggtgaccaccaagttcagcaactgcagctatgcccagtactgggacagcaccatcagcagcggcctgtgcatccagcccccaccctacccaggcaacatcttccggctgaagtactgcggcaacctggtggtggaggagggggaggagtgtgactgtggcaccatccggcagtgtgccaaggacccctgctgcctgctgaactgcaccctgcaccctggagctgcctgtgccttcggcatctgctgcaaggactgcaagttcctgcccagcggcaccctgtgccggcagcaggtgggagaatgtgacctgcctgagtggtgcaatggcaccagccaccagtgcccagatgatgtgtatgtgcaggacggcatcagctgcaatgtgaatgccttctgctatgagaagacctgcaacaaccacgacatccagtgcaaggagatcttcggccaggatgcccggagcgccagccagagctgctaccaggagatcaacacccagggcaacagatttggccactgcggcatcgtgggcaccacctacgtgaagtgctggaccccagacatcatgtgtggccgggtgcagtgtgaaaatgtgggcgtcatccccaacctgattgagcacagcacagtgcagcagttccacctgaatgacaccacctgctggggcacagactaccacctgggcatggccatcccagacattggagaggtgaaggatggcaccgtgtgtggccctgagaagatctgcatcaggaagaagtgtgcctccatggtgcacctgagccaggcctgccagcccaagacctgcaacatgaggggcatctgcaacaacaagcagcactgccactgcaaccacgagtgggccccaccctactgcaaggacaagggctacggcggcagcgctgacagcggccccccacccaagaacaacatggagggcctgaatgtgatgggcaagctgcgctacctgagcctgctgtgcctgctgcccctggtggccttcctgctcttctgcctgcacgtgctcttcaagaagaggaccaagagcaaggaggatgaggagggctag

SEQ ID NO: 142600 - DNA, 2169 bp, Artificial Sequence
  Description of Artificial Sequence: Synthetic coding sequence
atggctgtggatggcaccctggtgtacatccgggtgaccctgctgctgctgtggctgggcgtcttcctgagcatcagcggctactgccaggccggccccagccagcacttcaccagccctgaggtggtgatccccctgaaggtgatcagccggggccgcagcgccaaggcccctggctggctgagctacagcctgcgctttggaggccagaagcacgtggtgcacatgagggtgaagaagctgctggtgagccgccacctgcccgtcttcacctacacagatgaccgggccctgctggaggaccagctgttcatcccagatgactgctactaccacggctacgtggaggccgcccctgagagcctggtggtgttcagcgcctgctttggaggcttccggggcgtgctgaagatcagcggcctgacctatgaaattgagcccatccgccacagcgccacctttgagcacctggtgtacaagatcaacagcaatgagacccagtttcctgccatgagatgtggcctgacagagaaggaggtggcccggcagcagctggagtttgaggaggctgaaaattctgccctggagcccaagtctgctggggactggtggacccacgcctggttcctggagctggtggtggtggtgaaccacgacttcttcatctacagccagagcaacatcagcaaggtgcaggaggatgtgttcctggtggtgaacatcgtggacagcatgtacaagcagctgggcacctacatcatcctgattggcatcgagatctggaaccagggcaatgtgttccccatgaccagcattgagcaggtgctgaatgacttcagccagtggaagcagatcagcctgagccagctgcagcatgatgctgcccacatgttcatcaagaacagcctcatcagcatcctgggcctggcctacgtggccggcatctgccggccccccatcgactgtggggtggacaacttccagggcgacacctggagcctgtttgccaacacagtggcccacgagctgggccacaccctgggcatgcagcatgatgaggagttctgcttctgtggggagcggggctgcatcatgaacaccttccgggtgcctgctgagaagttcaccaactgcagctatgctgacttcatgaagaccaccctgaaccagggcagctgcctgcacaaccccccccggctgggggagatcttcatgctgaagagatgtggaaatggagtggtggagcgggaggagcagtgtgactgtggctctgtgcagcagtgtgagcaggatgcctgctgcctgctgaactgcaccctgcggcctggggccgcctgtgccttcggcctgtgctgcaaggactgcaagttcatgcccagcggggagctgtgccggcaggaggtgaatgaatgtgacctgcctgagtggtgcaatggcaccagccaccagtgcccagaggacagatatgtgcaggacggcatcccctgcagcgacagcgcctactgctaccagaagcgctgcaacaaccacgaccagcactgccgggagatctttgggaaggatgccaagagcgccagccagaactgctacaaggagatcaacagccagggcaaccgcttcggccactgcggcatcaatggcaccacctacctgaagtgccacatcagtgatgtgttctgtggccgggtgcagtgtgaaaatgtgcgggacatccccctgctgcaggaccacttcaccctgcagcacacccacatcaacggggtgacctgctggggcatcgactaccacctgaggatgaacatcagtgacatcggggaggtgaaggatggcaccgtgtgtggccctgggaagatctgcatccacaagaagtgtgtgtccctgtctgtgctgagccacgtgtgcctgcctgagacctgcaacatgaagggcatctgcaacaacaagcaccactgccactgcggctacggctggagccccccctactgccagcaccggggctatggaggcagcattgattctggccctgccagcgccaagaggggcgtcttcctgcccctgattgtcatccccagcctgtctgtgctgaccttcctgttcaccgtgggcctgctgatgtacctgcggcagtgcagcggccccaaggagaccaaggcccacagcagtggatag

SEQ ID NO: 142601 - DNA, 2721 bp, Artificial Sequence
  Description of Artificial Sequence: Synthetic coding sequence
atgcaggccgctgtggccgtgtctgtgcccttcctgctgctgtgtgtgctgggcacctgccccccagcccgctgtggccaggccggagatgccagcctgatggagctggagaagaggaaagaaaatagatttgtggagcggcagagcatcgtgcccctgcggctcatctacagaagtggaggagaagatgagagcagacatgatgccctggacaccagggtgcggggggacctgggcggcccccagctgacccacgtggaccaggccagcttccaggtggatgccttcggcaccagcttcatcctggatgtggtgctgaaccacgacctgctgagcagcgagtacatcgagcggcacatcgagcacggcggcaagacagtggaggtgaagggcggggagcactgctactaccagggccacatccggggcaacccagacagctttgtggccctgagcacctgccacggcctgcacggcatgttttatgatggcaaccacacctacctgattgagcctgaggagaatgacaccacccaggaggacttccacttccacagcgtgtacaagagccggctgtttgagttcagcctggatgacctgcccagcgagttccagcaggtgaacatcacccccagcaagttcatcctgaagccccggcccaagaggagcaagaggcagctgcggcgctaccccagaaatgtggaggaggagaccaagtacatcgagctgatgattgtgaatgaccacctgatgttcaagaagcaccggctgtctgtggtgcacaccaacacctacgccaagtctgtggtgaacatggctgacctgatctacaaggaccagctgaagaccagaattgtgctggtggccatggagacctgggccacagacaacaagtttgccatcagcgagaaccccctcatcaccctgcgggagttcatgaagtaccgccgggacttcatcaaggagaagagtgatgctgtgcacctgttcagcggcagccagtttgagagcagccgcagcggggccgcctacatcggcggcatctgcagcctgctgaagggcggcggcgtgaatgaatttgggaagacagacctgatggctgtgaccctggcccagagcctggcccacaacatcggcatcatcagtgacaagaggaagctggccagcggagaatgtaaatgtgaggacacctggagcggctgcatcatgggagacaccggctactacctgcccaagaagttcacccagtgcaacatcgaggagtaccatgacttcctgaacagcggcggcggggcctgcctcttcaacaagcccagcaagctgctggaccccccagaatgtggaaatggcttcatcgagaccggggaggagtgtgactgtggcaccccagcagaatgtgtgctggagggcgctgagtgctgcaagaagtgcaccctgacccaggacagccagtgcagtgatggcctgtgctgcaagaagtgcaagttccagcccatgggcaccgtgtgccgggaggccgtgaatgactgtgacatccgggagacctgcagcggcaacagcagccagtgtgcccccaacatccacaagatggatggctacagctgtgatggagtgcagggcatctgctttggaggccgctgcaagacccgggaccggcagtgcaagtacatctggggccagaaggtgacagccagtgacaagtactgctatgagaagctgaacatcgagggcacagagaagggcaactgtgggaaggacaaggacacctggatccagtgcaacaagagagatgtgctgtgtggctacctgctgtgcaccaacatcggcaacatcccccggctgggggagctggatggagagatcaccagcaccctggtggtgcagcagggccgcaccctgaactgcagcggcggccacgtgaagctggaggaggatgtggacctgggctacgtggaggatggcaccccctgtggcccccagatgatgtgcctggagcaccgctgcctgcctgtggccagcttcaacttcagcacctgcctgagcagcaaggagggcaccatctgcagcggaaatggagtgtgcagcaatgagctgaagtgtgtgtgcaacagacactggattggaagtgactgcaacacctacttcccccacaatgatgatgccaagacaggcatcaccctgtctggaaatggagtggccggcaccaacatcatcatcggcatcatcgccggcaccatcctggtgctggccctgatcctgggcatcacagcctggggctacaagaactaccgggagcagaggcagctgccccagggcgactatgtgaagaagccaggagatggagacagcttctacagcgacatccccccaggagtgtccaccaacagcgccagcagcagcaagaagaggagcaatggcctgagccacagctggagcgagcgcatcccagacaccaagcacatcagtgacatctgtgaaaatggccggcccaggagcaacagctggcagggcaacctgggcggcaacaagaagaagatccggggcaagcgcttccggcccaggagcaacagcacagagaccctgagccctgccaagagccccagcagcagcacaggcagcatcgccagcagcaggaagtacccctaccccatgccacccctgcctgatgaggacaagaaggtgaaccggcagagcgcccggctgtgggagaccagcatctag

SEQ ID NO: 142602 - DNA, 2700 bp, Artificial Sequence
  Description of Artificial Sequence: Synthetic coding sequence
atgcaggccgctgtggccgtgtctgtgcccttcctgctgctgtgtgtgctgggcacctgccccccagcccgctgtggccaggccggagatgccagcctgatggagctggagaagaggaaagaaaatagatttgtggagcggcagagcatcgtgcccctgcggctcatctacagaagtggaggagaagatgagagcagacatgatgccctggacaccagggtgcggggggacctgggcggcccccagctgacccacgtggaccaggccagcttccaggtggatgccttcggcaccagcttcatcctggatgtggtgctgaaccacgacctgctgagcagcgagtacatcgagcggcacatcgagcacggcggcaagacagtggaggtgaagggcggggagcactgctactaccagggccacatccggggcaacccagacagctttgtggccctgagcacctgccacggcctgcacggcatgttttatgatggcaaccacacctacctgattgagcctgaggagaatgacaccacccaggaggacttccacttccacagcgtgtacaagagccggctgtttgagttcagcctggatgacctgcccagcgagttccagcaggtgaacatcacccccagcaagttcatcctgaagccccggcccaagaggagcaagaggcagctgcggcgctaccccagaaatgtggaggaggagaccaagtacatcgagctgatgattgtgaatgaccacctgatgttcaagaagcaccggctgtctgtggtgcacaccaacacctacgccaagtctgtggtgaacatggctgacctgatctacaaggaccagctgaagaccagaattgtgctggtggccatggagacctgggccacagacaacaagtttgccatcagcgagaaccccctcatcaccctgcgggagttcatgaagtaccgccgggacttcatcaaggagaagagtgatgctgtgcacctgttcagcggcagccagtttgagagcagccgcagcggggccgcctacatcggcggcatctgcagcctgctgaagggcggcggcgtgaatgaatttgggaagacagacctgatggctgtgaccctggcccagagcctggcccacaacatcggcatcatcagtgacaagaggaagctggccagcggagaatgtaaatgtgaggacacctggagcggctgcatcatgggagacaccggctactacctgcccaagaagttcacccagtgcaacatcgaggagtaccatgacttcctgaacagcggcggcggggcctgcctcttcaacaagcccagcaagctgctggaccccccagaatgtggaaatggcttcatcgagaccggggaggagtgtgactgtggcaccccagcagaatgtgtgctggagggcgctgagtgctgcaagaagtgcaccctgacccaggacagccagtgcagtgatggcctgtgctgcaagaagtgcaagttccagcccatgggcaccgtgtgccgggaggccgtgaatgactgtgacatccgggagacctgcagcggcaacagcagccagtgtgcccccaacatccacaagatggatggctacagctgtgatggagtgcagggcatctgctttggaggccgctgcaagacccgggaccggcagtgcaagtacatctggggccagaaggtgacagccagtgacaagtactgctatgagaagctgaacatcgagggcacagagaagggcaactgtgggaaggacaaggacacctggatccagtgcaacaagagagatgtgctgtgtggctacctgctgtgcaccaacatcggcaacatcccccggctgggggagctggatggagagatcaccagcaccctggtggtgcagcagggccgcaccctgaactgcagcggcggccacgtgaagctggaggaggatgtggacctgggctacgtggaggatggcaccccctgtggcccccagatgatgtgcctggagcaccgctgcctgcctgtggccagcttcaacttcagcacctgcctgagcagcaaggagggcaccatctgcagcggaaatggagtgtgcagcaatgagctgaagtgtgtgtgcaacagacactggattggaagtgactgcaacacctacttcccccacaatgatgatgccaagacaggcatcaccctgtctggaaatggagtggccggcaccaacatcatcatcggcatcatcgccggcaccatcctggtgctggccctgatcctgggcatcacagcctggggctacaacaacatcttcaacttccgcagcaatggcctgagccacagctggagcgagcgcatcccagacaccaagcacatcagtgacatctgtgaaaatggccggcccaggagcaacagctggcagggcaacctgggcggcaacaagaagaagatccggggcaagcgcttccggcccaggagcaacagcacagagtacctgaacccctggttcaagagggactacaacgtggccaagtgggtggaggatgtgaacaagaacacagagggcccctacttccgcaccctgagccctgccaagagccccagcagcagcacaggcagcatcgccagcagcaggaagtacccctaccccatgccacccctgcctgatgaggacaagaaggtgaaccggcagagcgcccggctgtgggagaccagcatctag

SEQ ID NO: 142603 - DNA, 2580 bp, Artificial Sequence
  Description of Artificial Sequence: Synthetic coding sequence
atgcaggccgctgtggccgtgtctgtgcccttcctgctgctgtgtgtgctgggcacctgccccccagcccgctgtggccaggccggagatgccagcctgatggagctggagaagaggaaagaaaatagatttgtggagcggcagagcatcgtgcccctgcggctcatctacagaagtggaggagaagatgagagcagacatgatgccctggacaccagggtgcggggggacctgggcggcccccagctgacccacgtggaccaggccagcttccaggtggatgccttcggcaccagcttcatcctggatgtggtgctgaaccacgacctgctgagcagcgagtacatcgagcggcacatcgagcacggcggcaagacagtggaggtgaagggcggggagcactgctactaccagggccacatccggggcaacccagacagctttgtggccctgagcacctgccacggcctgcacggcatgttttatgatggcaaccacacctacctgattgagcctgaggagaatgacaccacccaggaggacttccacttccacagcgtgtacaagagccggctgtttgagttcagcctggatgacctgcccagcgagttccagcaggtgaacatcacccccagcaagttcatcctgaagccccggcccaagaggagcaagaggcagctgcggcgctaccccagaaatgtggaggaggagaccaagtacatcgagctgatgattgtgaatgaccacctgatgttcaagaagcaccggctgtctgtggtgcacaccaacacctacgccaagtctgtggtgaacatggctgacctgatctacaaggaccagctgaagaccagaattgtgctggtggccatggagacctgggccacagacaacaagtttgccatcagcgagaaccccctcatcaccctgcgggagttcatgaagtaccgccgggacttcatcaaggagaagagtgatgctgtgcacctgttcagcggcagccagtttgagagcagccgcagcggggccgcctacatcggcggcatctgcagcctgctgaagggcggcggcgtgaatgaatttgggaagacagacctgatggctgtgaccctggcccagagcctggcccacaacatcggcatcatcagtgacaagaggaagctggccagcggagaatgtaaatgtgaggacacctggagcggctgcatcatgggagacaccggctactacctgcccaagaagttcacccagtgcaacatcgaggagtaccatgacttcctgaacagcggcggcggggcctgcctcttcaacaagcccagcaagctgctggaccccccagaatgtggaaatggcttcatcgagaccggggaggagtgtgactgtggcaccccagcagaatgtgtgctggagggcgctgagtgctgcaagaagtgcaccctgacccaggacagccagtgcagtgatggcctgtgctgcaagaagtgcaagttccagcccatgggcaccgtgtgccgggaggccgtgaatgactgtgacatccgggagacctgcagcggcaacagcagccagtgtgcccccaacatccacaagatggatggctacagctgtgatggagtgcagggcatctgctttggaggccgctgcaagacccgggaccggcagtgcaagtacatctggggccagaaggtgacagccagtgacaagtactgctatgagaagctgaacatcgagggcacagagaagggcaactgtgggaaggacaaggacacctggatccagtgcaacaagagagatgtgctgtgtggctacctgctgtgcaccaacatcggcaacatcccccggctgggggagctggatggagagatcaccagcaccctggtggtgcagcagggccgcaccctgaactgcagcggcggccacgtgaagctggaggaggatgtggacctgggctacgtggaggatggcaccccctgtggcccccagatgatgtgcctggagcaccgctgcctgcctgtggccagcttcaacttcagcacctgcctgagcagcaaggagggcaccatctgcagcggaaatggagtgtgcagcaatgagctgaagtgtgtgtgcaacagacactggattggaagtgactgcaacacctacttcccccacaatgatgatgccaagacaggcatcaccctgtctggaaatggagtggccggcaccaacatcatcatcggcatcatcgccggcaccatcctggtgctggccctgatcctgggcatcacagcctggggctacaagaactaccgggagcagaggcagctgccccagggcgactatgtgaagaagccaggagatggagacagcttctacagcgacatccccccaggagtgtccaccaacagcgccagcagcagcaagaagaggagcaatggcctgagccacagctggagcgagcgcatcccagacaccaagcacatcagtgacatctgtgaaaatggccggcccaggagcaacagctggcagggcaacctgggcggcaacaagaagaagatccggggcaagcgcttccggcccaggagcaacagcacagaatag

SEQ ID NO: 142604 - DNA, 2613 bp, Artificial Sequence
  Description of Artificial Sequence: Synthetic coding sequence
atgcaggccgctgtggccgtgtctgtgcccttcctgctgctgtgtgtgctgggcacctgccccccagcccgctgtggccaggccggagatgccagcctgatggagctggagaagaggaaagaaaatagatttgtggagcggcagagcatcgtgcccctgcggctcatctacagaagtggaggagaagatgagagcagacatgatgccctggacaccagggtgcggggggacctgggcggcccccagctgacccacgtggaccaggccagcttccaggtggatgccttcggcaccagcttcatcctggatgtggtgctgaaccacgacctgctgagcagcgagtacatcgagcggcacatcgagcacggcggcaagacagtggaggtgaagggcggggagcactgctactaccagggccacatccggggcaacccagacagctttgtggccctgagcacctgccacggcctgcacggcatgttttatgatggcaaccacacctacctgattgagcctgaggagaatgacaccacccaggaggacttccacttccacagcgtgtacaagagccggctgtttgagttcagcctggatgacctgcccagcgagttccagcaggtgaacatcacccccagcaagttcatcctgaagccccggcccaagaggagcaagaggcagctgcggcgctaccccagaaatgtggaggaggagaccaagtacatcgagctgatgattgtgaatgaccacctgatgttcaagaagcaccggctgtctgtggtgcacaccaacacctacgccaagtctgtggtgaacatggctgacctgatctacaaggaccagctgaagaccagaattgtgctggtggccatggagacctgggccacagacaacaagtttgccatcagcgagaaccccctcatcaccctgcgggagttcatgaagtaccgccgggacttcatcaaggagaagagtgatgctgtgcacctgttcagcggcagccagtttgagagcagccgcagcggggccgcctacatcggcggcatctgcagcctgctgaagggcggcggcgtgaatgaatttgggaagacagacctgatggctgtgaccctggcccagagcctggcccacaacatcggcatcatcagtgacaagaggaagctggccagcggagaatgtaaatgtgaggacacctggagcggctgcatcatgggagacaccggctactacctgcccaagaagttcacccagtgcaacatcgaggagtaccatgacttcctgaacagcggcggcggggcctgcctcttcaacaagcccagcaagctgctggaccccccagaatgtggaaatggcttcatcgagaccggggaggagtgtgactgtggcaccccagcagaatgtgtgctggagggcgctgagtgctgcaagaagtgcaccctgacccaggacagccagtgcagtgatggcctgtgctgcaagaagtgcaagttccagcccatgggcaccgtgtgccgggaggccgtgaatgactgtgacatccgggagacctgcagcggcaacagcagccagtgtgcccccaacatccacaagatggatggctacagctgtgatggagtgcagggcatctgctttggaggccgctgcaagacccgggaccggcagtgcaagtacatctggggccagaaggtgacagccagtgacaagtactgctatgagaagctgaacatcgagggcacagagaagggcaactgtgggaaggacaaggacacctggatccagtgcaacaagagagatgtgctgtgtggctacctgctgtgcaccaacatcggcaacatcccccggctgggggagctggatggagagatcaccagcaccctggtggtgcagcagggccgcaccctgaactgcagcggcggccacgtgaagctggaggaggatgtggacctgggctacgtggaggatggcaccccctgtggcccccagatgatgtgcctggagcaccgctgcctgcctgtggccagcttcaacttcagcacctgcctgagcagcaaggagggcaccatctgcagcggaaatggagtgtgcagcaatgagctgaagtgtgtgtgcaacagacactggattggaagtgactgcaacacctacttcccccacaatgatgatgccaagacaggcatcaccctgtctggaaatggagtggccggcaccaacatcatcatcggcatcatcgccggcaccatcctggtgctggccctgatcctgggcatcacagcctggggctacaagaactaccgggagcagaggagcaatggcctgagccacagctggagcgagcgcatcccagacaccaagcacatcagtgacatctgtgaaaatggccggcccaggagcaacagctggcagggcaacctgggcggcaacaagaagaagatccggggcaagcgcttccggcccaggagcaacagcacagagaccctgagccctgccaagagccccagcagcagcacaggcagcatcgccagcagcaggaagtacccctaccccatgccacccctgcctgatgaggacaagaaggtgaaccggcagagcgcccggctgtgggagaccagcatctag

SEQ ID NO: 142605 - DNA, 2700 bp, Artificial Sequence
  Description of Artificial Sequence: Synthetic coding sequence
atgcaggccgctgtggccgtgtctgtgcccttcctgctgctgtgtgtgctgggcacctgccccccagcccgctgtggccaggccggagatgccagcctgatggagctggagaagaggaaagaaaatagatttgtggagcggcagagcatcgtgcccctgcggctcatctacagaagtggaggagaagatgagagcagacatgatgccctggacaccagggtgcggggggacctgggcggcccccagctgacccacgtggaccaggccagcttccaggtggatgccttcggcaccagcttcatcctggatgtggtgctgaaccacgacctgctgagcagcgagtacatcgagcggcacatcgagcacggcggcaagacagtggaggtgaagggcggggagcactgctactaccagggccacatccggggcaacccagacagctttgtggccctgagcacctgccacggcctgcacggcatgttttatgatggcaaccacacctacctgattgagcctgaggagaatgacaccacccaggaggacttccacttccacagcgtgtacaagagccggctgtttgagttcagcctggatgacctgcccagcgagttccagcaggtgaacatcacccccagcaagttcatcctgaagccccggcccaagaggagcaagaggcagctgcggcgctaccccagaaatgtggaggaggagaccaagtacatcgagctgatgattgtgaatgaccacctgatgttcaagaagcaccggctgtctgtggtgcacaccaacacctacgccaagtctgtggtgaacatggctgacctgatctacaaggaccagctgaagaccagaattgtgctggtggccatggagacctgggccacagacaacaagtttgccatcagcgagaaccccctcatcaccctgcgggagttcatgaagtaccgccgggacttcatcaaggagaagagtgatgctgtgcacctgttcagcggcagccagtttgagagcagccgcagcggggccgcctacatcggcggcatctgcagcctgctgaagggcggcggcgtgaatgaatttgggaagacagacctgatggctgtgaccctggcccagagcctggcccacaacatcggcatcatcagtgacaagaggaagctggccagcggagaatgtaaatgtgaggacacctggagcggctgcatcatgggagacaccggctactacctgcccaagaagttcacccagtgcaacatcgaggagtaccatgacttcctgaacagcggcggcggggcctgcctcttcaacaagcccagcaagctgctggaccccccagaatgtggaaatggcttcatcgagaccggggaggagtgtgactgtggcaccccagcagaatgtgtgctggagggcgctgagtgctgcaagaagtgcaccctgacccaggacagccagtgcagtgatggcctgtgctgcaagaagtgcaagttccagcccatgggcaccgtgtgccgggaggccgtgaatgactgtgacatccgggagacctgcagcggcaacagcagccagtgtgcccccaacatccacaagatggatggctacagctgtgatggagtgcagggcatctgctttggaggccgctgcaagacccgggaccggcagtgcaagtacatctggggccagaaggtgacagccagtgacaagtactgctatgagaagctgaacatcgagggcacagagaagggcaactgtgggaaggacaaggacacctggatccagtgcaacaagagagatgtgctgtgtggctacctgctgtgcaccaacatcggcaacatcccccggctgggggagctggatggagagatcaccagcaccctggtggtgcagcagggccgcaccctgaactgcagcggcggccacgtgaagctggaggaggatgtggacctgggctacgtggaggatggcaccccctgtggcccccagatgatgtgcctggagcaccgctgcctgcctgtggccagcttcaacttcagcacctgcctgagcagcaaggagggcaccatctgcagcggaaatggagtgtgcagcaatgagctgaagtgtgtgtgcaacagacactggattggaagtgactgcaacacctacttcccccacaatgatgatgccaagacaggcatcaccctgtctggaaatggagtggccggcaccaacatcatcatcggcatcatcgccggcaccatcctggtgctggccctgatcctgggcatcacagcctggggctacaagaactaccgggagcagaggagcaatggcctgagccacagctggagcgagcgcatcccagacaccaagcacatcagtgacatctgtgaaaatggccggcccaggagcaacagctggcagggcaacctgggcggcaacaagaagaagatccggggcaagcgcttccggcccaggagcaacagcacagagtacctgaacccctggttcaagagggactacaacgtggccaagtgggtggaggatgtgaacaagaacacagagggcccctacttccgcaccctgagccctgccaagagccccagcagcagcacaggcagcatcgccagcagcaggaagtacccctaccccatgccacccctgcctgatgaggacaagaaggtgaaccggcagagcgcccggctgtgggagaccagcatctag

SEQ ID NO: 142606 - DNA, 2328 bp, Artificial Sequence
  Description of Artificial Sequence: Synthetic coding sequence
atgctgcagggcctgctgcctgtgtccctgctgctgtctgtggccgtgtctgccatcaaggagctgcccggggtgaagaagtatgaggtggtgtaccccatccggctgcaccccctgcacaagcgggaggccaaggagcctgagcagcaggagcagtttgaaacagagctgaagtacaagatgaccatcaacgggaagattgctgtgctgtacctgaagaagaacaagaacctgctggcccctggctacacagagacctactacaacagcacaggcaaggagatcaccaccagcccccagatcatggatgactgctactaccagggccacatcctgaatgagaaggtgtctgatgccagcatcagcacctgccggggcctgcggggctacttcagccagggcgaccagcgctacttcatcgagcccctgagccccatccacagagatggccaggagcacgccctcttcaagtacaacccagatgagaagaactatgacagcacctgtggcatggatggagtgctgtgggcccatgacctgcagcagaacatcgccctgcctgccaccaagctggtgaagctgaaggacaggaaggtgcaggagcacgagaagtacatcgagtactacctggtgctggacaacggggagttcaagcgctacaatgaaaaccaggatgagatcaggaagagggtgtttgagatggccaactacgtgaacatgctgtacaagaagctgaacacccacgtggccctggtgggcatggagatctggacagacaaggacaagatcaagatcaccccaaatgccagcttcaccctggagaacttcagcaagtggaggggctctgtgctgagcaggaggaagagacatgacatcgcccagctgatcacagccacagagctggccggcaccaccgtgggcctggccttcatgagcaccatgtgcagcccctacagcgtgggcgtggtgcaggaccacagcgacaacctgctgcgggtggccggcaccatggcccacgagatgggccacaactttggcatgtttcatgatgactacagctgcaagtgccccagcaccatctgtgtgatggacaaggccctgtccttctacatccccacagacttcagcagctgcagccggctgtcctatgacaagttctttgaggacaagctgagcaactgcctcttcaatgcccccctgcccacagacatcatcagcacccccatctgtggcaaccagctggtggagatgggagaggactgtgactgtggcaccagcgaggagtgcaccaacatctgctgtgatgccaagacctgcaagatcaaggccaccttccagtgtgccctgggggagtgctgtgagaagtgccagttcaagaaggccggcatggtgtgcaggcctgccaaggatgaatgtgacctgcctgagatgtgcaatggcaagagcggcaactgcccagatgaccgcttccaggtgaatggcttcccctgccaccacggcaagggccactgcctgatgggcacctgccccaccctgcaggagcagtgcacagagctgtggggccctggaacagaggtggccgacaagagctgctacaacagaaatgaaggaggcagcaaatatggctactgcagaagagtggatgacaccctcatcccctgcaaggccaatgacaccatgtgtgggaagctgttctgccagggcggcagtgacaacctgccctggaagggcagaattgtgaccttcctgacctgcaagacctttgatcctgaggacaccagccaggagatcggcatggtggccaacggcaccaagtgtggggacaacaaggtgtgcatcaatgcagaatgtgtggacatcgagaaggcctacaagagcaccaactgcagcagcaagtgcaagggccatgctgtgtgtgaccacgagctgcagtgccagtgtgaggagggctggatccccccagactgtgatgacagctctgtggtgttccacttcagcatcgtggtgggcgtgctcttccccatggccgtcatctttgtggtggtggccatggtgatccgccaccagagcagccgggagaagcagaagaaggaccagaggcccctgagcaccaccggcacccggccccacaagcagaagaggaagccccagatggtgaaggctgtgcagccccaggagatgagccagatgaagccccacgtgtatgacctgcctgtggagggcaatgagcccccagccagcttccacaaggacaccaatgccctgccccccaccgtcttcaaggacaaccctgtgtccacccccaaggacagcaaccccaaggcctag

SEQ ID NO: 142607 - DNA, 1452 bp, Artificial Sequence
  Description of Artificial Sequence: Synthetic coding sequence
atggagatctggacagacaaggacaagatcaagatcaccccaaatgccagcttcaccctggagaacttcagcaagtggaggggctctgtgctgagcaggaggaagagacatgacatcgcccagctgatcacagccacagagctggccggcaccaccgtgggcctggccttcatgagcaccatgtgcagcccctacagcgtgggcgtggtgcaggaccacagcgacaacctgctgcgggtggccggcaccatggcccacgagatgggccacaactttggcatgtttcatgatgactacagctgcaagtgccccagcaccatctgtgtgatggacaaggccctgtccttctacatccccacagacttcagcagctgcagccggctgtcctatgacaagttctttgaggacaagctgagcaactgcctcttcaatgcccccctgcccacagacatcatcagcacccccatctgtggcaaccagctggtggagatgggagaggactgtgactgtggcaccagtgaagaatgtaccaacatctgctgtgatgccaagacctgcaagatcaaggccaccttccagtgtgccctgggggagtgctgtgagaagtgccagttcaagaaggccggcatggtgtgcaggcctgccaaggatgaatgtgacctgcctgagatgtgcaatggcaagagcggcaactgcccagatgaccgcttccaggtgaatggcttcccctgccaccacggcaagggccactgcctgatgggcacctgccccaccctgcaggagcagtgcacagagctgtggggccctggaacagaggtggccgacaagagctgctacaacagaaatgaaggaggcagcaaatatggctactgccggcgggtggatgacaccctcatcccctgcaaggccaatgacaccatgtgtgggaagctgttctgccagggcggcagtgacaacctgccctggaagggccgcatcgtgaccttcctgacctgcaagacctttgatcctgaggacaccagccaggagatcggcatggtggccaacggcaccaagtgtggggacaacaaggtgtgcatcaatgcagaatgtgtggacatcgagaaggcctacaagagcaccaactgcagcagcaaatgtaaaggacatgctgtgtgtgaccacgagctgcagtgccagtgtgaggagggctggatccccccagactgtgatgacagctctgtggtgttccggcggctgctgcactgcggctggggcgctgtgcccaatggaggccacttctgtggcggctgctacggcaacccagcccctgagctgcagaggaaggccgaggagaggtctgaggccaccatctaccactggcaccaggccacccagacagaggaggagaccccagatggcaagggctgcagcaccccaagagatgaaagtgatgaggccccctgtgtgtag

SEQ ID NO: 142608 - DNA, 1623 bp, Artificial Sequence
  Description of Artificial Sequence: Synthetic coding sequence
atgctgcagggcctgctgcctgtgtccctgctgctgtctgtggccgtgtctgccatcaaggagctgcccggggtgaagaagtatgaggtggtgtaccccatccggctgcaccccctgcacaagcgggaggccaaggagcctgagcagcaggagcagtttgaaacagagctgaagtacaagatgaccatcaacgggaagattgctgtgctgtacctgaagaagaacaagaacctgctggcccctggctacacagagacctactacaacagcacaggcaaggagatcaccaccagcccccagatcatggatgactgctactaccagggccacatcctgaatgagaaggtgtctgatgccagcatcagcacctgccggggcctgcggggctacttcagccagggcgaccagcgctacttcatcgagcccctgagccccatccacagagatggccaggagcacgccctcttcaagtacaacccagatgagaagaactatgacagcacctgtggcatggatggagtgctgtgggcccatgacctgcagcagaacatcgccctgcctgccaccaagctggtgaagctgaaggacaggaaggtgcaggagcacgagaagtacatcgagtactacctggtgctggacaacggggagttcaagcgctacaatgaaaaccaggatgagatcaggaagagggtgtttgagatggccaactacgtgaacatgctgtacaagaagctgaacacccacgtggccctggtgggcatggagatctggacagacaaggacaagatcaagatcaccccaaatgccagcttcaccctggagaacttcagcaagtggaggggctctgtgctgagcaggaggaagagacatgacatcgcccagctgatcacagccacagagctggccggcaccaccgtgggcctggccttcatgagcaccatgtgcagcccctacagcgtgggcgtggtgcaggaccacagcgacaacctgctgcgggtggccggcaccatggcccacgagatgggccacaactttggcatgtttcatgatgactacagctgcaagtgccccagcaccatctgtgtgatggacaaggccctgtccttctacatccccacagacttcagcagctgcagccggctgtcctatgacaagttctttgaggacaagctgagcaactgcctcttcaatgcccccctgcccacagacatcatcagcacccccatctgtggcaaccagctggtggagatgggagaggactgtgactgtggcaccagcgaggagtgcaccaacatctgctgtgatgccaagacctgcaagatcaaggccaccttccagtgtgccctgggggagtgctgtgagaagtgccagttcaagaaggccggcatggtgtgcaggcctgccaaggatgaatgtgacctgcctgagatgtgcaatggcaagagcggcaactgcccagatgaccgcttccaggtgaatggcttcccctgccaccacggcaagggccactgcctgatgggcacctgccccaccctgcaggagcagtgcacagagctgtggggccctggccgccgcaccaaccccttcccctgtgcctgtgccaaggagaaccacttcagatag

SEQ ID NO: 142609 - DNA, 924 bp, Artificial Sequence
  Description of Artificial Sequence: Synthetic coding sequence
atggccaactacgtgaacatgctgtacaagaagctgaacacccacgtggccctggtgggcatggagatctggacagacaaggacaagatcaagatcaccccaaatgccagcttcaccctggagaacttcagcaagtggaggggctctgtgctgagcaggaggaagagacatgacatcgcccagctgatcacagccacagagctggccggcaccaccgtgggcctggccttcatgagcaccatgtgcagcccctacagcgtgggcgtggtgcaggaccacagcgacaacctgctgcgggtggccggcaccatggcccacgagatgggccacaactttggcatgtttcatgatgactacagctgcaagtgccccagcaccatctgtgtgatggacaaggccctgtccttctacatccccacagacttcagcagctgcagccggctgtcctatgacaagttctttgaggacaagctgagcaactgcctcttcaatgcccccctgcccacagacatcatcagcacccccatctgtggcaaccagctggtggagatgggagaggactgtgactgtggcaccagtgaagaatgtaccaacatctgctgtgatgccaagacctgcaagatcaaggccaccttccagtgtgccctgggggagtgctgtgagaagtgccagttcaagaaggccggcatggtgtgcaggcctgccaaggatgaatgtgacctgcctgagatgtgcaatggcaagagcggcaactgcccagatgaccgcttccaggtgaatggcttcccctgccaccacggcaagggccactgcctgatgggcacctgccccaccctgcaggagcagtgcacagagctgtggggccctggaagaaggaccaaccccttcccctgtgcctgtgccaaggagaaccacttcagatag

SEQ ID NO: 142610 - DNA, 2463 bp, Artificial Sequence
  Description of Artificial Sequence: Synthetic coding sequence
atgaagatgctgctgctgctgcactgcctgggcgtcttcctgagctgcagcggccacatccaggatgagcacccccagtaccacagccccccagatgtggtgattcctgtgcgcatcaccggcaccacccggggcatgaccccacctggctggctgagctacatcctgccctttggaggccagaagcacatcatccacatcaaggtgaagaagctgctcttcagcaagcacctgcctgtgttcacctacacagaccagggcgccatcctggaggaccagccctttgtgcagaacaactgctactaccacggctacgtggagggggaccctgagagcctggtgtccctgagcacctgcttcggcggcttccagggcatcctgcagatcaatgactttgcctatgagatcaagcccctggccttcagcaccacctttgagcacctggtgtacaagatggacagcgaggagaagcagttcagcaccatgaggagcggcttcatgcagaatgagatcacctgcaggatggagtttgaggagattgacaacagcacccagaagcagagcagctatgtgggctggtggatccacttcagaattgtggagatcgtggtggtgattgacaactacctgtacatccgctatgaaagaaatgacagcaagctgctggaggacctgtatgtgattgtgaacatcgtggacagcatcctggatgtgattggagtgaaggtgctgctgtttggcctggagatctggaccaacaagaacctgattgtggtggatgatgtgaggaagtctgtgcacctgtactgcaagtggaagtctgagaacatcacccccaggatgcagcacgacaccagccacctgttcaccaccctgggcctgcggggcctgagcggcatcggggccttccggggcatgtgcaccccccacaggagctgtgccatcgtgaccttcatgaacaagaccctgggcaccttcagcattgctgtggcccaccacctgggccacaacctgggcatgaaccatgatgaggacacctgccgctgcagccagccccgctgcatcatgcatgagggcaacccccccatcaccaagttcagcaactgcagctatggagacttctgggagtacacagtggagaggaccaagtgcctgctggagaccgtgcacaccaaggacatcttcaacgtgaagagatgtggaaatggagtggtggaggagggggaggagtgtgactgtggccccctgaagcactgtgccaaggacccctgctgcctgagcaactgcaccctgacagatggcagcacctgtgccttcggcctgtgctgcaaggactgcaagttcctgcccagcggcaaggtgtgcaggaaggaggtgaatgaatgtgacctgcctgagtggtgcaatggcaccagccacaagtgcccagatgacttctacgtggaggatggcatcccctgcaaggagcggggctactgctatgagaagagctgccacgacagaaatgagcagtgccgccgcatctttggagctggggccaacacagccagcgagacctgctacaaggagctgaacaccctgggggacagagtgggccactgcggcatcaagaatgccacctacatcaagtgcaacatcagtgatgtgcagtgtggccgcatccagtgtgaaaatgtgacagagatccccaacatgtctgaccacaccaccgtgcactgggcccgcttcaatgacatcatgtgctggagcacagactaccacctgggcatgaagggccctgacattggagaggtgaaggatggaacagaatgtggcatcgaccacatctgcatccaccgccactgtgtgcacatcaccatcctgaacagcaactgcagccctgccttctgcaacaagaggggcatctgcaacaacaagcaccactgccactgcaactacctgtgggacccccccaactgcctgatcaagggctacggcggctctgtggacagcggccccccacccaagaggaagaagaagaagaagttctgctacctgtgcatcctgctgctgattgtgctcttcatcctgctgtgctgcctgtaccgcctgtgcaagaagagcaagcccatcaagaagcagcaggatgtgcagacccccagcgccaaggaggaggagaagatccagaggcggccccatgagctgcccccccagagccagccctgggtgatgcccagccagagccagccccctgtgacccccagccagagccacccccaggtgatgcccagccagagccagccccctgtgacccccagccagagccagccccgggtgatgcccagccagagccagccccctgtgatgcccagccagagccacccccagctgacccccagccagagccagccccctgtgacccccagccagaggcagccccagctgatgcccagccagagccagccccctgtgacccccagctag

SEQ ID NO: 142611 - DNA, 2463 bp, Artificial Sequence; identical to SEQ ID NO: 142610
  Description of Artificial Sequence: Synthetic coding sequence

SEQ ID NO: 142612 - DNA, 2463 bp, Artificial Sequence; identical to SEQ ID NO: 142610
  Description of Artificial Sequence: Synthetic coding sequence

SEQ ID NO: 142613 - DNA, 135 bp, Artificial Sequence
  Description of Artificial Sequence: Synthetic coding sequence
atgaagatgctgctgctgctgcactgcctgggcgtcttcctgagctgcagcggccacatccaggatgagcacccccagtaccacagccccccagatgtggtgattcctgtgcgcatcaccggcaccaccaggtag

SEQ ID NO: 142614 - DNA, 273 bp, Artificial Sequence
  Description of Artificial Sequence: Synthetic coding sequence
atgaagatgctgctgctgctgcactgcctgggcgtcttcctgagctgcagcggccacatccaggatgagcacccccagtaccacagccccccagatgtggtgattcctgtgcgcatcaccggcaccacccggggcatgaccccacctggctggctgagctacatcctgccctttggaggccagaagcacatcatccacatcaaggtgaagaagctgctcttcagcaagcacctgcctgtgttcacctacacagaccagggcgccatcctgtag

SEQ ID NO: 142615 - DNA, 45 bp, Artificial Sequence
  Description of Artificial Sequence: Synthetic coding sequence
atgaagatgctgctgctgctgcactgcctgggcgtcttcctgtag

SEQ ID NO: 142616 - DNA, 2463 bp, Artificial Sequence; identical to SEQ ID NO: 142610
  Description of Artificial Sequence: Synthetic coding sequence

SEQ ID NO: 142617 - DNA, 2373 bp, Artificial Sequence
  Description of Artificial Sequence: Synthetic coding sequence
atgaggtctgtgcagatcttcctgagccagtgccgcctgctgctgctgctggtgcccaccatgctgctgaagagcctgggggaggatgtgatcttccaccctgagggggagtttgacagctatgaggtgaccatccctgagaagctgtccttccggggggaggtgcagggcgtggtgtcccctgtgtcctacctgctgcagctgaagggcaagaagcacgtgctgcacctgtggcccaagaggctgctgctgcccaggcacctgcgggtcttctccttcacagagcacggggagctgctggaggaccacccctacatccccaaggactgcaactacatgggctctgtgaaggagagcctggacagcaaggccaccatcagcacctgcatgggcggcctgcggggcgtcttcaacattgatgccaagcactaccagatcgagcccctgaaggccagccccagctttgaacatgtggtgtacctgctgaagaaggagcagtttggaaaccaggtgtgtggcctgagtgatgatgaaattgagtggcagatggccccctatgagaacaaggcccggctgcgggacttccctggcagctacaagcaccccaagtacctggagctgatcctgctgtttgaccagagccgctacagatttgtgaacaacaacctgagccaggtgattcatgatgccatcctgctgaccggcatcatggacacctacttccaggatgtgaggatgaggatccacctgaaggccctggaggtgtggacagacttcaacaagatccgggtgggctacccagagctggccgaggtgctgggccgcttcgtcatctacaagaagtctgtgctgaatgcccggctgagcagtgactgggcccacctgtacctgcagaggaagtacaatgatgccctggcctggagctttgggaaggtgtgcagcctggagtatgccggctctgtgtccaccctgctggacaccaacatcctggccccagccacctggagcgcccacgagctgggccatgctgtgggcatgagccatgatgagcagtactgccagtgccggggccgcctgaactgcatcatgggcagcggccgcacaggcttcagcaactgcagctacatctccttcttcaagcacatcagcagcggggccacctgcctgaacaacatccctggcctgggctacgtgctgaagagatgtggcaacaagatcgtggaggacaatgaggagtgtgactgtggcagcacagaggagtgccagaaggaccgctgctgccagagcaactgcaagctgcagcccggggccaactgcagcatcggcctgtgctgccacgactgccgcttccggcccagcggctacgtgtgccggcaggagggcaatgaatgtgacctggccgagtactgtgatggcaacagcagcagctgccccaatgatgtgtacaagcaggacggcaccccctgcaagtatgagggccgctgcttcaggaagggctgccgcagccgctacatgcagtgccagagcatctttggaccagatgccatggaggcccccagtgaatgttatgatgctgtgaacctgattggagaccagtttggaaactgtgagatcaccggcatccggaacttcaagaagtgtgagagcgccaacagcatctgtggccgcctgcagtgcatcaacgtggagaccatcccagacctgcctgagcacaccaccatcatcagcacccacctgcaggccgagaacctgatgtgctggggcaccggctaccacctgtccatgaagcccatgggcatcccagacctgggcatgatcaatgatggcaccagctgtggggagggccgggtgtgcttcaagaagaactgtgtgaacagctctgtgctgcagtttgactgcctgcctgagaagtgcaacacccggggcgtgtgcaacaacaggaagaactgccactgcatgtatggctgggccccacccttctgtgaggaggtgggctacggcggcagcattgacagcggccccccaggcctgctgcggggggccatccccagcagcatctgggtggtgtccatcatcatgttccgcctcatcctgctgatcctgtctgtggtgtttgtgttcttccggcaggtgattggcaaccacctgaagcccaagcaggagaagatgcccctgagcaaggccaagacagagcaggaggagagcaagaccaagacagtgcaggaggagagcaagaccaagacaggccaggaggagagcgaggccaagacaggccaggaggagagcaaggccaagacaggccaggaggagagcaaggccaacatcgagagcaagaggcccaaggccaagtctgtgaagaagcagaagaagtag

SEQ ID NO: 142618 - DNA, 2346 bp, Artificial Sequence
  Description of Artificial Sequence: Synthetic coding sequence
atgaggtctgtgcagatcttcctgagccagtgccgcctgctgctgctgctggtgcccaccatgctgctgaagagcctgggggaggatgtgatcttccaccctgagggggagtttgacagctatgaggtgaccatccctgagaagctgtccttccggggggaggtgcagggcgtggtgtcccctgtgtcctacctgctgcagctgaagggcaagaagcacgtgctgcacctgtggcccaagaggctgctgctgcccaggcacctgcgggtcttctccttcacagagcacggggagctgctggaggaccacccctacatccccaaggactgcaactacatgggctctgtgaaggagagcctggacagcaaggccaccatcagcacctgcatgggcggcctgcggggcgtcttcaacattgatgccaagcactaccagatcgagcccctgaaggccagccccagctttgaacatgtggtgtacctgctgaagaaggagcagtttggaaaccaggtgtgtggcctgagtgatgatgaaattgagtggcagatggccccctatgagaacaaggcccggctgcgggacttccctggcagctacaagcaccccaagtacctggagctgatcctgctgtttgaccagagccgctacagatttgtgaacaacaacctgagccaggtgattcatgatgccatcctgctgaccggcatcatggacacctacttccaggatgtgaggatgaggatccacctgaaggccctggaggtgtggacagacttcaacaagatccgggtgggctacccagagctggccgaggtgctgggccgcttcgtcatctacaagaagtctgtgctgaatgcccggctgagcagtgactgggcccacctgtacctgcagaggaagtacaatgatgccctggcctggagctttgggaaggtgtgcagcctggagtatgccggctctgtgtccaccctgctggacaccaacatcctggccccagccacctggagcgcccacgagctgggccatgctgtgggcatgagccatgatgagcagtactgccagtgccggggccgcctgaactgcatcatgggcagcggccgcacaggcttcagcaactgcagctacatctccttcttcaagcacatcagcagcggggccacctgcctgaacaacatccctggcctgggctacgtgctgaagagatgtggcaacaagatcgtggaggacaatgaggagtgtgactgtggcagcacagaggagtgccagaaggaccgctgctgccagagcaactgcaagctgcagcccggggccaactgcagcatcggcctgtgctgccacgactgccgcttccggcccagcggctacgtgtgccggcaggagggcaatgaatgtgacctggccgagtactgtgatggcaacagcagcagctgccccaatgatgtgtacaagcaggacggcaccccctgcaagtatgagggccgctgcttcaggaagggctgccgcagccgctacatgcagtgccagagcatctttggaccagatgccatggaggcccccagtgaatgttatgatgctgtgaacctgattggagaccagtttggaaactgtgagatcaccggcatccggaacttcaagaagtgtgagagcgccaacagcatctgtggccgcctgcagtgcatcaacgtggagaccatcccagacctgcctgagcacaccaccatcatcagcacccacctgcaggccgagaacctgatgtgctggggcaccggctaccacctgtccatgaagcccatgggcatcccagacctgggcatgatcaatgatggcaccagctgtggggagggccgggtgtgcttcaagaagaactgtgtgaacagctctgtgctgcagtttgactgcctgcctgagaagtgcaacacccggggcgtgtgcaacaacaggaagaactgccactgcatgtatggctgggccccacccttctgtgaggaggtgggctacggcggcagcattgacagcggccccccaggcctgctgcggggggccatccccagcagcatctgggtggtgtccatcatcatgttccgcctcatcctgctgatcctgtctgtggtgtttgtgttcttccggcaggtgattggcaaccacctgaagcccaagcaggagaagatgcccctgagcaaggccaagacagagcaggaggagagcaagaccaagacagtgcaggaggagagcaagaccaagacaggccaggaggagagcgaggccaagacaggccaggaggagagcaaggccaacatcgagagcaagaggcccaaggccaagtctgtgaagaagcagaagaagtag

SEQ ID NO: 142619 - DNA, 540 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccagctgctggcccctggctacatcgagacccactacggcccagatggccagcctgtggtgctggcccccaaccacacagtgcgctgcttccacggcctgtgggatgcccctcctgagggcagaagagaggcccggaggaccaggaagtacctggagctgtacatcgtggccgaccacaccctcttcctgaccaggcacaggaacctgaaccacaccaagcagaggctgctggaggtggccaactacgtggaccaggtggtgaacagcgctggagatgcccacggctag

SEQ ID NO: 142620 - DNA, 336 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccagctgctggcccctggctacatcgagacccactacggccctgcccaggagtgccgggacctgtgctgctttgcccacaactag

SEQ ID NO: 142621 - DNA, 2364 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagaccactgccactaccagggccgggtgcggggcttcccagacagctgggtggtgctgtgcacctgcagcggcatgagcggcctcatcaccctgagcagaaatgccagctactacctgcggccctggccaccccggggcagcaaggacttcagcacccatgagatcttcaggatggagcagctgctgacctggaagggcacctgtggccaccgggaccccggcaacaaggccggcatgaccagcctgcccggcggcccccagagccggggccggcgggaggcccggaggaccaggaagtacctggagctgtacatcgtggccgaccacaccctcttcctgaccaggcacaggaacctgaaccacaccaagcagaggctgctggaggtggccaactacgtggaccagctgctgcggaccctggacatccaggtggccctgaccggcctggaggtgtggacagagcgggacaggagccgggtgacccaggatgccaatgccaccctgtgggccttcctgcagtggaggcggggcctgtgggcccagaggcctcatgattctgcccagctgctgaccggccgggccttccagggcgccaccgtgggcctggcccctgtggagggcatgtgcagagctgagagcagtggaggagtgtccacagaccacagcgagctgcccatcggggccgccgccaccatggcccatgaaattggccacagcctgggcctgagccatgaccctgatggctgctgcgtggaggccgctgctgagagcggcggctgtgtgatggctgctgccaccggccaccccttccccagggtcttcagcgcctgcagccggcggcagctgcgggccttcttcagaaaaggaggaggagcctgcctgagcaatgccccagaccccggcctgcctgtgcccccagccctgtgtggaaatggatttgtggaggccggggaggagtgtgactgtggccctggccaggagtgccgggacctgtgctgctttgcccacaactgcagcctgcggcctggggcccagtgtgcccatggagactgctgcgtgcgctgcctgctgaagccagctggggccctgtgccggcaggccatgggagactgtgacctgcctgagttctgcaccggcaccagcagccactgccccccagatgtgtacctgctggatggcagcccctgtgcccggggcagcggctactgctgggatggagcctgccccaccctggagcagcagtgccagcagctgtggggccctggcagccacccagcccctgaggcctgcttccaggtggtgaacagcgctggagatgcccacggcaactgtggccaggacagcgagggccacttcctgccctgtgccggcagagatgccctgtgtgggaagctgcagtgccagggcggcaagcccagcctgctggccccccacatggtgcctgtggacagcacagtgcacctggatggccaggaggtgacctgccgcggggccctggccctgcccagcgcccagctggacctgctgggcctgggcctggtggagcccggcacccagtgtggccccaggatggtgtgcaacagcaaccacaactgccactgtgcccctggctgggccccacccttctgtgacaagccaggctttggaggctccatggattctggccctgtgcaggctgaaaatcatgacaccttcctgctggccatgctgctgtctgtgctgctgcccctgctgcccggggccggcctggcctggtgctgctaccgcctgcccggggcccacctgcagcgctgctcctggggctgccggcgggaccctgcctgcagcggccccaaggatggcccccaccgggaccaccccctgggcggcgtgcaccccatggagctgggccccacagccaccggccagccctggcccctggaccctgagaacagccatgagcccagcagccaccctgagaagcccctgcctgctgtgtccccagacccccaggccgaccaggtgcagatgcccaggagctgcctgtggtag

SEQ ID NO: 142622 - DNA, 2442 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagaccactgccactaccagggccgggtgcggggcttcccagacagctgggtggtgctgtgcacctgcagcggcatgagcggcctcatcaccctgagcagaaatgccagctactacctgcggccctggccaccccggggcagcaaggacttcagcacccatgagatcttcaggatggagcagctgctgacctggaagggcacctgtggccaccgggaccccggcaacaaggccggcatgaccagcctgcccggcggcccccagagccggggccggcgggaggcccggaggaccaggaagtacctggagctgtacatcgtggccgaccacaccctcttcctgaccaggcacaggaacctgaaccacaccaagcagaggctgctggaggtggccaactacgtggaccagctgctgcggaccctggacatccaggtggccctgaccggcctggaggtgtggacagagcgggacaggagccgggtgacccaggatgccaatgccaccctgtgggccttcctgcagtggaggcggggcctgtgggcccagaggcctcatgattctgcccagctgctgaccggccgggccttccagggcgccaccgtgggcctggcccctgtggagggcatgtgcagagctgagagcagtggaggagtgtccacagaccacagcgagctgcccatcggggccgccgccaccatggcccatgaaattggccacagcctgggcctgagccatgaccctgatggctgctgcgtggaggccgctgctgagagcggcggctgtgtgatggctgctgccaccggccaccccttccccagggtcttcagcgcctgcagccggcggcagctgcgggccttcttcagaaaaggaggaggagcctgcctgagcaatgccccagaccccggcctgcctgtgcccccagccctgtgtggaaatggatttgtggaggccggggaggagtgtgactgtggccctggccaggagtgccgggacctgtgctgctttgcccacaactgcagcctgcggcctggggcccagtgtgcccatggagactgctgcgtgcgctgcctgctgaagccagctggggccctgtgccggcaggccatgggagactgtgacctgcctgagttctgcaccggcaccagcagccactgccccccagatgtgtacctgctggatggcagcccctgtgcccggggcagcggctactgctgggatggagcctgccccaccctggagcagcagtgccagcagctgtggggccctggcagccacccagcccctgaggcctgcttccaggtggtgaacagcgctggagatgcccacggcaactgtggccaggacagcgagggccacttcctgccctgtgccggcagagatgccctgtgtgggaagctgcagtgccagggcggcaagcccagcctgctggccccccacatggtgcctgtggacagcacagtgcacctggatggccaggaggtgacctgccgcggggccctggccctgcccagcgcccagctggacctgctgggcctgggcctggtggagcccggcacccagtgtggccccaggatggtgtgccagagccgccgctgcaggaagaatgccttccaggagctgcagcgctgcctgacagcctgccacagccacggcgtgtgcaacagcaaccacaactgccactgtgcccctggctgggccccacccttctgtgacaagccaggctttggaggctccatggattctggccctgtgcaggctgaaaatcatgacaccttcctgctggccatgctgctgtctgtgctgctgcccctgctgcccggggccggcctggcctggtgctgctaccgcctgcccggggcccacctgcagcgctgctcctggggctgccggcgggaccctgcctgcagcggccccaaggatggcccccaccgggaccaccccctgggcggcgtgcaccccatggagctgggccccacagccaccggccagccctggcccctggaccctgagaacagccatgagcccagcagccaccctgagaagcccctgcctgctgtgtccccagacccccaggccgaccaggtgcagatgcccaggagctgcctgtggtag

SEQ ID NO: 142623 - DNA, 417 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagtgcgctgcttccacggcctgtgggatgcccctcctgaggtgcccccccaccacagctacccctacagcagcctgcacagctag

SEQ ID NO: 142624 - DNA, 543 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccagctgctggcccctggctacatcgagacccactacggcccagatggccagcctgtggtgctggcccccaaccacacagtgcgctgcttccacggcctgtgggatgcccctcctgagggcagaagagaggcccggaggaccaggaagtacctggagctgtacatcgtggccgaccacaccctcttcctgaccaggcacaggaacctgaaccacaccaagcagaggctgctggaggtggccaactacgtggaccaggagtgccgggacctgtgctgctttgcccacaactag

SEQ ID NO: 142625 - DNA, 2439 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagaccactgccactaccagggccgggtgcggggcttcccagacagctgggtggtgctgtgcacctgcagcggcatgagcggcctcatcaccctgagcagaaatgccagctactacctgcggccctggccaccccggggcagcaaggacttcagcacccatgagatcttcaggatggagcagctgctgacctggaagggcacctgtggccaccgggaccccggcaacaaggccggcatgaccagcctgcccggcggcccccagagccggggccggcgggaggcccggaggaccaggaagtacctggagctgtacatcgtggccgaccacaccctcttcctgaccaggcacaggaacctgaaccacaccaagcagaggctgctggaggtggccaactacgtggaccagctgctgcggaccctggacatccaggtggccctgaccggcctggaggtgtggacagagcgggacaggagccgggtgacccaggatgccaatgccaccctgtgggccttcctgcagtggaggcggggcctgtgggcccagaggcctcatgattctgcccagctgctgaccggccgggccttccagggcgccaccgtgggcctggcccctgtggagggcatgtgcagagctgagagcagtggaggagtgtccacagaccacagcgagctgcccatcggggccgccgccaccatggcccatgaaattggccacagcctgggcctgagccatgaccctgatggctgctgcgtggaggccgctgctgagagcggcggctgtgtgatggctgctgccaccggccaccccttccccagggtcttcagcgcctgcagccggcggcagctgcgggccttcttcagaaaaggaggaggagcctgcctgagcaatgccccagaccccggcctgcctgtgcccccagccctgtgtggaaatggatttgtggaggccggggaggagtgtgactgtggccctggccaggagtgccgggacctgtgctgctttgcccacaactgcagcctgcggcctggggcccagtgtgcccatggagactgctgcgtgcgctgcctgctgaagccagctggggccctgtgccggcaggccatgggagactgtgacctgcctgagttctgcaccggcaccagcagccactgccccccagatgtgtacctgctggatggcagcccctgtgcccggggcagcggctactgctgggatggagcctgccccaccctggagcagcagtgccagcagctgtggggccctggcagccacccagcccctgaggcctgcttccaggtggtgaacagcgctggagatgcccacggcaactgtggccaggacagcgagggccacttcctgccctgtgccggcagagatgccctgtgtgggaagctgcagtgccagggcggcaagcccagcctgctggccccccacatggtgcctgtggacagcacagtgcacctggatggccaggaggtgacctgccgcggggccctggccctgcccagcgcccagctggacctgctgggcctgggcctggtggagcccggcacccagtgtggccccaggatggtgtgccagagccgccgctgcaggaagaatgccttccaggagctgcagcgctgcctgacagcctgccacagccacggcgtgtgcaacagcaaccacaactgccactgtgcccctggctgggccccacccttctgtgacaagccaggctttggaggctccatggattctggccctgtgcaggctgaaaatcatgacaccttcctgctggccatgctgctgtctgtgctgctgcccctgctgcccggggccggcctggcctggtgctgctaccgcctgcccggggcccacctgcagcgctgctcctggggctgccggcgggaccctgcctgcagcggccccaaggatggcccccaccgggaccaccccctgggcggcgtgcaccccatggagctgggccccacagccaccggccagccctggcccctggaccctgagaacagccatgagcccagcagccaccctgagaagcccctgcctgctgtgtccccagacccccaggaccaggtgcagatgcccaggagctgcctgtggtag

SEQ ID NO: 142626 - DNA, 456 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaggatgccctgtgtgggaagctgcagtgccagggcggcaagcccagcctgctggccccccacatggtgcctgtggacagcacagtgcacctggatggccaggaggtgacctgccgcggggccctggccctgcccagcgcccagctggacctgctgggcctgggcctggtggagcccggcacccagtgtggccccaggatgtag

SEQ ID NO: 142627 - DNA, 2079 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagaccactgccactaccagggccgggtgcggggcttcccagacagctgggtggtgctgtgcacctgcagcggcatgagcggcctcatcaccctgagcagaaatgccagctactacctgcggccctggccaccccggggcagcaaggacttcagcacccatgagatcttcaggatggagcagctgctgacctggaagggcacctgtggccaccgggaccccggcaacaaggccggcatgaccagcctgcccggcggcccccagagccggggccggcgggaggcccggaggaccaggaagtacctggagctgtacatcgtggccgaccacaccctcttcctgaccaggcacaggaacctgaaccacaccaagcagaggctgctggaggtggccaactacgtggaccagctgctgcggaccctggacatccaggtggccctgaccggcctggaggtgtggacagagcgggacaggagccggcggcagctgcgggccttcttcagaaaaggaggaggagcctgcctgagcaatgccccagaccccggcctgcctgtgcccccagccctgtgtggaaatggatttgtggaggccggggaggagtgtgactgtggccctggccaggagtgccgggacctgtgctgctttgcccacaactgcagcctgcggcctggggcccagtgtgcccatggagactgctgcgtgcgctgcctgctgaagccagctggggccctgtgccggcaggccatgggagactgtgacctgcctgagttctgcaccggcaccagcagccactgccccccagatgtgtacctgctggatggcagcccctgtgcccggggcagcggctactgctgggatggagcctgccccaccctggagcagcagtgccagcagctgtggggccctggcagccacccagcccctgaggcctgcttccaggtggtgaacagcgctggagatgcccacggcaactgtggccaggacagcgagggccacttcctgccctgtgccggcagagatgccctgtgtgggaagctgcagtgccagggcggcaagcccagcctgctggccccccacatggtgcctgtggacagcacagtgcacctggatggccaggaggtgacctgccgcggggccctggccctgcccagcgcccagctggacctgctgggcctgggcctggtggagcccggcacccagtgtggccccaggatggtgtgccagagccgccgctgcaggaagaatgccttccaggagctgcagcgctgcctgacagcctgccacagccacggcgtgtgcaacagcaaccacaactgccactgtgcccctggctgggccccacccttctgtgacaagccaggctttggaggctccatggattctggccctgtgcaggctgaaaatcatgacaccttcctgctggccatgctgctgtctgtgctgctgcccctgctgcccggggccggcctggcctggtgctgctaccgcctgcccggggcccacctgcagcgctgctcctggggctgccggcgggaccctgcctgcagcggccccaaggatggcccccaccgggaccaccccctgggcggcgtgcaccccatggagctgggccccacagccaccggccagccctggcccctggaccctgagaacagccatgagcccagcagccaccctgagaagcccctgcctgctgtgtccccagacccccaggaccaggtgcagatgcccaggagctgcctgtggtag

SEQ ID NO: 142628 - DNA, 522 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccaccggctgctggcccctggctacatcgagacccactacggcccagatggccagcctgtggtgctggcccccaaccacacagtgcgctgcttccacggcctgtgggatgcccctcctgaggaccactgccactaccagggccgggtgcggggcttcccagacagctgggtggtgctgtgcacctgcagcggcatgagagctggggagaagagagctggccctggcagcacctggaactgcaccctgtggcagaccaccccctgcagctag

SEQ ID NO: 142629 - DNA, 291 bp, Artificial Sequence
  Description of Artificial Sequence: Synthetic coding sequence
atgggctggaggccccggcgggcccggggcacccccctgctgctgctgctgctgctgctgctgctgtggcctgtgcctggggccggcgtgctgcagggccacatccctggccagcctgtgaccccccactgggtgctggatggccagccctggaggacagtgtccctggaggagcctgtgtccaagccagacatgggcctggtggccctggaggccgagggccaggagctgctgctggagctggagaagaaccagtttgccatcgccaccatcacagccaccgtgctgtag

SEQ ID NO: 142630 - DNA, 2265 bp, Artificial Sequence
  Description of Artificial Sequence: Synthetic coding sequence
atgctgcccggctgcatcttcctgatgatcctgctgatcccccaggtgaaggagaagttcatcctgggcgtggagggccagcagctggtgcggcccaagaagctgcccctcatccagaagagggacaccggccacacccatgatgatgacatcctgaagacctatgaggaggagctgctgtatgagatcaagctgaacaggaagaccctggtgctgcacctgctgcggagccgggagttcctgggcagcaactacagcgagaccttctacagcatgaagggggaggccttcaccaggcacccccagatcatggaccactgcttctaccagggcagcatcgtgcatgaatatgattctgctgccagcatcagcacctgcaatggcctgcggggcttcttccgcatcaatgaccagcgctacctgattgagcctgtgaagtacagtgatgaaggagagcacctggtgttcaagtacaacctgcgggtgccctacggggccaactacagctgcacagagctgaacttcaccaggaagacagtgcctggggacaatgaaagtgaggaggacagcaagatcaagggcatccatgatgagaagtatgtggagctgttcatcgtggctgatgacacagtgtacagaagaaatggccacccccacaacaagctgaggaaccgcatctggggcatggtgaactttgtgaacatgatctacaagaccctgaacatccacgtgaccctggtgggcatcgagatctggacccatgaggacaagattgagctgtacagcaacatcgagaccaccctgctgcgcttctccttctggcaggagaagatcctgaagaccaggaaggactttgaccacgtggtgctgctgagcggcaagtggctgtacagccacgtgcagggcatctcctacccaggcggcatgtgcctgccctactacagcaccagcatcatcaaggacctgctgcctgacaccaacatcatcgccaacaggatggcccaccagctgggccacaacctgggcatgcagcatgatgagttcccctgcacctgccccagcgggaaatgtgtgatggacagtgatggcagcatcccagccctgaagttcagcaagtgcagccagaaccagtaccaccagtacctgaaggactacaagcccacctgcatgctgaacatccccttcccctacaacttccatgacttccagttctgtggcaacaagaagctggatgaaggagaagaatgtgactgtggccctgcccaggagtgcaccaacccctgctgtgatgcccacacctgtgtgctgaagccaggcttcacctgtgccgagggggagtgctgtgagagctgccagatcaagaaggccggcagcatctgcaggcctgccaaggatgaatgtgacttccctgagatgtgcaccggccacagccctgcctgccccaaggaccagttccgggtgaatggcttcccctgcaagaacagcgagggctactgcttcatgggcaaatgtcccacccgggaggaccagtgcagcgagctgtttgatgatgaggccatcgagagccatgacatctgctacaagatgaacaccaagggcaacaagtttggctactgcaagaacaaggaaaatcgcttcctgccctgtgaggagaaggatgtgcgctgtgggaagatctactgcaccggcggggagctgagcagcctgctgggggaggacaagacctaccacctgaaggacccccagaagaatgccaccgtgaagtgcaagaccatcttcctgtaccatgacagcacagacatcggcctggtggccagcggcaccaagtgtggggagggcatggtgtgcaacaacggggagtgcctgaacatggagaaggtgtacatcagcaccaactgccccagccagtgcaatgaaaatcctgtggatggccacggcctgcagtgccactgtgaggagggccaggcccctgtggcctgtgaggagaccctgcacgtgaccaacatcaccatcctggtggtggtgctggtgctggtgattgtgggcattggagtgctgatcctgctggtgcgctacaggaagtgcatcaagctgaagcaggtgcagagccccccaacagagaccctgggcgtggagaacaagggctactttggagatgagcagcagatcagaacagagcccatcctgcctgagatccacttcctgaacaagccagccagcaaggacagccggggcattgctgaccccaaccagagcgccaagtag

SEQ ID NO: 142631 - DNA, 1656 bp, Artificial Sequence
  Description of Artificial Sequence: Synthetic coding sequence
gtgtgccccaggagctacttcctggagggccggggcagctacagcttcctgagcctcttcagcaccagccctgccccctacagaagaaatggccacccccacaacaagctgaggaaccgcatctggggcatggtgaactttgtgaacatgatctacaagaccctgaacatccacgtgaccctggtgggcatcgagatctggacccatgaggacaagattgagctgtacagcaacatcgagaccaccctgctgcgcttctccttctggcaggagaagatcctgaagaccaggaaggactttgaccacgtggtgctgctgagcggcaagtggctgtacagccacgtgcagggcatctcctacccaggcggcatgtgcctgccctactacagcaccagcatcatcaaggacctgctgcctgacaccaacatcatcgccaacaggatggcccaccagctgggccacaacctgggcatgcagcatgatgagttcccctgcacctgccccagcgggaaatgtgtgatggacagtgatggcagcatcccagccctgaagttcagcaagtgcagccagaaccagtaccaccagtacctgaaggactacaagcccacctgcatgctgaacatccccttcccctacaacttccatgacttccagttctgtggcaacaagaagctggatgaaggagaggagtgtgactgtggccctgcccaggagtgcaccaacccctgctgtgatgcccacacctgtgtgctgaagccaggcttcacctgtgccgagggggagtgctgtgagagctgccagatcaagaaggccggcagcatctgcaggcctgccaaggatgaatgtgacttccctgagatgtgcaccggccacagccctgcctgccccaaggaccagttccgggtgaatggcttcccctgcaagaacagcgagggctactgcttcatgggcaagtgccccacccgggaggaccagtgcagcgagctgtttgatgatgaggccatcgagagccatgacatctgctacaagatgaacaccaagggcaacaagtttggctactgcaagaacaaggagaaccgcttcctgccctgtgaggagaaggatgtgcgctgtgggaagatctactgcacaggaggagagctgagcagcctgctgggggaggacaagacctaccacctgaaggacccccagaagaatgccaccgtgaagtgcaagaccatcttcctgtaccatgacagcacagacatcggcctggtggccagcggcaccaagtgtggggagggcatggtgtgcaacaatggagaatgtctgaacatggagaaggtgtacatcagcaccaactgccccagccagtgcaatgaaaatcctgtggatggccacggcctgcagtgccactgtgaggagggccaggcccctgtggcctgtgaggagaccctgcacgtgaccaacatcaccatcctggtggtggtgctggtgctggtgattgtgggcatcggcgtgctgatcctgctggtgcgctacaggaagtgcatcaagctgaagcaggtgcagagccccccaacagagaccctgggcgtggagaacaagggctactttggagatgagcagcagatcagaacagagcccatcctgcctgagatccacttcctgaactag

SEQ ID NO: 142632 - DNA, 2475 bp, Artificial Sequence
  Description of Artificial Sequence: Synthetic coding sequence
atgaggggcctgggcctgtggctgctgggcgccatgatgctgcctgccatcgcccccagccggccctgggccctgatggagcagtatgaggtggtgctgccctggaggctgcccggcccccgggtgagaagagccctgcccagccacctgggcctgcaccctgagcgggtgtcctatgtgctgggcgccaccggccacaacttcaccctgcacctgaggaagaacagagacctgctgggcagcggctacacagagacctacacagctgccaatggaagtgaggtgacagagcagccccggggccaggaccactgcttctaccagggccacgtggagggctacccagattctgctgccagcctgagcacctgtgccggcctgcggggcttcttccaggtgggcagtgacctgcacctgattgagcccctggatgagggcggggagggcggcagacatgctgtgtaccaggccgagcacctgctgcagacagctggcacctgtggggtgtctgatgacagcctgggcagcctgctgggccccaggacagctgctgtgttccggcccaggcctggggacagcctgcccagccgggagaccaggtatgtggagctgtatgtggtggtggacaatgctgagttccagatgctgggcagcgaggccgctgtgcgccaccgggtgctggaggtggtgaaccacgtggacaagctgtaccagaagctgaacttccgggtggtgctggtgggcctggagatctggaacagccaggaccgcttccacgtgtccccagaccccagcgtgaccctggagaacctgctgacctggcaggcccggcagaggaccaggaggcacctgcatgacaacgtgcagctgatcaccggggtggacttcaccggcaccaccgtgggctttgcccgggtgtctgccatgtgcagccacagcagcggggctgtgaaccaggaccacagcaagaaccctgtgggcgtggcctgcaccatggcccacgagatgggccacaacctgggcatggaccatgatgaaaatgtgcagggctgccgctgccaggagagatttgaagctggccgctgcatcatggccggcagcatcggcagcagcttccccaggatgttcagtgactgcagccaggcctacctggagagcttcctggagcggccccagagcgtgtgcctggccaatgccccagacctgagccacctggtgggcggccctgtgtgtggcaacctgtttgtggagcggggggagcagtgtgactgtggccccccagaggactgcaggaaccgctgctgcaacagcaccacctgccagctggccgagggcgcccagtgtgcccacggcacctgctgccaggagtgcaaggtgaagccagctggggagctgtgccggcccaagaaggacatgtgtgacctggaggagttctgtgatggccgccacccagaatgtccagaagatgccttccaggagaatggcaccccctgcagcggcggctactgctacaatggagcctgccccaccctggcccagcagtgccaggccttctggggccctgggggccaggccgctgaggagagctgcttctcctatgacatcctgcccggctgcaaggccagccgctacagagctgacatgtgtggggtgctgcagtgcaagggcggccagcagcccctgggccgggccatctgcatcgtggatgtgtgccacgccctgaccacagaagatggaacagcctatgagcctgtgcctgagggcacccgctgtggccctgagaaggtgtgctggaagggccgctgccaggacctgcacgtgtaccgcagcagcaactgcagcgcccagtgccacaaccacggcgtgtgcaaccacaagcaggagtgccactgccacgccggctgggccccaccccactgtgccaagctgctgacagaggtgcatgctgccagcggcagcctgcctgtgtttgtggtggtggtgctggtgctgctggccgtggtgctggtgaccctggccggcatcatcgtgtacaggaaggcccggagccgcatcctgagcagaaatgtggcccccaagaccaccatgggccgcagcaaccccctcttccaccaggccgccagccgggtgcctgccaagggcggggccccagcccccagccggggcccccaggagctggtgcccaccacccaccctggccagcctgcccggcacccagccagctctgtggccctgaagaggcctcctccagcccctcctgtgacagtgagcagcccccccttccctgtgcctgtgtacacccggcaggcccccaagcaggtgatcaagcccacctttgcccctcctgtgccccctgtgaagccaggggccggggccgccaaccctggccctgctgagggcgctgtgggccccaaggtggccctgaagccacccatccagaggaagcagggcgctggggcccccacagccccctag

SEQ ID NO: 142633 - DNA, 2202 bp, Artificial Sequence
  Description of Artificial Sequence: Synthetic coding sequence
atgaggggcctgggcctgtggctgctgggcgccatgatgctgcccggccctgccccccgggagggggagctgcggccctggggccaccgggcccagctgcaccccccacctgctgaggagcagggccctgctggcctgcggctgcaccgggacctgtatggctgccagtggctgcggggagatggagctgccagcagagctggccccctgctgctgcccggcccccggcggggcgtgcccggcctgagccggcagccccagcacctgtgccggccccaggtgggcagtgacctgcacctgattgagcccctggatgaaggaggagagggcggcagacatgctgtgtaccaggccgagcacctgctgcagacagctggcacctgtggggtgtctgatgacagcctgggcagcctgctgggccccaggacagctgctgtgttccggcccaggcctggggacagcctgcccagccgggagacccgctacgtggagctgtatgtggtggtggacaatgctgagttccagatgctgggcagcgaggccgctgtgcgccaccgggtgctggaggtggtgaaccacgtggacaagctgtaccagaagctgaacttccgggtggtgctggtgggcctggagatctggaacagccaggaccgcttccacgtgtccccagaccccagcgtgaccctggagaacctgctgacctggcaggcccggcagaggacccggcggcacctgcatgacaacgtgcagctgatcactggagtggacttcaccggcaccaccgtgggctttgcccgggtgtctgccatgtgcagccacagcagtggagctgtgaaccaggaccacagcaagaaccctgtgggcgtggcctgcaccatggcccacgagatgggccacaacctgggcatggaccatgatgaaaatgtgcagggctgccgctgccaggagagatttgaggccggccgctgcatcatggccggcagcatcggcagcagcttccccaggatgttcagtgactgcagccaggcctacctggagagcttcctggagcggccccagagcgtgtgcctggccaatgccccagacctgagccacctggtgggcggccctgtgtgtggcaacctgtttgtggagcggggggagcagtgtgactgtggccccccagaggactgcaggaaccgctgctgcaacagcaccacctgccagctggccgagggcgcccagtgtgcccacggcacctgctgccaggagtgcaaggtgaagccagctggggagctgtgccggcccaagaaggacatgtgtgacctggaggagttctgtgatggccgccaccctgagtgcccagaagatgccttccaggagaatggcaccccctgcagcggcggctactgctacaacggggcctgccccaccctggcccagcagtgccaggccttctggggccctgggggccaggccgctgaggagagctgcttctcctatgacatcctgcccggctgcaaggccagccgctacagagctgacatgtgtggggtgctgcagtgcaagggcggccagcagcccctgggccgggccatctgcatcgtggatgtgtgccacgccctgaccacagaagatggaacagcctatgagcctgtgcctgagggcacccgctgtggccctgagaaggtgtgcaaccacaagcaggagtgccactgccacgccggctgggccccaccccactgtgccaagctgctgacagaggtgcacgccgccagcggcagcctgcctgtgtttgtggtggtggtgctggtgctgctggccgtggtgctggtgaccctggccggcatcatcgtgtacaggaaggcccggagccgcatcctgagcagaaatgtggcccccaagaccaccatgggccgcagcaaccccctcttccaccaggccgccagccgggtgcctgccaagggcggggccccagcccccagccggggcccccaggagctggtgcccaccacccaccctggccagcctgcccggcacccagccagctctgtggccctgaagaggcctcctccagcccctcctgtgacagtgagcagcccccccttccctgtgcctgtgtacacccggcaggcccccaagcagggcgctgtgggccccaaggtggccctgaagccacccatccagaggaagcagggcgctggggcccccacagccccctag

SEQ ID NO: 142634 - DNA, 2229 bp, Artificial Sequence
  Description of Artificial Sequence: Synthetic coding sequence
atgaggggcctgggcctgtggctgctgggcgccatgatgctgcctgccatcgcccccagccggccctgggccctgatggagcagtatgaggtggtgctgccctggaggctgcccggcccccgggtgagaagagccctgcccagccacctgggcctgcaccctgagcgggtgtcctatgtgctgggcgccaccggccacaacttcaccctgcacctgaggaagaacagagacctgctgggcagcggctacacagagacctacacagctgccaatggaagtgaggtgacagagcagccccggggccaggaccactgcttctaccagggccacgtggagggctacccagattctgctgccagcctgagcacctgtgccggcctgcggggcttcttccaggtgggcagtgacctgcacctgattgagcccctggatgagggcggggagggcggcagacatgctgtgtaccaggccgagcacctgctgcagacagctggcacctgtggggtgtctgatgacagcctgggcagcctgctgggccccaggacagctgctgtgttccggcccaggcctggggacagcctgcccagccgggagaccaggtatgtggagctgtatgtggtggtggacaatgctgagttccagatgctgggcagcgaggccgctgtgcgccaccgggtgctggaggtggtgaaccacgtggacaagctgtaccagaagctgaacttccgggtggtgctggtgggcctggagatctggaacagccaggaccgcttccacgtgtccccagaccccagcgtgaccctggagaacctgctgacctggcaggcccggcagaggaccaggaggcacctgcatgacaacgtgcagctgatcaccggggtggacttcaccggcaccaccgtgggctttgcccgggtgtctgccatgtgcagccacagcagcggggctgtgaaccaggaccacagcaagaaccctgtgggcgtggcctgcaccatggcccacgagatgggccacaacctgggcatggaccatgatgaaaatgtgcagggctgccgctgccaggagagatttgaagctggccgctgcatcatggccggcagcatcggcagcagcttccccaggatgttcagtgactgcagccaggcctacctggagagcttcctggagcggccccagagcgtgtgcctggccaatgccccagacctgagccacctggtgggcggccctgtgtgtggcaacctgtttgtggagcggggggagcagtgtgactgtggccccccagaggactgcaggaaccgctgctgcaacagcaccacctgccagctggccgagggcgcccagtgtgcccacggcacctgctgccaggagtgcaaggtgaagccagctggggagctgtgccggcccaagaaggacatgtgtgacctggaggagttctgtgatggccgccacccagaatgtccagaagatgccttccaggagaatggcaccccctgcagcggcggctactgctacaatggagcctgccccaccctggcccagcagtgccaggccttctggggccctgggggccaggccgctgaggagagctgcttctcctatgacatcctgcccggctgcaaggccagccgctacagagctgacatgtgtggggtgctgcagtgcaagggcggccagcagcccctgggccgggccatctgcatcgtggatgtgtgccacgccctgaccacagaagatggaacagcctatgagcctgtgcctgagggcacccgctgtggccctgagaaggtgtgctggaagggccgctgccaggacctgcacgtgtaccgcagcagcaactgcagcgcccagtgccacaaccacggcgtgtgcaaccacaagcaggagtgccactgccacgccggctgggccccaccccactgtgccaagctgctgacagaggtgcatgctggctgccagcccagggctggccagggccggggcagcagccccatccagggccccccccgggccggcccccaccaccccccaggccctgcccggcccaccccaggcctgctgggcggcagcgaggaggccgccccctgcagcagcggccactgtgtgcagcccaccctgcccagcagctgcctgcaccctgctggcaccaaggccggccaccaggccaacgtgaggaccccatctgcccccagccagacccggggctggtgtggccagccctggagcagctag

SEQ ID NO: 142635 - DNA, 2460 bp, Artificial Sequence
  Description of Artificial Sequence: Synthetic coding sequence
atgggcagcggggcccgcttccccagcggcaccctgcgggtgcgctggctgctgctgctgggcctggtgggccctgtgctgggcgccgcccggcccggcttccagcagaccagccacctgagcagctatgagatcatcaccccctggaggctgacccgggagcggcgggaggccccccggccctacagcaagcaggtgtcctatgtgatccaggccgagggcaaggagcacatcatccacctggagaggaacaaggacctgctgcctgaggactttgtggtgtacacctacaacaaggagggcaccctcatcacagaccaccccaacatccagaaccactgccactaccggggctacgtggagggcgtgcacaacagcagcatcgccctgagtgactgcttcggcctgcggggcctgctgcacctggagaatgccagctatggaattgagcccctgcagaacagcagccactttgagcacatcatctacaggatggatgatgtgtacaaggagcccctgaagtgtggggtgagcaacaaggacatcgagaaggagacagccaaggatgaggaggaggagccccccagcatgacccagctgctgcggcggcggcgggctgtgctgccccagaccaggtatgtggagctgttcatcgtggtggacaaggagagatatgacatgatgggcaggaaccagacagctgtgcgggaggagatgatcctgctggccaactacctggacagcatgtacatcatgctgaacatcagaattgtgctggtgggcctggagatctggaccaatggaaacctgatcaacatcgtgggcggcgctggagatgtgctgggcaactttgtgcagtggagggagaagttcctgatcaccaggagaagacatgacagcgcccagctggtgctgaagaagggctttggaggaacagctggcatggcctttgtgggcaccgtgtgcagccgcagccatgctgggggcatcaacgtgtttggccagatcaccgtggagacctttgccagcatcgtggcccacgagctgggccacaacctgggcatgaaccatgatgatggccgggactgcagctgtggggccaagagctgcatcatgaacagcggggccagcggcagcaggaacttcagcagctgcagcgctgaggactttgagaagctgaccctgaacaagggcggcaactgcctgctgaacatccccaagccagatgaggcctacagcgcccccagctgtggcaacaagctggtggatgctggggaggagtgtgactgtggcacccccaaggaatgtgagctggacccctgctgtgagggcagcacctgcaagctgaagagctttgctgaatgtgcctatggagactgctgcaaggactgccgcttcctgcccggcggcaccctgtgccggggcaagaccagtgaatgtgatgtgcctgagtactgcaatggcagcagccagttctgccagccagatgtgttcatccagaatggctacccctgccagaacaacaaggcctactgctacaacggcatgtgccagtactatgatgcccagtgccaggtgatcttcggcagcaaggccaaggccgcccccaaggactgcttcatcgaggtgaacagcaagggggaccgcttcggcaactgtggcttctctggaaatgagtacaagaagtgtgccactggaaatgccctgtgtgggaagctgcagtgtgaaaatgtgcaggagatccctgtgtttggcatcgtgcctgccatcatccagacccccagccggggcaccaagtgctggggcgtggacttccagctgggcagtgatgtgcctgaccccggcatggtgaatgaaggcaccaagtgtggggccggcaagatctgcaggaacttccagtgtgtggatgcctctgtgctgaactatgactgtgatgtgcagaagaagtgccacggccatggagtgtgcaacagcaacaagaactgccactgtgaaaatggctgggccccacccaactgtgagaccaagggctacggcggctctgtggacagcggccccacctacaatgagatgaacacagccctgagagatggcctgctggtgttcttcttcctgattgtgcccctcatcgtgtgtgccatcttcatcttcatcaagagggaccagctgtggaggagctacttcaggaagaagaggagccagacctatgaaagtgatggcaagaaccaggccaaccccagccggcagcccggctctgtgcccaggcatgtgtcccctgtgaccccaccccgggaggtgcccatctatgccaacagatttgctgtgcccacctatgctgccaagcagccccagcagttccccagccggcccccaccaccccagcccaaggtgagcagccagggcaacctgatcccagcccggcctgccccagccccacccctgtacagcagcctgacctag

SEQ ID NO: 142636 - DNA, 2904 bp, Artificial Sequence
  Description of Artificial Sequence: Synthetic coding sequence
atgcagagagctgtgcctgagggctttggaagaaggaagctgggcagtgacatgggaaatgctgagcgggcccctggcagccgcagctttggacctgtgcccaccctgctgctgctggccgccgccctgctggccgtgtctgatgccctgggccggcccagcgaggaggatgaggagctggtggtgcctgagctggagcgggcccctggccacggcaccacccggctgcggctgcacgcctttgaccagcagctggacctggagctgcggccagacagcagcttcctggcccctggcttcaccctgcagaatgtgggcaggaagagcggcagcgagacccccctgcctgagacagacctggcccactgcttctacagcggcaccgtgaatggagaccccagcagcgctgctgccctgagcctgtgtgagggcgtgcggggggccttctacctgctgggggaggcctacttcatccagcccctgcctgctgccagcgagcggctggccacagctgcccctggagagaagcccccagcccccctgcagttccacctgctgcggaggaaccggcagggagatgtgggcggcacctgtggggtggtggatgatgagccccggcccaccgggaaggccgagacagaagatgaagatgagggcacagaaggagaagatgagggcgcccagtggagcccccaggaccctgccctgcagggcgtgggccagcccactggaacaggcagcatcaggaagaagagatttgtgagcagccacagatatgtggagaccatgctggtggccgaccagagcatggccgagttccacggcagcggcctgaagcactacctgctgaccctcttctctgtggccgcccggctgtacaagcaccccagcatcagaaattctgtgtccctggtggtggtgaagatcctggtgattcatgatgagcagaagggccctgaggtgaccagcaatgctgccctgaccctgaggaacttctgcaactggcagaagcagcacaaccccccaagtgacagagatgctgagcactatgacacagccatcctcttcacccggcaggacctgtgtggcagccagacctgtgacaccctgggcatggctgatgtgggcaccgtgtgtgaccccagccgcagctgcagcgtgattgaagatgatggcctgcaggccgccttcaccacagcccacgagctgggccacgtgttcaacatgcctcatgatgatgccaagcagtgtgccagcctgaatggagtgaaccaggacagccacatgatggcctccatgctgagcaacctggaccacagccagccctggagcccctgcagcgcctacatgatcaccagcttcctggacaatggacatggagaatgtctgatggacaagccccagaaccccatccagctgcccggggacctgcccggcaccagctatgatgccaaccggcagtgccagttcaccttcggggaggacagcaagcactgcccagatgctgccagcacctgcagcaccctgtggtgcaccggcaccagcggaggagtgctggtgtgccagaccaagcacttcccctgggcagatggcaccagctgtggggagggcaagtggtgcatcaacgggaaatgtgtgaacaagacagacaggaagcactttgacacccccttccacggctcctggggcatgtggggcccctggggagactgcagcaggacctgtggcggcggcgtgcagtacaccatgagagaatgtgacaaccctgtgcccaagaatggaggcaagtactgtgagggcaagagggtgcgctaccgcagctgcaacctggaggactgcccagacaacaacgggaagaccttccgggaggagcagtgtgaggcccacaatgagttcagcaaggccagctttggaagtggccctgctgtggagtggatccccaagtatgctggggtgagccccaaggaccgctgcaagctgatctgccaggccaagggcatcggctacttctttgtgctgcagcccaaggtggtggatggcaccccctgcagcccagacagcacctctgtgtgtgtgcagggccagtgtgtgaaggccggctgtgaccgcatcatcgacagcaagaagaagtttgataaatgtggggtgtgtggcggcaatggcagcacctgcaagaagatcagcggctctgtgaccagcgccaagccaggctaccatgacatcatcaccatccccaccggggccaccaacatcgaggtgaagcagaggaaccagaggggcagcaggaacaacggcagcttcctggccatcaaggctgctgatggcacctacatcctgaatggagactacaccctgagcaccctggagcaggacatcatgtacaagggcgtggtgctgcgctacagcggcagcagcgctgccctggagcgcatccgctccttcagccccctgaaggagcccctgaccatccaggtgctgactgtgggcaatgccctgcggcccaagatcaagtacacctactttgtgaagaagaagaaggagagcttcaatgccatccccaccttcagcgcctgggtgattgaggagtggggagaatgttccaagagctgtgagctgggctggcagaggcggctggtggagtgccgggacatcaatggccagcctgcctctgaatgtgccaaggaggtgaagccagccagcacccggccctgtgccgaccacccctgcccccagtggcagctgggggagtggagcagctgcagcaagacctgtgggaagggctacaagaagaggagcctgaagtgcctgagccatgatggaggagtgctgagccatgagagctgtgaccccctgaagaagcccaagcacttcatcgacttctgcaccatggctgaatgttcctag

SEQ ID NO: 142637 - DNA, 3312 bp, Artificial Sequence
  Description of Artificial Sequence: Synthetic coding sequence
atggccccagcctgccagatcctgcgctgggccctggccctgggcctgggcctgatgtttgaggtgacccacgccttccgcagccaggatgagttcctgagcagcctggagagctatgaaattgccttccccaccagggtggaccacaacggggccctgctggccttcagccccccaccaccccggcggcagaggcggggcaccggggccacagctgagagccgcctcttctacaaggtggccagccccagcacccacttcctgctgaacctgaccaggagcagccggctgctggccggccacgtgtctgtggagtactggacccgggagggcctggcctggcagagagctgcccggccccactgcctgtatgccggccacctgcagggccaggccagcaccagccacgtggccatcagcacctgtggcggcctgcacggcctgattgtggctgatgaggaggagtacctgattgagcccctgcacggcggccccaagggcagccgcagccctgaggagagcggcccccacgtggtgtacaagaggagcagcctgcggcacccccacctggacacagcctgtggggtgagagatgagaagccctggaagggccggccctggtggctgcggaccctgaagcccccaccagcccggcccctgggcaatgaaacagagcggggccagcccggcctgaagaggtctgtgtcccgggagcgctacgtggagaccctggtggtggccgacaagatgatggtggcctaccatggaagaagagatgtggagcagtatgtgctggccatcatgaacatcgtggccaagctgttccaggacagcagcctgggcagcacagtgaacatcctggtgaccaggctcatcctgctgacagaggaccagcccaccctggagatcacccaccacgccggcaagagcctggacagcttctgcaagtggcagaagagcatcgtgaaccacagcggccatggaaatgccatcccagaaaatggagtggccaaccacgacacagctgtgctgatcaccaggtatgacatctgcatctacaagaacaagccctgtggcaccctgggcctggcccctgtgggcggcatgtgtgagcgggagaggagctgcagcgtgaatgaagacatcggcctggccacagccttcaccatcgcccacgagatcggccacaccttcggcatgaaccatgatggagtgggcaacagctgtggggcccggggccaggaccctgccaagctgatggccgcccacatcaccatgaagaccaacccctttgtgtggagcagctgcagccgggactacatcaccagcttcctggacagcggcctgggcctgtgcctgaacaacagaccaccccggcaggactttgtgtaccccaccgtggcccctggccaggcctatgatgctgatgagcagtgccgcttccagcacggcgtgaagagccggcagtgcaagtacggggaggtgtgcagcgagctgtggtgcctgagcaagagcaaccgctgcatcaccaacagcatcccagctgctgagggcaccctgtgccagacccacaccatcgacaagggctggtgctacaagagggtgtgtgtgcccttcggcagcaggcctgagggcgtggatggagcctggggcccctggaccccctggggagactgcagcaggacctgtggcggcggcgtgagcagcagcagccgccactgtgacagcccccggcccaccatcggcggcaagtactgcctgggggagaggagaagacacaggagctgcaacacagatgactgccccccaggcagccaggacttccgggaggtgcagtgcagcgagtttgacagcatccccttccggggcaagttctacaagtggaagacctacagaggaggaggagtgaaggcctgcagcctgacctgcctggccgagggcttcaacttctacacagaaagagctgctgctgtggtggatggcaccccctgcaggccagacacagtggacatctgtgtgtctggagagtgcaagcacgtgggctgtgacagagtgctgggcagtgacctgcgggaggacaagtgccgggtgtgtggaggagatggcagcgcctgtgagaccatcgagggcgtcttcagccctgccagccctggagctggctatgaagatgtggtgtggatccccaagggctctgtgcacatcttcatccaggacctgaacctgagcctgagccacctggccctgaagggggaccaggagagcctgctgctggagggcctgcccggcaccccccagccccaccggctgcccctggccggcaccaccttccagctgcggcagggccctgaccaggtgcagagcctggaggccctgggccccatcaatgccagcctgattgtgatggtgctggccaggacagagctgcctgccctgcgctaccgcttcaatgcccccatcgcccgggacagcctgcccccctacagctggcactacgccccctggaccaagtgcagcgcccagtgtgccggcggcagccaggtgcaggccgtggagtgcaggaaccagctggacagcagcgctgtggccccccactactgcagcgcccacagcaagctgcccaagaggcagagggcctgcaacacagagccctgccccccagactgggtggtgggcaactggagcctgtgcagccgcagctgtgatgctggggtgcgcagccgctctgtggtgtgccagaggagagtgtctgctgctgaggagaaggccctggatgacagcgcctgcccccagcccaggcctcctgtgctggaggcctgccacggccccacctgccccccagagtgggccgccctggactggagcgaatgtacccccagctgtggccctggcctgcggcaccgggtggtgctgtgcaagtctgctgaccaccgggccaccctgcccccagcccactgcagccctgctgccaagcccccagccaccatgcgctgcaacctgcggcgctgccccccagcccgctgggtggccggggagtggggcgagtgcagcgcccagtgtggggtgggccagaggcagaggtctgtgcgctgcaccagccacacaggccaggccagccatgagtgcacagaggccctgcggccccccaccacccagcagtgtgaggccaagtgtgacagccccaccccaggagatggccctgaggagtgcaaggatgtgaacaaggtggcctactgccccctggtgctgaagttccagttctgcagccgggcctacttccggcagatgtgctgcaagacctgccacggccactag

SEQ ID NO: 142638 - DNA, 2544 bp, Artificial Sequence
  Description of Artificial Sequence: Synthetic coding sequence
caggatgatggcggcctgagccgggcccctggctgtggggctgtgtgccccggccaccacgagcactgccaggtggccaagctgttccaggacagcagcctgggcagcacagtgaacatcctggtgaccaggctcatcctgctgacagaggaccagcccaccctggagatcacccaccacgccggcaagagcctggacagcttctgcaagtggcagaagagcatcgtgaaccacagcggccatggaaatgccatcccagaaaatggagtggccaaccacgacacagctgtgctgatcaccaggtatgacatctgcatctacaagaacaagccctgtggcaccctgggcctggcccctgtgggcggcatgtgtgagcgggagaggagctgcagcgtgaatgaagacatcggcctggccacagccttcaccatcgcccacgagatcggccacaccttcggcatgaaccatgatggagtgggcaacagctgtggggcccggggccaggaccctgccaagctgatggccgcccacatcaccatgaagaccaacccctttgtgtggagcagctgcagccgggactacatcaccagcttcctggacagcggcctgggcctgtgcctgaacaacagaccaccccggcaggactttgtgtaccccaccgtggcccctggccaggcctatgatgctgatgagcagtgccgcttccagcacggcgtgaagagccggcagtgcaagtacggggaggtgtgcagcgagctgtggtgcctgagcaagagcaaccgctgcatcaccaacagcatcccagctgctgagggcaccctgtgccagacccacaccatcgacaagggctggtgctacaagagggtgtgtgtgcccttcggcagcaggcctgagggcgtggatggagcctggggcccctggaccccctggggagactgcagcaggacctgtggcggcggcgtgagcagcagcagccgccactgtgacagcccccggcccaccatcggcggcaagtactgcctgggggagaggagaagacacaggagctgcaacacagatgactgccccccaggcagccaggacttccgggaggtgcagtgcagcgagtttgacagcatccccttccggggcaagttctacaagtggaagacctacagaggaggaggagtgaaggcctgcagcctgacctgcctggccgagggcttcaacttctacacagaaagagctgctgctgtggtggatggcaccccctgcaggccagacacagtggacatctgtgtgtctggagagtgcaagcacgtgggctgtgacagagtgctgggcagtgacctgcgggaggacaagtgccgggtgtgtggaggagatggcagcgcctgtgagaccatcgagggcgtcttcagccctgccagccctggagctggctatgaagatgtggtgtggatccccaagggctctgtgcacatcttcatccaggacctgaacctgagcctgagccacctggccctgaagggggaccaggagagcctgctgctggagggcctgcccggcaccccccagccccaccggctgcccctggccggcaccaccttccagctgcggcagggccctgaccaggtgcagagcctggaggccctgggccccatcaatgccagcctgattgtgatggtgctggccaggacagagctgcctgccctgcgctaccgcttcaatgcccccatcgcccgggacagcctgcccccctacagctggcactacgccccctggaccaagtgcagcgcccagtgtgccggcggcagccaggtgcaggccgtggagtgcaggaaccagctggacagcagcgctgtggccccccactactgcagcgcccacagcaagctgcccaagaggcagagggcctgcaacacagagccctgccccccagactgggtggtgggcaactggagcctgtgcagccgcagctgtgatgctggggtgcgcagccgctctgtggtgtgccagaggagagtgtctgctgctgaggagaaggccctggatgacagcgcctgcccccagcccaggcctcctgtgctggaggcctgccacggccccacctgccccccagagtgggccgccctggactggagcgaggtgtcccggcccctgcccagccggcccctgggctgccctgggggcgtgtccacagagacccccctgcggggcctgcaggtgtcctgccccctgctgaccagccactggggcagcaccctgagcaccaagaggcccttccagctgcagtgcacccccagctgtggccctggcctgcggcaccgggtggtgctgtgcaagtctgctgaccaccgggccaccctgcccccagcccactgcagccctgctgccaagcccccagccaccatgcgctgcaacctgcggcgctgccccccagcccgctgggtggccggggagtggggagaatgttctgcccagtgtggggtgggccagaggcagaggtctgtgcgctgcaccagccacacaggccaggccagccatgaatgtacagaggcctag

SEQ ID NO: 142639 - DNA, 4530 bp, Artificial Sequence
  Description of Artificial Sequence: Synthetic coding sequence
atgccctgtgcccagaggtcctggctggccaacctgtctgtggtggcccagctgctgaactttggagccctgtgctacggccggcagccccagcccggccctgtgcgcttcccagaccggcggcaggagcacttcatcaagggcctgcctgagtaccacgtggtgggccctgtgcgggtggatgccagcggccacttcctgtcctatggcctgcactaccccatcaccagcagcaggaggaagagggacctggatggcagcgaggactgggtgtactaccgcatcagccatgaggagaaggacctcttcttcaacctgactgtgaaccagggcttcctgagcaacagctacatcatggagaagagatatggcaacctgagccacgtgaagatgatggccagcagcgcccccctgtgccacctgagcggcaccgtgctgcagcagggcaccagggtgggcacagctgccctgagcgcctgccacggcctgaccggcttcttccagctgccccatggagacttcttcatcgagcctgtgaagaagcaccccctggtggagggcggctaccacccccacatcgtgtaccgccggcagaaggtgcctgagaccaaggagcccacctgtggcctgaaggacagcgtgaacatcagccagaagcaggagctgtggagggagaagtgggagcggcacaacctgcccagccgcagcctgagcagaagaagcatcagcaaggagcgctgggtggagaccctggtggtggccgacaccaagatgattgagtaccacggctctgaaaatgtggagagctacatcctgaccatcatgaacatggtgacaggcctcttccacaaccccagcattggaaatgccatccacatcgtggtggtgcggctcatcctgctggaggaggaggagcagggcctgaagatcgtgcaccacgccgagaagaccctgagcagcttctgcaagtggcagaagagcatcaaccccaagagtgacctgaaccctgtgcaccatgatgtggccgtgctgctgaccaggaaggacatctgtgccggcttcaaccggccctgtgagaccctgggcctgagccacctgagcggcatgtgccagccccacaggagctgcaacatcaatgaagacagcggcctgcccctggccttcaccatcgcccacgagctgggccacagctttggcatccagcatgatggcaaggaaaatgactgtgagcctgtgggccgccacccctacatcatgagccggcagctgcagtatgaccccacccccctgacctggagcaagtgcagcgaggagtacatcacccgcttcctggaccggggctggggcttctgcctggatgacatccccaagaagaagggcctgaagagcaaggtgattgcccctggggtcatctatgatgtgcaccaccagtgccagctgcagtatggccccaatgccaccttctgccaggaggtggagaatgtgtgccagaccctgtggtgcagcgtgaagggcttctgccgcagcaagctggatgctgctgctgatggcacccagtgtggggagaagaagtggtgcatggccggcaagtgcatcaccgtgggcaagaagccagagagcatccctgggggctggggccgctggagcccctggagccactgcagcaggacctgtggggccggcgtgcagagcgctgagcggctgtgcaacaaccctgagcccaagtttggaggcaagtactgcaccggggagaggaagcgctaccgcctgtgcaatgtgcacccctgccgctctgaggcccccaccttccggcagatgcagtgcagcgagtttgacacagtgccctacaagaatgagctgtaccactggttccccatcttcaaccctggctacgtggacatcggcctcatccccaagggggcccgggacatccgggtgatggagattgaaggagctggcaacttcctggccatccgctcagaagatcctgagaagtactacctgaatggaggcttcatcatccagtggaatggaaactacaagctggccggcaccgtcttccagtatgacaggaagggggacctggagaagctgatggccaccggccccaccaatgaatctgtgtggatccagctgctcttccaggtgaccaaccctggcatcaagtatgagtacaccatccagaaggatggcctggacaatgatgtggagcagcagatgtacttctggcagtatggccactggacagagtgcagcgtgacctgtggcaccggcatccggcggcagacagcccactgcatcaagaagggccggggcatggtgaaggccaccttctgtgaccctgagacccagcccaacggccggcagaagaagtgccacgagaaggcctgccccccacgctggtgggccggggagtgggaggcctgcagcgccacctgtggcccccacggggagaagaagaggacagtgctgtgcatccagaccatggtgtctgatgagcaggccctgcccccaacagactgccagcacctgctgaagcccaagaccctgctgagctgcaacagagacatcctgtgccccagcgactggacagtgggcaactggagcgagtgcagcgtgtcctgtggcggcggcgtgcgcatccgctctgtgacctgtgccaagaaccatgatgagccctgtgatgtgaccaggaagcccaacagccgggccctgtgtggcctgcagcagtgccccagcagcagaagagtgctgaagcccaacaagggcaccatcagcaatggcaagaacccccccaccctgaagcctgtgcccccacccaccagccggcccaggatgctgaccacccccactggacctgagagcatgagcaccagcaccccagccatcagcagccccagccccaccacagccagcaaggagggggacctgggcggcaagcagtggcaggacagcagcacccagcctgagctgagcagccgctacctgatcagcacaggcagcaccagccagcccatcctgaccagccagagcctgagcatccagcccagtgaagaaaatgtgagcagcagtgacaccggccccaccagcgagggcggcctggtggccaccaccaccagcggcagcggcctgagcagcagcaggaaccccatcacctggcctgtgacccccttctacaacaccctgaccaagggccctgagatggagatccacagcggcagcggggaggagcgggagcagcctgaggacaaggatgagagcaaccctgtgatctggaccaagatccgggtgcctggaaatgatgcccctgtggagagcacagagatgcccctggccccacccctgaccccagacctgagccgggagagctggtggccacccttcagcacagtgatggagggcctgctgcccagccagaggcccaccaccagcgagaccggcaccccccgggtggagggcatggtgacagagaagccagccaacaccctgctgcccctgggcggggaccaccagcctgagcccagcggcaagacagccaacagaaaccacctgaagctgcccaacaacatgaaccagaccaagagcagcgagcctgtgctgacagaagaagatgccaccagcctcatcacagagggcttcctgctgaatgccagcaactacaagcagctgaccaatggacatggcagcgcccactggatcgtgggcaactggagcgaatgttccaccacctgtggcctgggcgcctactggaggagagtggagtgcagcacccagatggacagcgactgtgccgccatccagaggccagaccctgccaagcgctgccacctgcggccctgtgccggctggaaggtgggcaactggagcaagtgcagcaggaactgcagcggcggcttcaagatccgggagatccagtgtgtggacagccgggaccacaggaacctgcggcccttccactgccagttcctggccggcatccccccacccctgtccatgagctgcaaccctgagccctgtgaggcctggcaggtggagccctggagccagtgcagccgcagctgtggcggcggcgtgcaggagcggggcgtcttctgccctgggggcctgtgtgactggaccaagaggcccaccagcaccatgagctgcaatgagcacctgtgctgccactgggccaccggcaactgggacctgtgcagcaccagctgtggcggcggcttccagaagaggacagtgcagtgtgtgcccagcgagggcaacaagacagaggaccaggaccagtgcctgtgtgaccacaagcccaggcctcctgagttcaagaagtgcaaccagcaggcctgcaagaagtctgctgacctgctgtgcaccaaggacaagctgagcgccagcttctgccagaccctgaaggccatgaagaagtgcagcgtgcccaccgtgcgggcagagtgctgcttcagctgcccccagacccacatcacccacacccagaggcagaggcggcagaggctgctgcagaagagcaaggagctgtag

SEQ ID NO: 142640 - DNA, 4785 bp, Artificial Sequence
  Description of Artificial Sequence: Synthetic coding sequence
atgccctgtgcccagaggtcctggctggccaacctgtctgtggtggcccagctgctgaactttggagccctgtgctacggccggcagccccagcccggccctgtgcgcttcccagaccggcggcaggagcacttcatcaagggcctgcctgagtaccacgtggtgggccctgtgcgggtggatgccagcggccacttcctgtcctatggcctgcactaccccatcaccagcagcaggaggaagagggacctggatggcagcgaggactgggtgtactaccgcatcagccatgaggagaaggacctcttcttcaacctgactgtgaaccagggcttcctgagcaacagctacatcatggagaagagatatggcaacctgagccacgtgaagatgatggccagcagcgcccccctgtgccacctgagcggcaccgtgctgcagcagggcaccagggtgggcacagctgccctgagcgcctgccacggcctgaccggcttcttccagctgccccatggagacttcttcatcgagcctgtgaagaagcaccccctggtggagggcggctaccacccccacatcgtgtaccgccggcagaaggtgcctgagaccaaggagcccacctgtggcctgaaggacagcgtgaacatcagccagaagcaggagctgtggagggagaagtgggagcggcacaacctgcccagccgcagcctgagcagaagaagcatcagcaaggagcgctgggtggagaccctggtggtggccgacaccaagatgattgagtaccacggctctgaaaatgtggagagctacatcctgaccatcatgaacatggtgacaggcctcttccacaaccccagcattggaaatgccatccacatcgtggtggtgcggctcatcctgctggaggaggaggagcagggcctgaagatcgtgcaccacgccgagaagaccctgagcagcttctgcaagtggcagaagagcatcaaccccaagagtgacctgaaccctgtgcaccatgatgtggccgtgctgctgaccaggaaggacatctgtgccggcttcaaccggccctgtgagaccctgggcctgagccacctgagcggcatgtgccagccccacaggagctgcaacatcaatgaagacagcggcctgcccctggccttcaccatcgcccacgagctgggccacagctttggcatccagcatgatggcaaggaaaatgactgtgagcctgtgggccgccacccctacatcatgagccggcagctgcagtatgaccccacccccctgacctggagcaagtgcagcgaggagtacatcacccgcttcctggaccggggctggggcttctgcctggatgacatccccaagaagaagggcctgaagagcaaggtgattgcccctggggtcatctatgatgtgcaccaccagtgccagctgcagtatggccccaatgccaccttctgccaggaggtggagaatgtgtgccagaccctgtggtgcagcgtgaagggcttctgccgcagcaagctggatgctgctgctgatggcacccagtgtggggagaagaagtggtgcatggccggcaagtgcatcaccgtgggcaagaagccagagagcatccctgggggctggggccgctggagcccctggagccactgcagcaggacctgtggggccggcgtgcagagcgctgagcggctgtgcaacaaccctgagcccaagtttggaggcaagtactgcaccggggagaggaagcgctaccgcctgtgcaatgtgcacccctgccgctctgaggcccccaccttccggcagatgcagtgcagcgagtttgacacagtgccctacaagaatgagctgtaccactggttccccatcttcaacccagcccacccctgtgagctgtactgccggcccattgatggccagttcagcgagaagatgctggatgctgtgattgatggcaccccctgctttgaaggaggcaacagcagaaatgtgtgcatcaatggcatctgcaagatggtgggctgtgactatgaaattgacagcaatgccacagaggacagatgtggggtgtgcctgggagatggcagcagctgccagacagtgaggaagatgttcaagcagaaggagggcagcggctacgtggacatcggcctcatccccaagggggcccgggacatccgggtgatggagattgagggcgccggcaacttcctggccatccgctctgaggaccctgagaagtactacctgaatggaggcttcatcatccagtggaatggaaactacaagctggccggcaccgtcttccagtatgacagaaaaggagacctggagaagctgatggccaccggccccaccaatgaatctgtgtggatccagctgctcttccaggtgaccaaccctggcatcaagtatgagtacaccatccagaaggatggcctggacaatgatgtggagcagcagatgtacttctggcagtatggccactggacagaatgttctgtgacctgtggcaccggcatccggcggcagacagcccactgcatcaagaagggccggggcatggtgaaggccaccttctgtgaccctgagacccagcccaacggccggcagaagaagtgccacgagaaggcctgccccccacgctggtgggccggggagtgggaggcctgcagcgccacctgtggcccccatggagagaagaagaggacagtgctgtgcatccagaccatggtgtctgatgagcaggccctgcccccaacagactgccagcacctgctgaagcccaagaccctgctgagctgcaacagagacatcctgtgccccagcgactggacagtgggcaactggagcgaatgttctgtgtcctgtggcggcggcgtgcgcatccgctctgtgacctgtgccaagaaccatgatgagccctgtgatgtgaccaggaagcccaacagccgggccctgtgtggcctgcagcagtgccccagcagccggcgggtgctgaagcccaacaagggcaccatcagcaatggcaagaacccccccaccctgaagcctgtgcccccacccaccagccggcccaggatgctgaccacccccaccggccctgagagcatgagcaccagcaccccagccatcagcagccccagccccaccacagccagcaaggagggggacctgggcggcaagcagtggcaggacagcagcacccagcctgagctgagcagccgctacctgatcagcacaggcagcaccagccagcccatcctgaccagccagagcctgagcatccagcccagcgaggagaatgtgagcagcagtgacaccggccccaccagcgagggcggcctggtggccaccaccaccagcggcagcggcctgagcagcagcaggaaccccatcacctggcctgtgacccccttctacaacaccctgaccaagggccctgagatggagatccacagcggcagcggggaggagcgggagcagcctgaggacaaggatgagagcaaccctgtgatctggaccaagatccgggtgcctggaaatgatgcccctgtggagagcacagagatgcccctggccccacccctgaccccagacctgagccgggagagctggtggccacccttcagcacagtgatggagggcctgctgcccagccagaggcccaccaccagcgagaccggcaccccccgggtggagggcatggtgacagagaagccagccaacaccctgctgcccctgggcggggaccaccagcctgagcccagcggcaagacagccaacagaaaccacctgaagctgcccaacaacatgaaccagaccaagagcagcgagcctgtgctgacagaggaggatgccaccagcctcatcacagagggcttcctgctgaatgccagcaactacaagcagctgaccaacggccacggcagcgcccactggatcgtgggcaactggagcgagtgcagcaccacctgtggcctgggcgcctactggaggagagtggagtgcagcacccagatggacagcgactgtgccgccatccagaggccagaccctgccaagcgctgccacctgcggccctgtgccggctggaaggtgggcaactggagcaagtgcagcaggaactgcagcggcggcttcaagatccgggagatccagtgtgtggacagccgggaccacaggaacctgcggcccttccactgccagttcctggccggcatccccccacccctgtccatgagctgcaaccctgagccctgtgaggcctggcaggtggagccctggagccagtgcagccgcagctgtggcggcggcgtgcaggagcggggcgtcttctgccctgggggcctgtgtgactggaccaagaggcccaccagcaccatgagctgcaatgagcacctgtgctgccactgggccactggaaactgggacctgtgcagcaccagctgtggcggcggcttccagaagaggacagtgcagtgtgtgcccagcgagggcaacaagacagaggaccaggaccagtgcctgtgtgaccacaagccccggcccccagagttcaagaagtgcaaccagcaggcctgcaagaagtctgctgacctgctgtgcaccaaggacaagctgagcgccagcttctgccagaccctgaaggccatgaagaagtgcagcgtgcccaccgtgcgggcagagtgctgcttcagctgcccccagacccacatcacccacacccagaggcagaggcggcagaggctgctgcagaagagcaaggagctgtag

SEQ ID NO: 142641 - DNA, 699 bp, Artificial Sequence
  Description of Artificial Sequence: Synthetic coding sequence
atgccctgtgcccagaggtcctggctggccaacctgtctgtggtggcccagctgctgaactttggagccctgtgctacggccggcagccccagcccggccctgtgcgcttcccagaccggcggcaggagcacttcatcaagggcctgcctgagtaccacgtggtgggccctgtgcgggtggatgccagcggccacttcctgtcctatggcctgcactaccccatcaccagcagcaggaggaagagggacctggatggcagcgaggactgggtgtactaccgcatcagccatgaggagaaggacctcttcttcaacctgactgtgaaccagggcttcctgagcaacagctacatcatggagaagagatatggcaacctgagccacgtgaagatgatggccagcagcgcccccctgtgccacctgagcggcaccgtgctgcagcagggcaccagggtgggcacagctgccctgagcgcctgccacggcctgaccggcttcttccagctgccccatggagacttcttcatcgagcctgtgaagaagcaccccctggtggagggcggctaccacccccacatcgtgtaccgccggcagaaggtgcctgagaccaaggagcccacctgtggcctgaagggcatcgtgacccacatgagctcctgggtggaggagagcgtgctcttcttctggctgttctactag

SEQ ID NO: 142642 - DNA, 3675 bp, Artificial Sequence
  Description of Artificial Sequence: Synthetic coding sequence
atgaagccccgggcccggggctggaggggcctggccgccctgtggatgctgctggcccaggtggccgagcaggccccagcctgtgccatgggccctgctgctgctgcccctggcagccccagcgtgcccaggcctcctcctcctgctgagcggcccggctggatggagaagggggagtatgacctggtgtctgcctatgaggtggaccacagaggagactatgtgtcccatgagatcatgcaccaccagaggagaagaagagctgtgcctgtgtctgaggtggagagcctgcacctgcggctgaagggcagcagacatgacttccacatggacctgcggaccagcagcagcctggtggcccctggcttcatcgtgcagaccctgggcaagacaggcaccaagtctgtgcagaccctgcccccagaggacttctgcttctaccagggcagcctgcggagccacaggaacagctctgtggccctgagcacctgccagggcctgagcggcatgatcagaacagaggaggccgactacttcctgcggcccctgcccagccacctgtcctggaagctgggccgggccgcccagggcagcagccccagccacgtgctgtacaagaggagcacagagccccacgcccctggggccagcgaggtgctggtgaccagcaggacctgggagctggcccaccagcccctgcacagcagtgacctgcggctgggcctgccccagaagcagcacttctgtggccgcaggaagaagtacatgccccagccccccaaggaggacctcttcatcctgcctgatgagtacaagagctgcctgcggcacaagaggagcctgctgcggagccacagaaatgaggagctgaatgtggagaccctggtggtggtggacaagaagatgatgcagaaccacggccacgagaacatcaccacctacgtgctgaccatcctgaacatggtgtctgccctcttcaaggatggcaccatcggcggcaacatcaacatcgccatcgtgggcctcatcctgctggaggatgagcagcccggcctggtgatcagccaccacgccgaccacaccctgagcagcttctgccagtggcagagcggcctgatgggcaaggatggcaccaggcatgaccacgccatcctgctgaccggcctggacatctgctcctggaagaatgagccctgtgacaccctgggctttgcccccatcagcggcatgtgcagcaagtaccgcagctgcaccatcaatgaagacaccggcctgggcctggccttcaccatcgcccatgaaagtggccacaactttggcatgattcatgatggagagggcaacatgtgcaagaagtctgagggcaacatcatgagccccaccctggccggcagaaatggagtcttctcctggagcccctgcagccggcagtacctgcacaagttcctgagcacagcccaggccatctgcctggccgaccagcccaagcctgtgaaggagtacaagtacccagagaagctgcccggggagctgtatgatgccaacacccagtgcaagtggcagtttggagagaaggccaagctgtgcatgctggacttcaagaaggacatctgcaaggccctgtggtgccaccgcatcggcaggaaatgtgagaccaagttcatgcctgctgctgagggcaccatctgtggccatgacatgtggtgccggggcggccagtgtgtgaagtatggagatgagggccccaagcccacccacggccactggagcgactggagctcctggagcccctgcagcaggacctgtggcggcggcgtgagccacaggagccggctgtgcaccaaccccaagcccagccacggcggcaagttctgtgagggcagcaccaggaccctgaagctgtgcaacagccagaagtgcccccgggacagcgtggacttccgggccgcccagtgtgccgagcacaacagccgccgcttccggggccgccactacaagtggaagccctacacccaggtggaggaccaggacctgtgcaagctgtactgcatcgccgagggctttgacttcttcttcagcctgagcaacaaggtgaaggatggcaccccctgcagcgaggacagcagaaatgtgtgcattgatggcatctgtgagcgggtgggctgtgacaacgtgctgggcagtgatgctgtggaggatgtgtgtggggtgtgcaatggaaacaacagcgcctgcaccatccaccggggcctgtacaccaagcaccaccacaccaaccagtactaccacatggtgaccatccccagcggggcccggagcatccgcatctatgagatgaatgtgtccaccagctacatctctgtgagaaatgccctgcggcgctactacctgaatggccactggacagtggactggccaggccgctacaagttcagcggcaccacctttgactacagaagaagctacaatgaacctgagaacctgattgccaccggccccaccaatgagaccctgattgtggagctgctcttccagggcagaaatcctggggtggcctgggagtacagcatgccccggctgggcacagagaagcagcccccagcccagcccagctacacctgggccatcgtgcgctctgagtgcagcgtgtcctgtggcggcggccagatgacagtgcgggagggctgctacagagacctgaagttccaggtgaacatgtccttctgcaaccccaagaccaggcctgtgacaggcctggtgccctgcaaggtgtctgcctgcccccccagctggagcgtgggcaactggagcgcctgcagcaggacctgtggcggcggggcccagagcaggcctgtgcagtgcacccggcgggtgcactatgacagcgagcctgtgcctgccagcctgtgcccccagcctgcccccagcagccggcaggcctgcaacagccagagctgccccccagcctggagcgctggcccctgggccgagtgcagccacacctgtgggaagggctggaggaagagagctgtggcctgcaagagcaccaaccccagcgcccgggcccagctgctgcctgatgctgtgtgcaccagcgagcccaagcccaggatgcatgaggcctgcctgctgcagcgctgccacaagcccaagaagctgcagtggctggtgtctgcctggagccagtgcagcgtgacctgtgagcggggcacccagaagcgcttcctgaagtgtgccgagaagtatgtgtctgggaagtaccgggagctggccagcaagaagtgcagccacctgcccaagcccagcctggagctggagcgggcctgtgcccccctgccctgccccaggcaccccccatttgctgctgctggccccagccggggctcctggtttgccagcccctggagccagtgcacagccagctgtggcggcggcgtgcagaccaggtctgtgcagtgcctggccggcggccgcccagccagcggctgcctgctgcaccagaagcccagcgccagcctggcctgcaacacccacttctgccccatcgccgagaagaaggatgccttctgcaaggactacttccactggtgctacctggtgccccagcacggcatgtgcagccacaagttctacggcaagcagtgctgcaagacctgcagcaagagcaacctgtag

SEQ ID NO: 142643 - DNA, 2787 bp, Artificial Sequence
  Description of Artificial Sequence: Synthetic coding sequence
atgaagccccgggcccggggctggaggggcctggccgccctgtggatgctgctggcccaggtggccgagcaggccccagcctgtgccatgggccctgctgctgctgcccctggcagccccagcgtgcccaggcctcctcctcctgctgagcggcccggctggatggagaagggggagtatgacctggtgtctgcctatgaggtggaccacagaggagactatgtgtcccatgagatcatgcaccaccagaggagaagaagagctgtgcctgtgtctgaggtggagagcctgcacctgcggctgaagggcagcagacatgacttccacatggacctgcggaccagcagcagcctggtggcccctggcttcatcgtgcagaccctgggcaagacaggcaccaagtctgtgcagaccctgcccccagaggacttctgcttctaccagggcagcctgcggagccacaggaacagctctgtggccctgagcacctgccagggcctgagcggcatgatcagaacagaggaggccgactacttcctgcggcccctgcccagccacctgtcctggaagctgggccgggccgcccagggcagcagccccagccacgtgctgtacaagaggagcacagagccccacgcccctggggccagcgaggtgctggtgaccagcaggacctgggagctggcccaccagcccctgcacagcagtgacctgcggctgggcctgccccagaagcagcacttctgtggccgcaggaagaagtacatgccccagccccccaaggaggacctcttcatcctgcctgatgagtacaagagctgcctgcggcacaagaggagcctgctgcggagccacagaaatgaggagctgaatgtggagaccctggtggtggtggacaagaagatgatgcagaaccacggccacgagaacatcaccacctacgtgctgaccatcctgaacatggtgtctgccctcttcaaggatggcaccatcggcggcaacatcaacatcgccatcgtgggcctcatcctgctggaggatgagcagcccggcctggtgatcagccaccacgccgaccacaccctgagcagcttctgccagtggcagagcggcctgatgggcaaggatggcaccaggcatgaccacgccatcctgctgaccggcctggacatctgctcctggaagaatgagccctgtgacaccctgggctttgcccccatcagcggcatgtgcagcaagtaccgcagctgcaccatcaatgaagacaccggcctgggcctggccttcaccatcgcccatgaaagtggccacaactttggcatgattcatgatggagagggcaacatgtgcaagaagtctgagggcaacatcatgagccccaccctggccggcagaaatggagtcttctcctggagcccctgcagccggcagtacctgcacaagttcctgagcacagcccaggccatctgcctggccgaccagcccaagcctgtgaaggagtacaagtacccagagaagctgcccggggagctgtatgatgccaacacccagtgcaagtggcagtttggagagaaggccaagctgtgcatgctggacttcaagaaggacatctgcaaggccctgtggtgccaccgcatcggcaggaaatgtgagaccaagttcatgcctgctgctgagggcaccatctgtggccatgacatgtggtgccggggcggccagtgtgtgaagtatggagatgagggccccaagcccacccacggccactggagcgactggagctcctggagcccctgcagcaggacctgtggcggcggcgtgagccacaggagccggctgtgcaccaaccccaagcccagccacggcggcaagttctgtgagggcagcaccaggaccctgaagctgtgcaacagccagaagtgcccccgggacagcgtggacttccgggccgcccagtgtgccgagcacaacagccgccgcttccggggccgccactacaagtggaagccctacacccaggtggaggaccaggacctgtgcaagctgtactgcatcgccgagggctttgacttcttcttcagcctgagcaacaaggtgaaggatggcaccccctgcagcgaggacagcagaaatgtgtgcattgatggcatctgtgagcgggtgggctgtgacaacgtgctgggcagtgatgctgtggaggatgtgtgtggggtgtgcaatggaaacaacagcgcctgcaccatccaccggggcctgtacaccaagcaccaccacaccaaccagtactaccacatggtgaccatccccagcggggcccggagcatccgcatctatgagatgaatgtgtccaccagctacatctctgtgagaaatgccctgcggcgctactacctgaatggccactggacagtggactggccaggccgctacaagttcagcggcaccacctttgactacagaagaagctacaatgaacctgagaacctgattgccaccggccccaccaatgagaccctgattgtggagctgctcttccagggcagaaatcctggggtggcctgggagtacagcatgccccggctgggcacagagaagcagcccccagcccagcccagctacacctgggccatcgtgcgctctgagtgcagcgtgtcctgtggcggcggccagatgacagtgcgggagggctgctacagagacttcctgtacttcatgttctacctgagccagctgtttgccagcgagtgccccttcaagaacaccctgctgcacgccttcctgtgcaagtag

SEQ ID NO: 142644 - DNA, 3288 bp, Artificial Sequence
  Description of Artificial Sequence: Synthetic coding sequence
atgtgtgatggagccctgctgccccccctggtgctgcctgtgctgctgctgctggtgtggggcctggaccccggcacagctgtgggagatgctgctgctgatgtggaggtggtgctgccctggagggtgcggccagatgatgtgcacctgccccccctgcctgctgcccctggccccaggagaagaagaagacccaggaccccacctgctgccccccgggcccggcctggagagcgggccctgctgctgcacctgcctgccttcggccgggacctgtacctgcagctgcggcgggacctgcgcttcctgagccggggctttgaggtggaggaggccggggccgccaggagaagaggccggcctgctgagctgtgcttctacagcggccgggtgctgggccaccctggcagcctggtgtccctgagcgcctgtggggctgctgggggcctggtgggcctcatccagctgggccaggagcaggtgctgatccagcccctgaacaacagccagggccccttcagcggccgggagcacctgatccggaggaagtggagcctgacccccagccccagcgctgaggcccagaggcctgagcagctgtgcaaggtgctgacagagaagaagaagcccacctggggccggcccagccgggactggagggagaggagaaatgccatccggctgaccagcgagcacacagtggagaccctggtggtggctgatgctgacatggtgcagtaccacggggctgaggccgcccagcgcttcatcctgactgtgatgaacatggtgtacaacatgttccagcaccagagcctgggcatcaagatcaacatccaggtgaccaagctggtgctgctgcggcagaggcctgccaagctgagcatcggccaccacggggagaggagcctggagagcttctgccactggcagaatgaggagtatggaggagcccgctacctgggcaacaaccaggtgcctgggggcaaggatgatcctcccctggtggatgctgctgtgtttgtgaccaggacagacttctgtgtgcacaaggatgagccctgtgacacagtgggcatcgcctacctgggcggcgtgtgcagcgccaagaggaaatgtgtgctggctgaagataatggcctgaacctggccttcaccatcgcccacgagctgggccacaacctgggcatgaaccatgatgatgaccacagcagctgtgccggccgcagccacatcatgtctggagagtgggtgaagggcaggaaccccagcgacctgtcctggagcagctgcagcagagatgacctggagaacttcctgaagagcaaggtgtccacctgcctgctggtgacagaccccaggagccagcacacagtgcggctgccccacaagctgcccggcatgcactacagcgccaatgagcagtgccagatcctgtttggcatgaatgccaccttctgcaggaacatggagcacctgatgtgtgccggcctgtggtgcctggtggagggggacaccagctgcaagaccaagctggacccccccctggatggaacagaatgtggggctgacaagtggtgcagagctggagaatgtgtgtccaagacccccatccctgagcacgtggatggagactggagcccctggggcgcctggagcatgtgcagcaggacctgtggcactggagcccgcttccggcagaggaaatgtgacaaccccccacctggccctgggggcacccactgccctggggcctctgtggagcacgctgtgtgtgagaacctgccctgccccaagggcctgcccagcttccgggaccagcagtgccaggcccatgaccggctgagccccaagaagaagggcctgctgacagctgtggtggtggatgacaagccctgtgagctgtactgcagccccctgggcaaggagagccccctgctggtggccgacagagtgctggatggcaccccctgtggcccctatgaaacagacctgtgtgtgcacggcaagtgccagaagattggctgtgatggcatcatcggcagcgctgccaaggaggacagatgtggggtgtgcagcggagatggcaagacctgccacctggtgaagggggacttcagccacgcccggggcacagccctgaaggacagcggcaagggcagcatcaacagcgactggaagattgagctgcctggagagttccagattgctggcaccaccgtgcgctacgtgagaagaggcctgtgggagaagatcagcgccaagggccccaccaagctgcccctgcacctgatggtgctgctcttccatgaccaggactatggcatccactatgagtacacagtgcctgtgaacagaacagctgagaaccagagcgagcctgagaagccccaggacagcctcttcatctggacccacagcggctgggagggctgcagcgtgcagtgtggcggcggggagaggaggaccatcgtgtcctgcacccgcatcgtgaacaagaccaccaccctggtgaatgacagcgactgcccccaggccagcaggcctgagccccaggtgcggcgctgcaacctgcacccctgccagagccgctgggtggccggcccctggagcccctgcagcgccacctgtgagaagggcttccagcaccgggaggtgacctgtgtgtaccagctgcagaatggcacccacgtggccacccggcccctgtactgccccggccccaggcctgctgctgtgcagagctgtgagggccaggactgcctgagcatctgggaggccagcgagtggagccagtgcagcgccagctgtgggaaaggagtgtggaagaggacagtggcctgcaccaacagccagggcaaatgtgatgccagcacccggcccagggctgaggaggcctgtgaggactacagcggctgctatgagtggaagacaggagactggagcacctgcagcagcacctgtgggaagggcctgcagagccgggtggtgcagtgcatgcacaaggtgactggaagacatggcagcgagtgcccagccctgagcaagccagccccctaccggcagtgctaccaggaggtgtgcaatgaccgcatcaatgccaacaccatcaccagcccccggctggccgccctgacctacaagtgcacccgggaccagtggacagtgtactgcagggtcatccgggagaagaacctgtgccaggacatgcgctggtaccagcgctgctgccagacctgccgggacttctacgccaacaagatgaggcagcccccacccaacagctag

SEQ ID NO: 142645 - DNA, 3666 bp, Artificial Sequence
  Description of Artificial Sequence: Synthetic coding sequence
atggagtgtgccctgctgctggcctgtgccttccctgctgctggcagcggccccccccggggcctggccggcctgggccgggtggccaaggccctgcagctgtgctgcctgtgctgtgcctctgtggccgccgccctggccagtgacagcagcagcggggccagcggcctgaatgatgattatgtgtttgtgacccctgtggaggtggacagcgctggcagctacatcagccatgacatcctgcacaatggaaggaagaagaggtctgcccagaatgcccggagcagcctgcactaccgcttcagcgccttcggccaggagctgcacctggagctgaagcccagcgccatcctgagcagccacttcatcgtgcaggtgctgggcaaggatggagccagcgagacccagaagccagaggtgcagcagtgcttctaccagggcttcatcagaaatgacagcagcagctctgtggccgtgtccacctgtgccggcctgagcggcctcatccgcaccaggaagaatgagttcctgatcagccccctgccccagctgctggcccaggagcacaactacagcagccctgctggccaccacccccacgtgctgtacaagaggacagctgaggagaagatccagcgctaccggggctacccaggcagcggcaggaactacccaggctacagccccagccacatcccccacgccagccagagccgggagacagagtaccaccaccggcggctgcagaagcagcacttctgtggccgcaggaagaagtatgcccccaagccacccacagaggacacctacctgcgctttgatgaatatggcagcagcggccggcccaggagatctgctgggaagagccagaagggcctgaatgtggagaccctggtggtggccgacaagaagatggtggagaagcatggaaaaggaaatgtgaccacctacatcctgactgtgatgaacatggtgtctggcctcttcaaggatggcaccatcggcagtgacatcaacgtggtggtggtgtccctcatcctgctggagcaggagcccggcggcctgctgatcaaccaccacgccgaccagagcctgaacagcttctgccagtggcagagcgccctgattggcaagaatggcaagagacatgaccacgccatcctgctgaccggctttgacatctgctcctggaagaatgagccctgtgacaccctgggctttgcccccatcagcggcatgtgcagcaagtaccgcagctgcaccatcaatgaagacaccggcctgggcctggccttcaccatcgcccacgagagcggccacaactttggcatgattcatgatggagagggcaacccctgcaggaaggccgagggcaacatcatgagccccaccctgaccggcaacaatggagtcttctcctggagcagctgcagccggcagtacctgaagaagttcctgagcaccccccaggccggctgcctggtggatgagcccaagcaggccggccagtacaagtacccagacaagctgcccggccagatctatgatgctgacacccagtgcaagtggcagtttggagccaaggccaagctgtgcagcctgggctttgtgaaggacatctgcaagagcctgtggtgccaccgggtgggccaccgctgtgagaccaagttcatgcctgctgctgagggcaccgtgtgtggcctgtccatgtggtgccggcagggccagtgtgtgaagtttggagagctgggcccccggcccatccacggccagtggagcgcctggagcaagtggagcgagtgcagcaggacctgtggcggcggcgtgaagttccaggagcggcactgcaacaaccccaagccccagtatggaggcctcttctgccccggcagcagccgcatctaccagctgtgcaacatcaacccctgcaatgaaaacagcctggacttccgggcccagcagtgtgccgagtacaacagcaagcccttccggggctggttctaccagtggaagccctacaccaaggtggaggaggaggaccgctgcaagctgtactgcaaggcagaaaattttgagttcttctttgccatgtctgggaaggtgaaggatggcaccccctgcagccccaacaagaatgatgtgtgcattgatggagtgtgtgagctggtgggctgtgaccacgagctgggcagcaaggctgtgtctgatgcctgtggggtgtgcaagggggacaacagcacctgcaagttctacaagggcctgtacctgaaccagcacaaggccaatgagtactaccctgtggtgctgatcccagctggggcccggagcattgagatccaggagctgcaggtgagcagcagctacctggccgtgcgcagcctgagccagaagtactacctgactggaggctggagcattgactggccaggagagttcccctttgctggcaccacctttgagtaccagaggagcttcaacagacctgagcggctgtatgcccctggccccaccaatgagaccctggtgtttgagatcctgatgcagggcaagaaccctggcatcgcctggaagtatgccctgcccaaggtgatgaatggcaccccaccagccaccaagaggcctgcctacacctggagcatcgtgcagagcgagtgcagcgtgtcctgtggcggcggctacatcaacgtgaaggccatctgcctgcgggaccagaacacccaggtgaacagcagcttctgcagcgccaagaccaagcctgtgacagagcccaagatctgcaatgccttcagctgcccagcctactggatgcctggagagtggagcacctgcagcaaggcctgtgccggcggccagcagagcaggaagatccagtgtgtgcagaagaagcccttccagaaggaggaggccgtgctgcacagcctgtgccctgtgtccacccccacccaggtgcaggcctgcaacagccacgcctgccccccccagtggagcctgggcccctggagccagtgcagcaagacctgtggccggggcgtgaggaagcgggagctgctgtgcaagggcagcgctgctgagaccctgcctgagagccagtgcaccagcctgcccaggcctgagctgcaggagggctgtgtgctgggccgctgccccaagaacagccggctgcagtgggtggccagctcctggagcgaatgttctgccacctgtggcctgggcgtgaggaagcgggagatgaagtgcagcgagaagggcttccagggcaagctgatcaccttccctgagcggcgctgcaggaacatcaagaagcccaacctggacctggaggagacctgcaacagaagagcctgcccagcccaccctgtgtacaacatggtggccggctggtacagcctgccctggcagcagtgcaccgtgacctgtggcggcggcgtgcagaccaggtctgtgcactgtgtgcagcagggccggcccagcagcagctgcctgctgcaccagaagccccctgtgctgcgggcctgcaacaccaacttctgcccagcccctgagaagcgggaggaccccagctgtgtggacttcttcaactggtgccacctggtgccccagcacggcgtgtgcaaccacaagttctacggcaagcagtgctgcaagagctgcaccaggaagatctag

SEQ ID NO: 142646 - DNA, 825 bp, Artificial Sequence
  Description of Artificial Sequence: Synthetic coding sequence
atggagtgtgccctgctgctggcctgtgccttccctgctgctggcagcggccccccccggggcctggccggcctgggccgggtggccaaggccctgcagctgtgctgcctgtgctgtgcctctgtggccgccgccctggccagtgacagcagcagcggggccagcggcctgaatgatgattatgtgtttgtgacccctgtggaggtggacagcgctggcagctacatcagccatgacatcctgcacaatggaaggaagaagaggtctgcccagaatgcccggagcagcctgcactaccgcttcagcgccttcggccaggagctgcacctggagctgaagcccagcgccatcctgagcagccacttcatcgtgcaggtgctgggcaaggatggagccagcgagacccagaagccagaggtgcagcagtgcttctaccagggcttcatcagaaatgacagcagcagctctgtggccgtgtccacctgtgccggcctgagcggcctcatccgcaccaggaagaatgagttcctgatcagccccctgccccagctgctggcccaggagcacaactacagcagccctgctggccaccacccccacgtgctgtacaagaggacagctgaggagaagatccagcgctaccggggctacccaggcagcggcaggaactacccaggctacagccccagccacatcccccacgccagccagagccgggagacagagtaccaccaccggcggctgcagaagcagcacttctgtggccgcaggaagaagtgcatctgcagccaggccagccaccggggccacctgagcaaggtgtag

SEQ ID NO: 142647 - DNA, 3636 bp, Artificial Sequence
  Description of Artificial Sequence: Synthetic coding sequence
atggaccccccagctggagctgcccggcggctgctgtgcccagccctgctgctgctgctgctgctgctgcccccacccctgctgcccccacctcctcctccagccaatgcccggctggccgctgctgctgaccccccaggcggccccctgggccacggggctgagcgcatcctggccgtgcctgtgaggacagatgcccagggccgcctggtgagccacgtggtgtctgctgccaccagccgggccggcgtgcgggccaggagagctgcccctgtgaggacccccagcttccctggaggaaatgaggaggagcccggcagccacctgttctacaacgtgacagtgtttggccgggacctgcacctgcggctgcggcccaatgcccggctggtggcccctggggccaccatggagtggcagggcgagaagggcaccaccagggtggagcccctgctgggcagctgcctgtatgtgggagatgtggccggcctggccgaggccagctctgtggccctgagcaactgtgatggcctggccggcctcatccgcatggaggaggaggagttcttcatcgagcccctggagaagggcctggccgcccaggaggccgagcagggccgggtgcacgtggtgtacagaagaccacccaccagcccccccctgggcggcccccaggccctggacacaggagccagcctggacagcctggacagcctgagccgggccctgggcgtgctggaggagcacgccaacagcagcagaagaagagccaggagacatgctgctgatgatgactacaacatcgaggtgctgctgggcgtggatgattctgtggtgcagttccacggcaaggagcacgtgcagaagtacctgctgaccctgatgaacatcgtgaatgagatctaccatgatgagagcctgggcgcccacatcaacgtggtgctggtgcgcatcatcctgctgtcctatggcaagtccatgagcctcatcgagatcggcaaccccagccagagcctggagaatgtgtgccgctgggcctacctgcagcagaagccagacaccggccatgatgagtaccatgaccacgccatcttcctgacccggcaggactttggccccagcggcatgcagggctacgcccctgtgacaggcatgtgccaccctgtgcgcagctgcaccctgaaccatgaagatggcttcagcagcgcctttgtggtggcccacgagaccggccacgtgctgggcatggagcatgatggccagggcaacagatgtggagatgaggtgcggctgggcagcatcatggcccccctggtgcaggccgccttccaccgcttccactggagccgctgcagccagcaggagctgagccgctacctgcacagctatgactgcctgctggatgacccctttgcccatgactggccagccctgccccagctgcccggcctgcactacagcatgaatgagcagtgccgctttgattttggcctgggctacatgatgtgcacagccttccgcacctttgacccctgcaagcagctgtggtgcagccacccagacaacccctacttctgcaagaccaagaagggcccccccctggatggcaccatgtgtgcccctgggaagcactgcttcaagggccactgcatctggctgaccccagacatcctgaagagagatggctcctggggcgcctggagccccttcggcagctgcagcaggacctgtggcactggagtgaagttccgcacccggcagtgtgacaacccccacccagccaatggaggccgcacctgcagcggcctggcctatgacttccagctgtgcagccggcaggactgcccagacagcctggccgacttccgggaggagcagtgccggcagtgggacctgtactttgagcacggagatgcccagcaccactggctgccccatgagcacagagatgccaaggagcgctgccacctgtactgtgagagccgggagaccggggaggtggtgtccatgaagaggatggtgcatgatggcacccgctgcagctacaaggatgccttcagcctgtgtgtgcggggggactgcaggaaggtgggctgtgatggagtgattggcagcagcaagcaggaggacaagtgtggggtgtgtggcggggacaacagccactgcaaggtggtgaagggcaccttcaccaggagccccaagaagcacggctacatcaagatgtttgagatcccagctggggcccggcacctgctgatccaggaggtggatgccaccagccaccacctggccgtgaagaacctggagaccgggaagttcatcctgaatgaggagaatgatgtggatgccagcagcaagaccttcatcgccatgggcgtggagtgggagtacagagatgaagatggccgggagaccctgcagaccatgggccccctgcacggcaccatcaccgtgctggtgattcctgtgggggacaccagggtgtccctgacctacaagtacatgattcatgaggacagcctgaatgtggatgacaacaacgtgctggaggaggacagcgtggtgtatgagtgggccctgaagaagtggagcccctgcagcaagccctgtggcggcggcagccagttcaccaagtatggctgcagaagaaggctggaccacaagatggtgcaccggggcttctgtgccgccctgagcaagcccaaggccatcagaagagcctgcaacccccaggagtgcagccagcctgtgtgggtgactggagagtgggagccctgcagccagacctgtggccgcacaggcatgcaggtgcgctctgtgcgctgcatccagcccctgcatgacaacaccaccaggtctgtgcacgccaagcactgcaatgatgcccggcctgagagcagaagagcctgcagccgggagctgtgccccggccgctggagggctggcccctggagccagtgcagcgtgacctgtggaaatggcacccaggagaggcctgtgctgtgcaggacagcagatgacagctttggcatctgccaggaggagaggcctgagacagcccggacctgccgcctgggcccctgccccaggaacatcagtgaccccagcaagaagagctatgtggtgcagtggctgagcaggccagaccctgacagccccatcaggaagatcagcagcaagggccactgccagggcgacaagagcatcttctgcaggatggaggtgctgagccgctactgcagcatccctggctacaacaagctgtgctgcaagagctgcaacctgtacaacaacctgaccaacgtggagggccgcatcgagcccccacctgggaagcacaatgacattgatgtgttcatgcccaccctgcctgtgcccaccgtggccatggaggtgcggcccagccccagcacccccctggaggtgcccctgaatgccagcagcaccaatgccacagaggaccaccctgagaccaatgctgtggatgagccctacaagatccacggcctggaggatgaggtgcagccccccaacctgatcccccggcggcccagcccctatgagaagaccaggaaccagaggatccaggagctgattgatgagatgaggaagaaggagatgctgggcaagttctag

SEQ ID NO: 142648 - DNA, 1701 bp, Artificial Sequence
  Description of Artificial Sequence: Synthetic coding sequence
atggaccccccagctggagctgcccggcggctgctgtgcccagccctgctgctgctgctgctgctgctgcccccacccctgctgcccccacctcctcctccagccaatgcccggctggccgctgctgctgaccccccaggcggccccctgggccacggggctgagcgcatcctggccgtgcctgtgaggacagatgcccagggccgcctggtgagccacgtggtgtctgctgccaccagccgggccggcgtgcgggccaggagagctgcccctgtgaggacccccagcttccctggaggaaatgaggaggagcccggcagccacctgttctacaacgtgacagtgtttggccgggacctgcacctgcggctgcggcccaatgcccggctggtggcccctggggccaccatggagtggcagggcgagaagggcaccaccagggtggagcccctgctgggcagctgcctgtatgtgggagatgtggccggcctggccgaggccagctctgtggccctgagcaactgtgatggcctggccggcctcatccgcatggaggaggaggagttcttcatcgagcccctggagaagggcctggccgcccaggaggccgagcagggccgggtgcacgtggtgtacagaagaccacccaccagcccccccctgggcggcccccaggccctggacacaggagccagcctggacagcctggacagcctgagccgggccctgggcgtgctggaggagcacgccaacagcagcagaagaagagccaggagacatgctgctgatgatgactacaacatcgaggtgctgctgggcgtggatgattctgtggtgcagttccacggcaaggagcacgtgcagaagtacctgctgaccctgatgaacatcgtgaatgagatctaccatgatgagagcctgggcgcccacatcaacgtggtgctggtgcgcatcatcctgctgtcctatggcaagtccatgagcctcatcgagatcggcaaccccagccagagcctggagaatgtgtgccgctgggcctacctgcagcagaagccagacaccggccatgatgagtaccatgaccacgccatcttcctgacccggcaggactttggccccagcggcatgcagggctacgcccctgtgacaggcatgtgccaccctgtgcgcagctgcaccctgaaccatgaagatggcttcagcagcgcctttgtggtggcccacgagaccggccacgtgctgggcatggagcatgatggccagggcaacagatgtggagatgaggtgcggctgggcagcatcatggcccccctggtgcaggccgccttccaccgcttccactggagccgctgcagccagcaggagctgagccgctacctgcacagctatgactgcctgctggatgacccctttgcccatgactggccagccctgccccagctgcccggcctgcactacagcatgaatgagcagtgccgctttgattttggcctgggctacatgatgtgcacagccttccgcacctttgacccctgcaagcagctgtggtgcagccacccagacaacccctacttctgcaagaccaagaagggcccccccctggatggcaccatgtgtgcccctgggaagttccggcctggagctgtggcccacgcctgctaccccagcaccctgggcggccagggccgctggatcgcctag

SEQ ID NO: 142649 - DNA, 4515 bp, Artificial Sequence
  Description of Artificial Sequence: Synthetic coding sequence
atgtgggtggccaagtggctgaccggcctgctgtaccacctgagcctcttcatcaccaggtcctgggaggtggacttccacccccggcaggaggccctggtgaggaccctgaccagctatgaggtggtgattcctgagcgggtgaatgaatttggagaggtgttcccccagagccaccacttcagccggcagaagaggagcagcgaggccctggagcccatgcccttccgcacccactaccgcttcaccgcctacggccagctgttccagctgaacctgacagcagatgccagcttcctggccgccggctacacagaggtgcacctgggcaccccagagcggggggcctgggagagtgatgctggccccagcgacctgcggcactgcttctaccggggccaggtgaacagccaggaggactacaaggctgtggtgtccctgtgtggcggcctgaccggcaccttcaagggccagaatggagagtacttcctggagcccatcatgaaggcagatggaaatgaatatgaagatggccacaacaagccccacctgatctaccggcaggacctgaacaacagcttcctgcagaccctgaagtactgcagcgtgtctgagagccagatcaaggagaccagcctgcccttccacacctacagcaacatgaatgaagacctgaatgtgatgaaggagcgggtgctgggccacaccagcaagaatgtgcccctgaaggatgagcggcggcacagcaggaagaagaggctcatctcctacccccgctacatcgagatcatggtgacagcagatgccaaggtggtgtctgcccacggcagcaacctgcagaactacatcctgaccctgatgagcatcgtggccaccatctacaaggaccccagcatcggcaacctgatccacatcgtggtggtgaagctggtgatgatccaccgggaggaggagggccctgtgatcaactttgatggagccaccaccctgaagaacttctgctcctggcagcagacccagaatgacctggatgatgtgcaccccagccaccacgacacagctgtgctgatcacccgggaggacatctgcagcagcaaggagaagtgcaacatgctgggcctgagctacctgggcaccatctgtgaccccctgcagagctgcttcatcaatgaggagaagggcctcatcagcgccttcaccatcgcccacgagctgggccacaccctgggcgtgcagcatgatgacaacccccgctgcaaggagatgaaggtgaccaagtaccacgtgatggccccagccctgtccttccacatgagcccctggagctggagcaactgcagcaggaaatatgtgacagagttcctggacaccggctatggagaatgtctgctggacaagccagatgaggagatctacaacctgcccagcgagctgcccggcagccgctatgatggcaacaagcagtgtgagctggcctttggacctggcagccagatgtgcccccacatcaacatctgcatgcacctgtggtgcaccagcacagagaagctgcacaagggctgcttcacccagcacgtgcccccagcagatggaacagactgtggccctggcatgcactgccgccacggcctgtgtgtgaacaaggagacagagaccaggcctgtgaatggagagtggggcccctgggagccctacagcagctgcagcaggacctgtggcggcggcatcgagagcgccacccggcgctgcaacagacctgagcccagaaatggaggcaactactgtgtgggccgcaggatgaagttccgcagctgcaacacagacagctgccccaagggcacccaggacttccgggagaagcagtgcagcgacttcaacgggaagcacctggacatcagcggcatccccagcaatgtgcgctggctgccccgctacagcggcatcggcaccaaggaccgctgcaagctgtactgccaggtggccggcaccaactacttctacctgctgaaggacatggtggaggatggcaccccctgtggcacagagagctacaacatcgactgcaactgtgtgctgaaggctgctggctgtgaccacgtgctgaacagcagcgccaagattgacaagtgtggggtgtgtggcggggacaacagcagctgcaagaccatcaccggggtcttcaacagcagccactacggctacaacgtggtggtgaagatcccagctggggccaccaacgtggacatccggcagtacagctacagcggccagccagatgacagctacctggccctgagtgatgctgagggcaacttcctgttcaatggaaacttcctgctgagcaccagcaagaaggagatcaacgtgcagggcaccaggacagtcatcgagtacagcggcagcaacaatgctgtggagcgcatcaacagcaccaaccggcaggagaaggagatcctgattgaggtgctgtgtgtgggcaacctgtacaacccagatgtgcactacagcttcaacatccccctggaggagaggagtgacatgttcacctgggacccctacggcccctgggagggctgcaccaagatgtgccagggcctgcagaggaggaacatcacctgcatccacaagagtgaccacagcgtggtgtctgacaaggaatgtgaccacctgcccctgcccagctttgtgacccagagctgcaacacagactgtgagctgcgctggcacgtgattggcaagtcagaatgtagcagccagtgtggccagggctaccgcaccctggacatccactgcatgaagtacagcatccacgagggccagacagtgcaggtggatgaccactactgtggggaccagctgaagccacccacccaggagctgtgccacggcaactgtgtgttcacccgctggcactacagcgagtggagccagtgcagccgcagctgtggcggcggggagaggagccgggagagctactgcatgaacaactttggccaccggctggccgacaatgaatgccaggagctgagccgggtgacccgggagaactgcaatgagttcagctgccccagctgggccgccagcgagtggagcgagtgcctggtgacctgtgggaagggcaccaagcagaggcaggtgtggtgccagctgaatgtggaccacctgagtgatggcttctgcaacagcagcaccaagccagagagcctgagcccctgtgagctgcacacctgtgcctcctggcaggtgggcccctggggcccctgcaccaccacctgtggccacggctaccagatgagagatgtgaagtgtgtgaatgagctggccagcgctgtgctggaggacacagagtgccacgaggccagccggcccagcgaccggcagagctgtgtgctgaccccctgcagcttcatcagcaagctggagacagccctgctgcccaccgtgctgatcaagaagatggcccagtggaggcatggctcctggaccccctgcagcgtgtcctgtggccggggcacccaggcccgctacgtgtcctgcagagatgccctggacagaattgctgatgagagctactgtgcccacctgcccaggcctgctgagatctgggactgcttcaccccctgtggggagtggcaggccggggactggagcccctgcagcgccagctgtggccacggcaagaccacccggcaggtgctgtgcatgaactaccaccagcccattgatgagaactactgtgaccctgaggtgcggcccctgatggagcaggagtgcagcctggccgcctgccccccagcccacagccacttccccagcagccctgtgcagcccagctactacctgagcaccaacctgcccctgacccagaagctggaggacaatgaaaaccaggtggtgcaccccagcgtgcggggcaaccagtggaggacaggcccctggggcagctgcagcagcagctgcagcggcggcctgcagcacagagctgtggtgtgccaggatgaaaatggccagagcgccagctactgtgatgctgccagcaagcccccagagctgcagcagtgtggccctggcccctgcccccagtggaactacggcaactggggagaatgttcccagacctgtggcggcggcatcaagagccggctggtgatctgccagttccccaacggccagatcctggaggaccacaactgtgagatcgtgaacaagccacccagcgtcatccagtgccacatgcacgcctgcccagcagatgtgtcctggcaccaggagccctggaccagcgaggacctgaaggtgaagctgctgccccagaggaccatcatcctgtgggagctgatgaagaacatcttctgccacggcaagcacagccacatgtacctgatcaacgtggtgacagaccacctgctgtaccccaggcactgtgaccctgagaccatcgagacctacttcctgagcctgtggagcctgcagttcacctggggagacctgaagtactacaagaacagcctgtag

SEQ ID NO: 142650 - DNA, 5733 bp, Artificial Sequence
  Description of Artificial Sequence: Synthetic coding sequence
atgtgggtggccaagtggctgaccggcctgctgtaccacctgagcctcttcatcaccaggtcctgggaggtggacttccacccccggcaggaggccctggtgaggaccctgaccagctatgaggtggtgattcctgagcgggtgaatgaatttggagaggtgttcccccagagccaccacttcagccggcagaagaggagcagcgaggccctggagcccatgcccttccgcacccactaccgcttcaccgcctacggccagctgttccagctgaacctgacagcagatgccagcttcctggccgccggctacacagaggtgcacctgggcaccccagagcggggggcctgggagagtgatgctggccccagcgacctgcggcactgcttctaccggggccaggtgaacagccaggaggactacaaggctgtggtgtccctgtgtggcggcctgaccggcaccttcaagggccagaatggagagtacttcctggagcccatcatgaaggcagatggaaatgaatatgaagatggccacaacaagccccacctgatctaccggcaggacctgaacaacagcttcctgcagaccctgaagtactgcagcgtgtctgagagccagatcaaggagaccagcctgcccttccacacctacagcaacatgaatgaagacctgaatgtgatgaaggagcgggtgctgggccacaccagcaagaatgtgcccctgaaggatgagcggcggcacagcaggaagaagaggctcatctcctacccccgctacatcgagatcatggtgacagcagatgccaaggtggtgtctgcccacggcagcaacctgcagaactacatcctgaccctgatgagcatcgtggccaccatctacaaggaccccagcatcggcaacctgatccacatcgtggtggtgaagctggtgatgatccaccgggaggaggagggccctgtgatcaactttgatggagccaccaccctgaagaacttctgctcctggcagcagacccagaatgacctggatgatgtgcaccccagccaccacgacacagctgtgctgatcacccgggaggacatctgcagcagcaaggagaagtgcaacatgctgggcctgagctacctgggcaccatctgtgaccccctgcagagctgcttcatcaatgaggagaagggcctcatcagcgccttcaccatcgcccacgagctgggccacaccctgggcgtgcagcatgatgacaacccccgctgcaaggagatgaaggtgaccaagtaccacgtgatggccccagccctgtccttccacatgagcccctggagctggagcaactgcagcaggaaatatgtgacagagttcctggacaccggctatggagaatgtctgctggacaagccagatgaggagatctacaacctgcccagcgagctgcccggcagccgctatgatggcaacaagcagtgtgagctggcctttggacctggcagccagatgtgcccccacatcaacatctgcatgcacctgtggtgcaccagcacagagaagctgcacaagggctgcttcacccagcacgtgcccccagcagatggaacagactgtggccctggcatgcactgccgccacggcctgtgtgtgaacaaggagacagagaccaggcctgtgaatggagagtggggcccctgggagccctacagcagctgcagcaggacctgtggcggcggcatcgagagcgccacccggcgctgcaacagacctgagcccagaaatggaggcaactactgtgtgggccgcaggatgaagttccgcagctgcaacacagacagctgccccaagggcacccaggacttccgggagaagcagtgcagcgacttcaacgggaagcacctggacatcagcggcatccccagcaatgtgcgctggctgccccgctacagcggcatcggcaccaaggaccgctgcaagctgtactgccaggtggccggcaccaactacttctacctgctgaaggacatggtggaggatggcaccccctgtggcacagagacccatgacatctgtgtgcagggccagtgcatggctgctggctgtgaccacgtgctgaacagcagcgccaagattgacaagtgtggggtgtgtggcggggacaacagcagctgcaagaccatcaccggggtcttcaacagcagccactacggctacaacgtggtggtgaagatcccagctggggccaccaacgtggacatccggcagtacagctacagcggccagccagatgacagctacctggccctgagtgatgctgagggcaacttcctgttcaatggaaacttcctgctgagcaccagcaagaaggagatcaacgtgcagggcaccaggacagtcatcgagtacagcggcagcaacaatgctgtggagcgcatcaacagcaccaaccggcaggagaaggagctgatcctgcaggtgctgtgtgtgggcaacctgtacaacccagatgtgcactacagcttcaacatccccctggaggagaggagtgacatgttcacctgggacccctacggcccctgggagggctgcaccaagatgtgccagggcctgcagaggaggaacatcacctgcatccacaagagtgaccacagcgtggtgtctgacaaggaatgtgaccacctgcccctgcccagctttgtgacccagagctgcaacacagactgtgagctgcgctggcacgtgattggcaagtcagaatgtagcagccagtgtggccagggctaccgcaccctggacatccactgcatgaagtacagcatccacgagggccagacagtgcaggtggatgaccactactgtggggaccagctgaagccacccacccaggagctgtgccacggcaactgtgtgttcacccgctggcactacagcgagtggagccagtgcagccgcagctgtggcggcggggagaggagccgggagagctactgcatgaacaactttggccaccggctggccgacaatgaatgccaggagctgagccgggtgacccgggagaactgcaatgagttcagctgccccagctgggccgccagcgagtggagcgagtgcctggtgacctgtgggaagggcaccaagcagaggcaggtgtggtgccagctgaatgtggaccacctgagtgatggcttctgcaacagcagcaccaagccagagagcctgagcccctgtgagctgcacacctgtgcctcctggcaggtgggcccctggggcccctgcaccaccacctgtggccacggctaccagatgagagatgtgaagtgtgtgaatgagctggccagcgctgtgctggaggacacagagtgccacgaggccagccggcccagcgaccggcagagctgtgtgctgaccccctgcagcttcatcagcaagctggagacagccctgctgcccaccgtgctgatcaagaagatggcccagtggaggcatggctcctggaccccctgcagcgtgtcctgtggccggggcacccaggcccgctacgtgtcctgcagagatgccctggacagaattgctgatgagagctactgtgcccacctgcccaggcctgctgagatctgggactgcttcaccccctgtggggagtggcaggccggggactggagcccctgcagcgccagctgtggccacggcaagaccacccggcaggtgctgtgcatgaactaccaccagcccattgatgagaactactgtgaccctgaggtgcggcccctgatggagcaggagtgcagcctggccgcctgccccccagcccacagccacttccccagcagccctgtgcagcccagctactacctgagcaccaacctgcccctgacccagaagctggaggacaatgaaaaccaggtggtgcaccccagcgtgcggggcaaccagtggaggacaggcccctggggcagctgcagcagcagctgcagcggcggcctgcagcacagagctgtggtgtgccaggatgaaaatggccagagcgccagctactgtgatgctgccagcaagcccccagagctgcagcagtgtggccctggcccctgcccccagtggaactacggcaactggggagaatgttcccagacctgtggcggcggcatcaagagccggctggtgatctgccagttccccaacggccagatcctggaggaccacaactgtgagatcgtgaacaagccacccagcgtcatccagtgccacatgcacgcctgcccagcagatgtgtcctggcaccaggagccctggaccagctgcagcgccagctgtgggaaaggaaggaagtaccgggaggtgttctgcatcgaccagttccagaggaagctggaggacaccaactgcagccaggtgcagaagccacccacccacaaggcctgccgctctgtgcgctgccccagctggaaggccaacagctggaatgaatgttctgtgacctgtggcagcggcgtgcagcagagagatgtgtactgccgcctgaagggcgtgggccaggtggtggaggagatgtgtgaccagagcacccggccctgcagccagaggcgctgctggagccaggactgtgtgcagcacaagggcatggagcggggccgcctgaactgcagcaccagctgtgagaggaaggacagccaccagaggatggagtgcacagacaaccagatccggcaggtgaatgaaattgtgtacaacagcagcaccatcagcctgaccagcaagaactgcaggaaccccccctgcaactacatcgtggtgacagctgacagcagccagtgtgccaacaactgtggcttctcctaccggcagaggatcacctactgcacagagatccccagcaccaagaagcacaagctgcaccggctgcggcccatcgtgtaccaggagtgccctgtggtgcccagcagccaggtgtaccagtgcatcaacagctgcctgcacctggccacctggaaggtgggcaagtggagcaaatgttctgtgacctgtggcatcggcatcatgaagaggcaggtgaagtgcatcaccaagcacggcctgagcagtgacctgtgcctgaaccacctgaagccaggggcccagaagaagtgctacgccaatgactgcaagagcttcaccacctgcaaggagatccaggtgaagaaccacatcaggaaggatggagactactacctgaacatcaagggccgcatcatcaagatctactgtgccgacatgtacctggagaaccccaaggagtacctgaccctggtgcagggcgaggagaacttcagcgaggtgtatggcttccggctgaagaacccctaccagtgccccttcaacggcagccggcgggaggactgtgaatgtgacaatggccacctggccgccggctacaccgtcttcagcaagatcagaattgacctgacctccatgcagatcaagaccacagacctgctcttcagcaagaccatctttggaaatgctgtgccctttgccacagctggggactgctacagcgccttccgctgcccccagggccagttcagcatcaacctgagcggcaccggcatgaagatcagcagcacagccaagtggctgacccagggcagctacacctctgtgtccatccgccgctcagaagatggcacccgcttctttggaaaatgtggcggctactgtgggaagtgcctgccccacatgaccaccggcctgcccatccaggtgatctag

SEQ ID NO: 142651 - DNA, 1869 bp, Artificial Sequence
  Description of Artificial Sequence: Synthetic coding sequence
atgttcacctgggacccctacggcccctgggagggctgcaccaagatgtgccagggcctgcagaggaggaacatcacctgcatccacaagagtgaccacagcgtggtgtctgacaaggaatgtgaccacctgcccctgcccagctttgtgacccagagctgcaacacagactgtgagctgcgctggcacgtgattggcaagtcagaatgtagcagccagtgtggccagggctaccgcaccctggacatccactgcatgaagtacagcatccacgagggccagacagtgcaggtggatgaccactactgtggggaccagctgaagccacccacccaggagctgtgccacggcaactgtgtgttcacccgctggcactacagcgagtggagccagtgcagccgcagctgtggcggcggggagaggagccgggagagctactgcatgaacaactttggccaccggctggccgacaatgaatgccaggagctgagccgggtgacccgggagaactgcaatgagttcagctgccccagctgggccgccagcgagtggagcgagtgcctggtgacctgtgggaagggcaccaagcagaggcaggtgtggtgccagctgaatgtggaccacctgagtgatggcttctgcaacagcagcaccaagccagagagcctgagcccctgtgagctgcacacctgtgcctcctggcaggtgggcccctggggcccctgcaccaccacctgtggccacggctaccagatgagagatgtgaagtgtgtgaatgagctggccagcgctgtgctggaggacacagagtgccacgaggccagccggcccagcgaccggcagtgcagcgtgtcctgtggccggggcacccaggcccgctacgtgtcctgcagagatgccctggacagaattgctgatgagagctactgtgcccacctgcccaggcctgctgagatctgggactgcttcaccccctgtggggagtggcaggccggggactggagcccctgcagcgccagctgtggccacggcaagaccacccggcaggtgctgtgcatgaactaccaccagcccattgatgagaactactgtgaccctgaggtgcggcccctgatggagcaggagtgcagcctggccgcctgccccccagcccacagccacttccccagcagccctgtgcagcccagctactacctgagcaccaacctgcccctgacccagaagctggaggacaatgaaaaccaggtggtgcaccccagcgtgcggggcaaccagtggaggacaggcccctggggcagctgcagcagcagctgcagcggcggcctgcagcacagagctgtggtgtgccaggatgaaaatggccagagcgccagctactgtgatgctgccagcaagcccccagagctgcagcagtgtggccctggcccctgcccccagtggaactacggcaactggggagaatgttcccagacctgtggcggcggcatcaagagccggctggtgatctgccagttccccaacggccagatcctggaggaccacaactgtgagatcgtgaacaagccacccagcgtcatccagtgccacatgcacgcctgcccagcagatgtgtcctggcaccaggagccctggaccagcgaggacctgaaggtgaagctgctgccccagaggaccatcatcctgtgggagctgatgaagaacatcttctgccacggcaagcacagccacatgtacctgatcaacgtggtgacagaccacctgctgtaccccaggcactgtgaccctgagaccatcgagacctacttcctgagcctgtggagcctgcagttcacctggggagacctgaagtactacaagaacagcctgtag

SEQ ID NO: 142652 - DNA, 4515 bp, Artificial Sequence
  Description of Artificial Sequence: Synthetic coding sequence
atgtgggtggccaagtggctgaccggcctgctgtaccacctgagcctcttcatcaccaggtcctgggaggtggacttccacccccggcaggaggccctggtgaggaccctgaccagctatgaggtggtgattcctgagcgggtgaatgaatttggagaggtgttcccccagagccaccacttcagccggcagaagaggagcagcgaggccctggagcccatgcccttccgcacccactaccgcttcaccgcctacggccagctgttccagctgaacctgacagcagatgccagcttcctggccgccggctacacagaggtgcacctgggcaccccagagcggggggcctgggagagtgatgctggccccagcgacctgcggcactgcttctaccggggccaggtgaacagccaggaggactacaaggctgtggtgtccctgtgtggcggcctgaccggcaccttcaagggccagaatggagagtacttcctggagcccatcatgaaggcagatggaaatgaatatgaagatggccacaacaagccccacctgatctaccggcaggacctgaacaacagcttcctgcagaccctgaagtactgcagcgtgtctgagagccagatcaaggagaccagcctgcccttccacacctacagcaacatgaatgaagacctgaatgtgatgaaggagcgggtgctgggccacaccagcaagaatgtgcccctgaaggatgagcggcggcacagcaggaagaagaggctcatctcctacccccgctacatcgagatcatggtgacagcagatgccaaggtggtgtctgcccacggcagcaacctgcagaactacatcctgaccctgatgagcatcgtggccaccatctacaaggaccccagcatcggcaacctgatccacatcgtggtggtgaagctggtgatgatccaccgggaggaggagggccctgtgatcaactttgatggagccaccaccctgaagaacttctgctcctggcagcagacccagaatgacctggatgatgtgcaccccagccaccacgacacagctgtgctgatcacccgggaggacatctgcagcagcaaggagaagtgcaacatgctgggcctgagctacctgggcaccatctgtgaccccctgcagagctgcttcatcaatgaggagaagggcctcatcagcgccttcaccatcgcccacgagctgggccacaccctgggcgtgcagcatgatgacaacccccgctgcaaggagatgaaggtgaccaagtaccacgtgatggccccagccctgtccttccacatgagcccctggagctggagcaactgcagcaggaaatatgtgacagagttcctggacaccggctatggagaatgtctgctggacaagccagatgaggagatctacaacctgcccagcgagctgcccggcagccgctatgatggcaacaagcagtgtgagctggcctttggacctggcagccagatgtgcccccacatcaacatctgcatgcacctgtggtgcaccagcacagagaagctgcacaagggctgcttcacccagcacgtgcccccagcagatggaacagactgtggccctggcatgcactgccgccacggcctgtgtgtgaacaaggagacagagaccaggcctgtgaatggagagtggggcccctgggagccctacagcagctgcagcaggacctgtggcggcggcatcgagagcgccacccggcgctgcaacagacctgagcccagaaatggaggcaactactgtgtgggccgcaggatgaagttccgcagctgcaacacagacagctgccccaagggcacccaggacttccgggagaagcagtgcagcgacttcaacgggaagcacctggacatcagcggcatccccagcaatgtgcgctggctgccccgctacagcggcatcggcaccaaggaccgctgcaagctgtactgccaggtggccggcaccaactacttctacctgctgaaggacatggtggaggatggcaccccctgtggcacagagacccatgacatctgtgtgcagggccagtgcatggctgctggctgtgaccacgtgctgaacagcagcgccaagattgacaagtgtggggtgtgtggcggggacaacagcagctgcaagaccatcaccggggtcttcaacagcagccactacggctacaacgtggtggtgaagatcccagctggggccaccaacgtggacatccggcagtacagctacagcggccagccagatgacagctacctggccctgagtgatgctgagggcaacttcctgttcaatggaaacttcctgctgagcaccagcaagaaggagatcaacgtgcagggcaccaggacagtcatcgagtacagcggcagcaacaatgctgtggagcgcatcaacagcaccaaccggcaggagaaggagctgatcctgcaggtgctgtgtgtgggcaacctgtacaacccagatgtgcactacagcttcaacatccccctggaggagaggagtgacatgttcacctgggacccctacggcccctgggagggctgcaccaagatgtgccagggcctgcagaggaggaacatcacctgcatccacaagagtgaccacagcgtggtgtctgacaaggaatgtgaccacctgcccctgcccagctttgtgacccagagctgcaacacagactgtgagctgcgctggcacgtgattggcaagtcagaatgtagcagccagtgtggccagggctaccgcaccctggacatccactgcatgaagtacagcatccacgagggccagacagtgcaggtggatgaccactactgtggggaccagctgaagccacccacccaggagctgtgccacggcaactgtgtgttcacccgctggcactacagcgagtggagccagtgcagccgcagctgtggcggcggggagaggagccgggagagctactgcatgaacaactttggccaccggctggccgacaatgaatgccaggagctgagccgggtgacccgggagaactgcaatgagttcagctgccccagctgggccgccagcgagtggagcgagtgcctggtgacctgtgggaagggcaccaagcagaggcaggtgtggtgccagctgaatgtggaccacctgagtgatggcttctgcaacagcagcaccaagccagagagcctgagcccctgtgagctgcacacctgtgcctcctggcaggtgggcccctggggcccctgcaccaccacctgtggccacggctaccagatgagagatgtgaagtgtgtgaatgagctggccagcgctgtgctggaggacacagagtgccacgaggccagccggcccagcgaccggcagagctgtgtgctgaccccctgcagcttcatcagcaagctggagacagccctgctgcccaccgtgctgatcaagaagatggcccagtggaggcatggctcctggaccccctgcagcgtgtcctgtggccggggcacccaggcccgctacgtgtcctgcagagatgccctggacagaattgctgatgagagctactgtgcccacctgcccaggcctgctgagatctgggactgcttcaccccctgtggggagtggcaggccggggactggagcccctgcagcgccagctgtggccacggcaagaccacccggcaggtgctgtgcatgaactaccaccagcccattgatgagaactactgtgaccctgaggtgcggcccctgatggagcaggagtgcagcctggccgcctgccccccagcccacagccacttccccagcagccctgtgcagcccagctactacctgagcaccaacctgcccctgacccagaagctggaggacaatgaaaaccaggtggtgcaccccagcgtgcggggcaaccagtggaggacaggcccctggggcagctgcagcagcagctgcagcggcggcctgcagcacagagctgtggtgtgccaggatgaaaatggccagagcgccagctactgtgatgctgccagcaagcccccagagctgcagcagtgtggccctggcccctgcccccagtggaactacggcaactggggagaatgttcccagacctgtggcggcggcatcaagagccggctggtgatctgccagttccccaacggccagatcctggaggaccacaactgtgagatcgtgaacaagccacccagcgtcatccagtgccacatgcacgcctgcccagcagatgtgtcctggcaccaggagccctggaccagcgaggacctgaaggtgaagctgctgccccagaggaccatcatcctgtgggagctgatgaagaacatcttctgccacggcaagcacagccacatgtacctgatcaacgtggtgacagaccacctgctgtaccccaggcactgtgaccctgagaccatcgagacctacttcctgagcctgtggagcctgcagttcacctggggagacctgaagtactacaagaacagcctgtag

SEQ ID NO: 142653 - DNA, 3618 bp, Artificial Sequence
  Description of Artificial Sequence: Synthetic coding sequence
atggtgctgctgagcctgtggctgattgctgctgccctggtggaggtgaggaccagcgcagatggccaggccggaaatgaggagatggtgcagattgacctgcccatcaagcgctaccgggagtatgagctggtgacccctgtgtccaccaacctggagggccgctacctgagccacaccctgagcgccagccacaagaagaggtctgccagagatgtgagcagcaaccctgagcagctgttcttcaacatcacagccttcggcaaggacttccacctgcggctgaagcccaacacccagctggtggcccctggagctgtggtggagtggcatgagaccagcctggtgcccggcaacatcacagaccccatcaacaaccaccagcccggcagcgccacctaccgcatcagaagaacagagcccctgcagaccaactgtgcctacgtgggggacatcgtggacatccctggcacctctgtggccatcagcaactgtgatggcctggccggcatgatcaagagtgacaatgaggagtacttcatcgagcccctggagcggggcaagcagatggaggaggagaagggccgcatccacgtggtgtacaagaggtctgctgtggagcaggcccccatcgacatgagcaaggacttccactaccgggagagtgacctggagggcctggatgacctgggcaccgtgtatggcaacatccaccagcagctgaatgagaccatgagaagaagaagacatgctggagaaaatgactacaacatcgaggtgctgctgggcgtggatgattctgtggtgcgcttccacggcaaggagcacgtgcagaactacctgctgaccctgatgaacatcgtgaatgagatctaccatgatgagagcctgggcgtgcacatcaacgtggtgctggtgaggatgatcatgctgggctacgccaagagcatcagcctcatcgagcggggcaaccccagccgcagcctggagaatgtgtgccgctgggccagccagcagcagaggagtgacctgaaccacagcgagcaccacgaccacgccatcttcctgacccggcaggactttggacctgctggcatgcagggctacgcccctgtgacaggcatgtgccaccctgtgcgcagctgcaccctgaaccatgaagatggcttcagcagcgcctttgtggtggcccacgagaccggccacgtgctgggcatggagcatgatggccagggcaacagatgtggagatgaaacagccatgggctctgtgatggcccccctggtgcaggccgccttccaccgctaccactggagccgctgcagcggccaggagctgaagcgctacatccacagctatgactgcctgctggatgacccctttgaccatgactggcccaagctgcctgagctgcccggcatcaactacagcatggatgagcagtgccgctttgattttggagtgggctacaagatgtgcacagccttccgcacctttgacccctgcaagcagctgtggtgcagccacccagacaacccctacttctgcaagaccaagaagggcccccccctggatggaacagaatgtgccgccggcaagtggtgctacaagggccactgcatgtggaagaatgccaaccagcagaagcaggacggcaactggggctcctggaccaagtttggcagctgcagcaggacctgtggcactggagtgcgcttccgcacccggcagtgcaacaaccccatgcccatcaatggaggccaggactgccctggggtgaactttgagtaccagctgtgcaacacagaggagtgccagaagcactttgaggacttccgggcccagcagtgccagcagaggaacagccactttgagtaccagaacaccaagcaccactggctgccctatgagcacccagaccccaagaagcgctgccacctgtactgccagagcaaggagactggagatgtggcctacatgaagcagctggtgcatgatggcacccactgcagctacaaggacccctacagcatctgtgtgagaggagaatgtgtgaaggtgggctgtgacaaggagatcggcagcaacaaggtggaggacaagtgtggggtgtgtggcggggacaacagccactgcaggacagtgaagggcaccttcaccaggacccccaggaagctgggctacctgaagatgtttgacatccccccaggggcccggcacgtgctgatccaggaggatgaggccagcccccacatcctggccatcaagaaccaggccaccggccactacatcctgaatggcaagggggaggaggccaagagcaggaccttcatcgacctgggcgtggagtgggactacaacattgaagatgacatcgagagcctgcacacagatggccccctgcatgaccccgtcatcgtgctgatcatcccccaggagaatgacaccaggagcagcctgacctacaagtacatcatccacgaggacagcgtgcccaccatcaacagcaacaacgtcatccaggaggagctggacacctttgagtgggccctgaagtcctggagccagtgcagcaagccctgtggcggcggcttccagtacaccaagtatggctgcaggaggaagagtgacaacaagatggtgcacaggagcttctgtgaggccaacaagaagcccaagcccatccggaggatgtgcaacatccaggagtgcacccaccccctgtgggtggccgaggagtgggagcactgcaccaagacctgtggcagcagcggctaccagctgaggacagtgcgctgcctgcagcccctgctggatggcaccaacagatctgtgcacagcaagtactgcatgggagacaggcctgagagccggcggccctgcaacagagtgccctgcccagcccagtggaagacaggcccctggagcgaatgttctgtgacctgtggggagggcacagaggtgcggcaggtgctgtgcagagctggggaccactgtgatggagagaagccagagagcgtgcgggcctgccagctgcccccctgcaatgatgagccctgcctgggggacaagagcatcttctgccagatggaggtgctggcccgctactgcagcatccctggctacaacaagctgtgctgtgagagctgcagcaagaggagcagcaccctgcccccaccctacctgctggaggccgctgagacccatgatgatgtgatcagcaaccccagcgacctgcccaggagcctggtgatgcccaccagcctggtgccctaccacagcgagaccccagccaagaagatgagcctgagcagcatcagctctgtgggcggccccaatgcctatgctgccttccggcccaacagcaagccagatggagccaacctgcggcagaggtctgcccagcaggccggcagcaagacagtgcggctggtgacagtgcccagcagcccccccaccaagagggtgcacctgagcagcgccagccagatggccgccgccagcttctttgctgccagtgacagcatcggggccagcagccaggcccggaccagcaagaaggatggcaagatcatcgacaacagaagacccaccaggagcagcaccctggagaggtag

SEQ ID NO: 142654 - DNA, 1020 bp, Artificial Sequence
  Description of Artificial Sequence: Synthetic coding sequence
atgagccagacaggcagccaccctggccggggcctggccggccgctggctgtggggcgcccagccctgcctgctgctgcccatcgtgcccctgtcctggctggtgtggctgctgctgctgctgctggccagcctgctgcccagcgcccggctggccagccccctgccccgggaggaggagatcgtgtttcctgagaagctgaatggatctgtgctgcccggcagcggggccccagcccggctgctgtgccgcctgcaggccttcggggagaccctgctgctggagctggagcaggacagcggcgtgcaggtggagggcctgactgtgcagtacctgggccaggcccctgagctgctgggcggcgctgagcccggcacctacctgaccggcaccatcaatggagaccctgagagcgtggccagcctgcactgggatggaggagccctgctgggcgtgctgcagtacagaggagctgagctgcacctgcagcccctggagggcggcacccccaacagcgctgggggccctggggcccacatcctgcggaggaagagccctgccagcggccagggccccatgtgcaatgtgaaggcccccctgggcagccccagcccccggccccggcgggccaagagatttgccagcctgagcagatttgtggagaccctggtggtggctgatgacaagatggccgccttccacggggccggcctgaagcgctacctgctgactgtgatggctgctgctgccaaggccttcaagcaccccagcatcagaaatcctgtgtccctggtggtgacccggctggtgatcctgggcagcggggaggagggcccccaggtgggccccagcgctgcccagaccctgcgctccttctgtgcctggcagaggggcctgaacaccccagaagattctgaccctgaccactttgacacagccatcctcttcacccggcaggtgcggccccagagcgccccccaggccatgcactgcaccatcctgcggagcgccaccacctag

SEQ ID NO: 142655 - DNA, 2514 bp, Artificial Sequence
  Description of Artificial Sequence: Synthetic coding sequence
atgagccagacaggcagccaccctggccggggcctggccggccgctggctgtggggcgcccagccctgcctgctgctgcccatcgtgcccctgtcctggctggtgtggctgctgctgctgctgctggccagcctgctgcccagcgcccggctggccagccccctgccccgggaggaggagatcgtgtttcctgagaagctgaatggatctgtgctgcccggcagcggggccccagcccggctgctgtgccgcctgcaggccttcggggagaccctgctgctggagctggagcaggacagcggcgtgcaggtggagggcctgactgtgcagtacctgggccaggcccctgagctgctgggcggcgctgagcccggcacctacctgaccggcaccatcaatggagaccctgagagcgtggccagcctgcactgggatggaggagccctgctgggcgtgctgcagtacagaggagctgagctgcacctgcagcccctggagggcggcacccccaacagcgctgggggccctggggcccacatcctgcggaggaagagccctgccagcggccagggccccatgtgcaatgtgaaggcccccctgggcagccccagcccccggccccggcgggccaagagatttgccagcctgagcagatttgtggagaccctggtggtggctgatgacaagatggccgccttccacggggccggcctgaagcgctacctgctgactgtgatggctgctgctgccaaggccttcaagcaccccagcatcagaaatcctgtgtccctggtggtgacccggctggtgatcctgggcagcggggaggagggcccccaggtgggccccagcgctgcccagaccctgcgctccttctgtgcctggcagaggggcctgaacaccccagaagattctgaccctgaccactttgacacagccatcctcttcacccggcaggacctgtgtggggtgtccacctgtgacaccctgggcatggctgatgtgggcaccgtgtgtgaccctgcccggagctgtgccatcgtggaggatgatggcctgcagagcgccttcaccgctgcccacgagctgggccacgtgttcaacatgctgcatgacaacagcaagccctgcatcagcctgaatggccccctgagcaccagcagacatgtgatggcccctgtgatggcccacgtggaccctgaggagccctggagcccctgcagcgcccgcttcatcacagacttcctggacaatggctacggccactgcctgctggacaagccagaggcccccctgcacctgcctgtgaccttccctgggaaggactatgatgctgaccggcagtgccagctgacctttggaccagacagccgccactgcccccagctgcccccaccctgtgccgccctgtggtgcagcggccacctgaatggacatgccatgtgccagaccaagcacagcccctgggcagatggcaccccctgtggccctgcccaggcctgcatgggcggccgctgcctgcacatggaccagctgcaggacttcaacatcccccaggccggcggctggggcccctggggcccctggggagactgcagcaggacctgtggcggcggcgtgcagttcagcagccgggactgcaccaggcctgtgcccagaaatggaggcaagtactgtgagggccgccgcacccgcttccgcagctgcaacacagaggactgccccaccggcagcgccctgaccttccgggaggagcagtgtgccgcctacaaccacaggacagacctcttcaagagcttccctggccccatggactgggtgccccgctacacaggagtggccccccaggaccagtgcaagctgacctgccaggcccaggccctgggctactactacgtgctggagccccgggtggtggatggcaccccctgcagcccagacagcagctctgtgtgtgtgcagggccgctgcatccacgccggctgtgaccgcatcatcggcagcaagaagaagtttgacaagtgcatggtgtgtggaggagatggcagcggctgcagcaagcagagcggcagcttcaggaagttccgctatggctacaacaacgtggtgaccatcccagctggggccacccacatcctggtgcggcagcagggcaaccctggccacaggagcatctacctggccctgaagctgcctgatggcagctatgccctgaatggagagtacaccctgatgcccagccccacagatgtggtgctgcccggggctgtgtccctgcgctacagcggggccacagctgccagcgagaccctgagcggccacggccccctggcccagcccctgaccctgcaggtgctggtggccggcaacccccaggacacccggctgcgctacagcttctttgtgccccggcccacccccagcaccccccggcccaccccccaggactggctgcaccggcgggcccagatcctggagatcctgcggcggcggccctgggccggcaggaagtag

SEQ ID NO: 142656 - DNA, 2793 bp, Artificial Sequence
  Description of Artificial Sequence: Synthetic coding sequence
atgctgctgggctgggccagcctgctgctgtgtgccttccggctgcccctggccgctgtgggccctgctgccaccccagcccaggacaaggccggccagcccccaacagctgctgctgctgcccagccccggcggcggcagggcgaggaggtgcaggagagagctgagcccccaggccacccccaccccctggcccagaggcggcgcagcaagggcctggtgcagaacatcgaccagctgtacagcggcggcggcaaggtgggctacctggtgtatgccggcggccgccgcttcctgctggacctggagagagatggctctgtgggcattgctggctttgtgcctgctgggggcggcaccagcgccccctggaggcacaggagccactgcttctaccggggcaccgtggatggcagccccaggagcctggccgtgtttgacctgtgtggcggcctggatggcttctttgctgtgaagcacgcccgctacaccctgaagcccctgctgcggggcccctgggccgaggaggagaagggccgggtgtatggagatggcagcgcccgcatcctgcacgtgtacacccgggagggcttctcctttgaggccctgcccccccgggccagctgtgagaccccagccagcaccccagaggcccatgaacatgccccagcccacagcaaccccagcggccgggccgccctggccagccagctgctggaccagagcgccctgagccctgctgggggcagcggcccccagacctggtggaggagaagaagaagaagcatcagccgggcccggcaggtggagctgctgctggtggctgatgcctccatggcccggctgtatggccggggcctgcagcactacctgctgaccctggccagcatcgccaacagactctacagccacgccagcattgagaaccacatccggctggccgtggtgaaggtggtggtgctgggggacaaggacaagagcctggaggtgtccaagaatgctgccaccaccctgaagaacttctgcaagtggcagcaccagcacaaccagctgggagatgaccacgaggagcactatgatgctgccatcctcttcacccgggaggacctgtgtggccaccacagctgtgacaccctgggcatggctgatgtgggcaccatctgcagccctgagaggagctgtgctgtgattgaagatgatggcctgcacgccgccttcaccgtggcccacgagatcggccacctgctgggcctgagccatgatgacagcaagttctgtgaggagaccttcggcagcacagaggacaagaggctgatgagcagcatcctgaccagcattgatgccagcaagccctggagcaagtgcaccagcgccaccatcacagagttcctggatgatggccacggcaactgcctgctggacctgcccaggaagcagatcctgggccctgaggagctgcccggccagacctatgatgccacccagcagtgcaacctgacctttggacctgagtacagcgtgtgccccggcatggatgtgtgtgcccggctgtggtgtgctgtggtgcggcagggccagatggtgtgcctgaccaagaagctgcctgctgtggagggcaccccctgtgggaagggccgcatctgcctgcagggcaaatgtgtggacaagaccaagaagaagtactacagcaccagcagccacggcaactggggctcctggggctcctggggccagtgcagccgcagctgtggcggcggcgtgcagtttgcctaccgccactgcaacaacccagcccccaggaacaacggccgctactgcaccgggaagagggccatctaccgcagctgcagcctgatgccctgcccccccaacgggaagagcttcagacatgagcagtgtgaggccaagaatggctaccagagtgatgccaagggcgtgaagacctttgtggagtgggtgcccaagtatgccggcgtgctgcctgcagatgtgtgcaagctgacctgccgggccaagggcaccggctactacgtggtgttcagccccaaggtgacagatggaacagaatgtcggctgtacagcaacagcgtgtgtgtgcggggcaaatgtgtgaggacaggctgtgatggcatcatcggcagcaagctgcagtatgacaagtgtggggtgtgtggcggggacaacagcagctgcaccaagatcgtgggcaccttcaacaagaagagcaagggctacacagatgtggtgcgcatccctgagggcgccacccacatcaaggtgcggcagttcaaggccaaggaccagacccgcttcaccgcctacctggccctgaagaagaagaatggagagtacctgatcaatggcaagtacatgatcagcaccagcgagaccatcatcgacatcaatggcaccgtgatgaactacagcggctggagccacagagatgacttcctgcacggcatgggctacagcgccaccaaggagatcctgattgtgcagatcctggccacagaccccaccaagcccctggatgtgcgctacagcttctttgtgcccaagaagagcacccccaaggtgaacagcgtgaccagccacggcagcaacaaggtgggcagccacaccagccagccccagtgggtgacaggcccctggctggcctgcagcaggacctgtgacaccggctggcacaccaggacagtgcagtgccaggacggcaacaggaagctggccaagggctgccccctgagccagaggcccagcgccttcaagcagtgcctgctgaagaagtgctag

SEQ ID NO: 142657 - DNA, 2577 bp, Artificial Sequence
  Description of Artificial Sequence: Synthetic coding sequence
atggagatcctgtggaagaccctgacctggatcctgagcctcatcatggccagcagcgagttccacagcgaccaccggctgagctacagcagccaggaggagttcctgacctacctggagcactaccagctgaccatccccatccgggtggaccagaatggagccttcctgtccttcaccgtgaagaatgacaagcacagcagaagaagaagatccatggaccccatcgacccccagcaggccgtgtccaagctgttcttcaagctgagcgcctacggcaagcacttccacctgaacctgaccctgaacacagactttgtgtccaagcacttcaccgtggagtactggggcaaggatggcccccagtggaagcatgacttcctggacaactgccactacacaggctacctgcaggaccagaggagcaccaccaaggtggccctgagcaactgtgtgggcctgcatggagtcatcgccacagaagatgaggagtacttcatcgagcccctgaagaacaccacagaggacagcaagcacttctcctatgaaaatggccacccccacgtgatctacaagaagagcgccctgcagcagaggcacctgtatgaccacagccactgcggcgtgtctgacttcaccaggtctgggaagccctggtggctgaatgacaccagcacagtgtcctacagcctgcccatcaacaacacccacatccaccaccggcagaagaggtctgtgtccattgaaagatttgtggagaccctggtggtggccgacaagatgatggtgggctaccacggcaggaaggacatcgagcactacatcctgtctgtgatgaacatcgtggccaagctgtacagagacagcagcctgggcaatgtggtgaacatcatcgtggcccggctgattgtgctgacagaggaccagcccaacctggagatcaaccaccacgccgacaagagcctggacagcttctgcaagtggcagaagagcatcctgagccaccagagtgatggcaacaccatcccagaaaatggaattgcccaccacgacaatgctgtgctgatcaccaggtatgacatctgcacctacaagaacaagccctgtggcaccctgggcctggcctctgtggccggcatgtgtgagcctgagaggagctgcagcatcaatgaagatattggcctgggcagcgccttcaccatcgcccatgaaattggccacaactttggcatgaaccatgatggcatcggcaacagctgcaggaaggtgatgaagcagcagtatggcagcagccactactgtgagtaccagagcttcttcctggtgtgcctgcagagccggctgcaccaccagctgagccgggaggtgtgccgggagctgtggtgcctgagcaagagcaacagatgtgtgaccaacagcatcccagctgctgagggcaccctgtgccagacaggcaacatcgagaagggctggtgctaccagggcgactgtgtgcccttcggcacctggccccagagcattgatggcggctggggcccctggagcctgtggggagaatgttccaggacctgtggcggcggcgtgagcagcagcctgcggcactgtgacagccctgcccccagcggcggcggcaagtactgcctgggggagaggaagcgctaccgcagctgcaacacagacccctgccccctgggcagccgggacttccgggagaagcagtgtgccgactttgacaacatgcccttccggggcaagtactacaactggaagccctacacaggaggcggcgtgaagccctgtgccctgaactgcctggccgagggctacaacttctacacagagcgggccccagctgtgattgatggcacccagtgcaatgctgacagcctggacatctgcatcaatggagagtgcaagcacgtgggctgtgacaacatcctgggcagtgatgccagagaagatcgctgccgggtgtgtggaggagatggcagcacctgtgatgccatcgagggcttcttcaatgacagcctgccccggggcggctacatggaggtggtgcagatcccccggggctctgtgcacatcgaggtgcgggaggtggccatgagcaagaactacatcgccctgaagtcagaaggagatgactactacatcaatggagcctggaccatcgactggcccaggaagtttgatgtggccggcacagccttccactacaagaggcccacagatgagcctgagagcctggaggccctgggccccaccagtgaaaatctcatcgtgatggtgctgctgcaggagcagaacctgggcatccgctacaagttcaacgtgcccatcaccaggactggaagtggggacaatgaggtgggcttcacctggaaccaccagccctggagcgaatgttctgccacctgtgccggcggcaagatgcccacccggcagcccacccagagggcccgctggaggaccaagcacatcctgtcctatgccctgtgcctgctgaagaagctgattggcaacatcagctgccgctttgccagcagctgcaacctggccaaggagaccctgctgtag

SEQ ID NO: 142658 - DNA, 3354 bp, Artificial Sequence
  Description of Artificial Sequence: Synthetic coding sequence
atggagatcctgtggaagaccctgacctggatcctgagcctcatcatggccagcagcgagttccacagcgaccaccggctgagctacagcagccaggaggagttcctgacctacctggagcactaccagctgaccatccccatccgggtggaccagaatggagccttcctgtccttcaccgtgaagaatgacaagcacagcagaagaagaagatccatggaccccatcgacccccagcaggccgtgtccaagctgttcttcaagctgagcgcctacggcaagcacttccacctgaacctgaccctgaacacagactttgtgtccaagcacttcaccgtggagtactggggcaaggatggcccccagtggaagcatgacttcctggacaactgccactacacaggctacctgcaggaccagaggagcaccaccaaggtggccctgagcaactgtgtgggcctgcatggagtcatcgccacagaagatgaggagtacttcatcgagcccctgaagaacaccacagaggacagcaagcacttctcctatgaaaatggccacccccacgtgatctacaagaagagcgccctgcagcagaggcacctgtatgaccacagccactgcggcgtgtctgacttcaccaggtctgggaagccctggtggctgaatgacaccagcacagtgtcctacagcctgcccatcaacaacacccacatccaccaccggcagaagaggtctgtgtccattgaaagatttgtggagaccctggtggtggccgacaagatgatggtgggctaccacggcaggaaggacatcgagcactacatcctgtctgtgatgaacatcgtggccaagctgtacagagacagcagcctgggcaatgtggtgaacatcatcgtggcccggctgattgtgctgacagaggaccagcccaacctggagatcaaccaccacgccgacaagagcctggacagcttctgcaagtggcagaagagcatcctgagccaccagagtgatggcaacaccatcccagaaaatggaattgcccaccacgacaatgctgtgctgatcaccaggtatgacatctgcacctacaagaacaagccctgtggcaccctgggcctggcctctgtggccggcatgtgtgagcctgagaggagctgcagcatcaatgaagatattggcctgggcagcgccttcaccatcgcccatgaaattggccacaactttggcatgaaccatgatggcatcggcaacagctgtggcaccaagggccatgaagctgccaagctgatggccgcccacatcacagccaacaccaaccccttctcctggagcgcctgcagccgggactacatcaccagcttcctggacagcggccggggcacctgcctggacaatgagccccccaagagggacttcctgtacccagctgtggcccctggccaggtgtatgatgctgatgagcagtgccgcttccagtacggggccaccagccggcagtgcaagtatggagaggtgtgccgggagctgtggtgcctgagcaagagcaacagatgtgtgaccaacagcatcccagctgctgagggcaccctgtgccagacaggcaacatcgagaagggctggtgctaccagggcgactgtgtgcccttcggcacctggccccagagcattgatggcggctggggcccctggagcctgtggggagaatgttccaggacctgtggcggcggcgtgagcagcagcctgcggcactgtgacagccctgcccccagcggcggcggcaagtactgcctgggggagaggaagcgctaccgcagctgcaacacagacccctgccccctgggcagccgggacttccgggagaagcagtgtgccgactttgacaacatgcccttccggggcaagtactacaactggaagccctacacaggaggcggcgtgaagccctgtgccctgaactgcctggccgagggctacaacttctacacagagcgggccccagctgtgattgatggcacccagtgcaatgctgacagcctggacatctgcatcaatggagagtgcaagcacgtgggctgtgacaacatcctgggcagtgatgccagagaagatcgctgccgggtgtgtggaggagatggcagcacctgtgatgccatcgagggcttcttcaatgacagcctgccccggggcggctacatggaggtggtgcagatcccccggggctctgtgcacatcgaggtgcgggaggtggccatgagcaagaactacatcgccctgaagtcagaaggagatgactactacatcaatggagcctggaccatcgactggcccaggaagtttgatgtggccggcacagccttccactacaagaggcccacagatgagcctgagagcctggaggccctgggccccaccagtgaaaatctcatcgtgatggtgctgctgcaggagcagaacctgggcatccgctacaagttcaacgtgcccatcaccaggactggaagtggggacaatgaggtgggcttcacctggaaccaccagccctggagcgaatgttctgccacctgtgccggcggcgtgcagaggcaggaggtggtgtgcaagaggctggatgacaacagcatcgtgcagaacaactactgtgaccctgacagcaagcccccagagaaccagagggcctgcaacacagagccctgccccccagagtggttcatcggggactggctggagtgcagcaagacctgtgatggcggcatgaggaccagggctgtgctgtgcatcaggaagattggccccagcgaggaggagaccctggactacagcggctgcctgacccacaggcctgtggagaaggagccctgcaacaaccagagctgccccccccagtgggtggccctggactggagcgagtgcacccccaagtgtggccctggcttcaagcacagaattgtgctgtgcaagagcagtgacctgagcaagaccttccctgctgcccagtgcccagaggagagcaagccccctgtgcgcatccgctgcagcctgggccgctgccccccaccccgctgggtgactggagactggggccagtgcagcgcccagtgtggcctgggccagcagatgaggacagtgcagtgcctgagctacacaggccaggccagcagtgactgcctggagaccgtgcggccccccagcatgcagcagtgtgagagcaaatgtgacagcacccccatcagcaacacagaggagtgcaaggatgtgaacaaggtggcctactgccccctggtgctgaagttcaagttctgcagccgggcctacttccggcagatgtgctgcaagacctgccagggccactag

SEQ ID NO: 142659 - DNA, 1407 bp, Artificial Sequence
  Description of Artificial Sequence: Synthetic coding sequence
atggagatcctgtggaagaccctgacctggatcctgagcctcatcatggccagcagcgagttccacagcgaccaccggctgagctacagcagccaggaggagttcctgacctacctggagcactaccagctgaccatccccatccgggtggaccagaatggagccttcctgtccttcaccgtgaagaatgacaagcacagcagaagaagaagatccatggaccccatcgacccccagcaggccgtgtccaagctgttcttcaagctgagcgcctacggcaagcacttccacctgaacctgaccctgaacacagactttgtgtccaagcacttcaccgtggagtactggggcaaggatggcccccagtggaagcatgacttcctggacaactgccactacacaggctacctgcaggaccagaggagcaccaccaaggtggccctgagcaactgtgtgggcctgcatggagtcatcgccacagaagatgaggagtacttcatcgagcccctgaagaacaccacagaggacagcaagcacttctcctatgaaaatggccacccccacgtgatctacaagaagagcgccctgcagcagaggcacctgtatgaccacagccactgcggcgtgtctgacttcaccaggtctgggaagccctggtggctgaatgacaccagcacagtgtcctacagcctgcccatcaacaacacccacatccaccaccggcagaagaggtctgtgtccattgaaagatttgtggagaccctggtggtggccgacaagatgatggtgggctaccacggcaggaaggacatcgagcactacatcctgtctgtgatgaacatcgtggccaagctgtacagagacagcagcctgggcaatgtggtgaacatcatcgtggcccggctgattgtgctgacagaggaccagcccaacctggagatcaaccaccacgccgacaagagcctggacagcttctgcaagtggcagaagagcatcctgagccaccagagtgatggcaacaccatcccagaaaatggaattgcccaccacgacaatgctgtgctgatcaccaggtatgacatctgcacctacaagaacaagccctgtggcaccctgggcctggcctctgtggccggcatgtgtgagcctgagaggagctgcagcatcaatgaagatattggcctgggcagcgccttcaccatcgcccatgaaattggccacaactttggcatgaaccatgatggcatcggcaacagctgtggcaccaagggccatgaagctgccaagctgatggccgcccacatcacagccaacaccaaccccttctcctggagcgcctgcagccgggactacatcaccagcttcctggagttcctgaagctgggggacagcatcagcggcagctag

SEQ ID NO: 142660 - DNA, 5061 bp, Artificial Sequence
  Description of Artificial Sequence: Synthetic coding sequence
atgcctgggggccccagccccaggagccctgcccccctgctgcggcccctgctgctgctgctgtgtgccctggcccctggggcccctggccctgcccctggccgggccacagagggccgggccgccctggacatcgtgcaccctgtgcgggtggatgctgggggcagcttcctgtcctatgagctgtggccccgggccctgaggaagagagatgtgtctgtgagaagagatgccccagccttctatgagctgcagtaccggggccgggagctgcgcttcaacctgacagccaaccagcacctgctggcccctggctttgtgtctgagacccggcggcggggcggcctgggccgggcccacatccgggcccacaccccagcctgccacctgctgggggaggtgcaggaccctgagctggagggcggcctggccgccatcagcgcctgtgatggcctgaagggcgtcttccagctgagcaatgaagactacttcatcgagcccctggacagcgccccagcccggcccggccacgcccagccccacgtggtgtacaagaggcaggcccctgagcggctggcccagagaggagacagcagcgcccccagcacctgtggggtgcaggtgtacccagagctggagagcagaagagagcgctgggagcagaggcagcagtggaggcggccccggctgcggcggctgcaccagaggtctgtgtccaaggagaagtgggtggagaccctggtggtggctgatgccaagatggtggagtaccacggccagccccaggtggagagctatgtgctgaccatcatgaacatggtggccggcctcttccatgaccccagcatcggcaaccccatccacatcaccatcgtgcggctggtgctgctggaggatgaggaggaggacctgaagatcacccaccacgccgacaacaccctgaagagcttctgcaagtggcagaagagcatcaacatgaagggagatgcccaccccctgcaccacgacacagccatcctgctgaccaggaaggacctgtgtgccgccatgaaccggccctgtgagaccctgggcctgagccacgtggccggcatgtgccagccccacaggagctgcagcatcaatgaagacaccggcctgcccctggccttcaccgtggcccacgagctgggccacagctttggcatccagcatgatggcagcggaaatgactgtgagcctgtgggcaagaggcccttcatcatgagcccccagctgctgtatgatgctgcccccctgacctggagccgctgcagccggcagtacatcacccgcttcctggaccggggctggggcctgtgcctggatgatcctccagccaaggacatcatcgacttccccagcgtgcccccaggagtgctgtatgatgtgagccaccagtgccgcctgcagtacggggcctacagcgccttctgtgaggacatggacaacgtgtgccacaccctgtggtgcagcgtgggcaccacctgccacagcaagctggatgctgctgtggatggcacccgctgtggggagaacaagtggtgcctgagcggggagtgtgtgcctgtgggcttccggcctgaggccgtggatggcggctggagcggctggagcgcctggagcatctgcagccgcagctgtggcatgggcgtgcagagcgctgagcggcagtgcacccagcccacccccaagtacaagggccgctactgtgtgggggagaggaagcgcttccggctgtgcaacctgcaggcctgcccagctggccggcccagcttcagacatgtgcagtgcagccactttgatgccatgctgtacaagggccagctgcacacctgggtgcctgtggtgaatgatgtgaacccctgtgagctgcactgcaggcctgccaatgagtactttgctgagaagctgagagatgctgtggtggatggcaccccctgctaccaggtgcgggccagccgggacctgtgcatcaatggcatctgcaagaatgtgggctgtgactttgaaattgacagcggggccatggaggacagatgtggggtgtgccacggcaatggcagcacctgccacacagtgtctggcacctttgaggaggccgagggcctgggctacgtggatgtgggcctcatcccagctggggcccgggagatccgcatccaggaggtggccgaggccgccaacttcctggccctgcggtctgaggaccctgagaagtacttcctgaatggaggctggaccatccagtggaatggagactaccaggtggccggcaccaccttcacctacgcccggcggggcaactgggagaacctgaccagccctggccccaccaaggagcctgtgtggatccagctgctcttccaggagagcaaccctggggtgcactatgagtacaccatccaccgggaggccggcggccatgatgaggtgcccccacctgtgttctcctggcactacggcccctggaccaagtgcaccgtgacctgtggccggggcgtgcagaggcagaatgtgtactgcctggagcggcaggccggccctgtggatgaggagcactgtgaccccctgggccgcccagatgaccagcagaggaaatgttctgagcagccctgcccagcccgctggtgggccggggagtggcagctgtgcagcagcagctgtggccctgggggcctgagccggcgggctgtgctgtgcatccgctctgtgggcctggatgagcagagcgccctggagcccccagcctgtgagcacctgccccggcccccaacagagaccccctgcaacagacatgtgccctgcccagccacctgggccgtgggcaactggagccagtgcagcgtgacctgtggggagggcacccagaggagaaatgtgctgtgcaccaatgacacaggagtgccctgtgatgaggcccagcagcctgccagcgaggtgacctgcagcctgcccctgtgccgctggcccctgggcaccctgggccctgagggcagcggcagcggcagcagcagccatgagctgttcaatgaagctgacttcatcccccaccacctggccccccggcccagccctgccagcagccccaagccaggcaccatgggaaatgccatcgaggaggaggcccctgagctggacctgcccggccctgtgtttgtggatgacttctactatgactacaacttcatcaacttccacgaggacctgtcctatggccccagcgaggagccagacctggacctggccggcactggagacaggaccccaccaccccacagccaccctgctgcccccagcacaggcagccctgtgcctgccacagagcccccagctgccaaggaggagggcgtgctgggcccctggagccccagcccctggcccagccaggccggccgcagccccccacctccttctgagcagaccccaggcaaccccctcatcaacttcctgcctgaggaggacacccccatcggggccccagacctgggcctgcccagcctgtcctggccccgggtgtccacagatggcctgcagaccccagccaccccagagagccagaatgacttccctgtgggcaaggacagccagagccagctgcccccaccctggagggacaggaccaatgaggtgttcaaggatgatgaggagcccaagggccgcggggccccccacctgcccccccggcccagcagcaccctgccccccctgagccctgtgggcagcacccacagcagccccagcccagatgtggccgagctgtggacaggaggcaccgtggcctgggagcccgccctggagggcggcctgggccctgtggacagcgagctgtggcccaccgtgggcgtggccagcctgctgcccccacccatcgcccccctgcctgagatgaaggtgcgggacagcagcctggagcccggcacccccagcttccccaccccaggccctggctcctgggacctgcagacagtggccgtgtggggcaccttcctgcccaccaccctgaccggcctgggccacatgcctgagcccgccctgaaccctggccccaagggccagcctgagagcctgagccctgaggtgcccctgagcagccggctgctgagcaccccagcctgggacagccctgccaacagccaccgggtgcctgagacccagcccctggcccccagcctggccgaggccggccccccagctgaccccctggtggtgagaaatgccggctggcaggccggcaactggagcgagtgcagcaccacctgtggcctgggcgctgtgtggaggcctgtgcgctgcagcagcggcagagatgaggactgtgccccagctggccggccccagcctgcccggcgctgccacctgcggccctgtgccacctggcacagcggcaactggagcaagtgcagccgcagctgtggcggcggcagctctgtgagagatgtgcagtgtgtggacacccgggacctgcggcccctgcggcccttccactgccagcccggccctgccaagcccccagcccaccggccctgtggggcccagccctgcctgtcctggtacaccagctcctggagagaatgttctgaggcctgtggcggcggggagcagcagaggctggtgacctgcccagagcccggcctgtgtgaggaggccctgcggcccaacaccacccggccctgcaacacccacccctgcacccagtgggtggtgggcccctggggccagtgcagcggcccctgtggcggcggcgtgcagaggcggctggtgaagtgtgtgaacacccagacaggcctgcctgaggaggacagcgaccagtgtggccacgaggcctggccagagagcagccggccctgtggcacagaggactgtgagcctgtggagcccccaagatgtgagcgggaccggctgagctttggcttctgtgagaccctgcggctgctgggccgctgccagctgcccaccatccgcacccagtgctgccgcagctgcagcccccccagccatggagcccccagccggggccaccagagggtggcccggaggtag

SEQ ID NO: 142661 - DNA, 1383 bp, Artificial Sequence
  Description of Artificial Sequence: Synthetic coding sequence
atgcctgggggccccagccccaggagccctgcccccctgctgcggcccctgctgctgctgctgtgtgccctggcccctggggcccctggccctgcccctggccgggccacagagggccgggccgccctggacatcgtgcaccctgtgcgggtggatgctgggggcagcttcctgtcctatgagctgtggccccgggccctgaggaagagagatgtgtctgtgagaagagatgccccagccttctatgagctgcagtaccggggccgggagctgcgcttcaacctgacagccaaccagcacctgctggcccctggctttgtgtctgagacccggcggcggggcggcctgggccgggcccacatccgggcccacaccccagcctgccacctgctgggggaggtgcaggaccctgagctggagggcggcctggccgccatcagcgcctgtgatggcctgaagggcgtcttccagctgagcaatgaagactacttcatcgagcccctggacagcgccccagcccggcccggccacgcccagccccacgtggtgtacaagaggcaggcccctgagcggctggcccagagaggagacagcagcgcccccagcacctgtggggtgcaggtgtacccagagctggagagcagaagagagcgctgggagcagaggcagcagtggaggcggccccggctgcggcggctgcaccagaggtctgtgtccaaggagaagtgggtggagaccctggtggtggctgatgccaagatggtggagtaccacggccagccccaggtggagagctatgtgctgaccatcatgaacatggtggccggcctcttccatgaccccagcatcggcaaccccatccacatcaccatcgtgcggctggtgctgctggaggatgaggaggaggacctgaagatcacccaccacgccgacaacaccctgaagagcttctgcaagtggcagaagagcatcaacatgaagggagatgcccaccccctgcaccacgacacagccatcctgctgaccaggaaggacctgtgtgccgccatgaaccggccctgtgagaccctgggcctgagccacgtggccggcatgtgccagccccacaggagctgcagcatcaatgaagacaccggcctgcccctggccttcaccgtggcccacgagctgggccacagcagctgcaccacccccctgcccagccctggccctgctgctgctgccagcatcagccctggcagcctgtctgtgcagaggcagaatgtgtactgcctggagcggcaggccggccctgtggatgaggagcactgtgaccccctgggccgcccagatgaccagcagaggaaatgttctgagcagccctgcccagccagcgcccagtag

SEQ ID NO: 142662 - DNA, 2670 bp, Artificial Sequence
  Description of Artificial Sequence: Synthetic coding sequence
atgctgcctgccccagctgccccccgctggccacccctgctgctgctgctgctgctgctgctgcccctggcccggggggccccagcccggcctgctgctgggggccaggccagcgagctggtggtgcccacccggctgcccggcagcgctggggagctggccctgcacctgagcgccttcggcaagggctttgtgctgcggctggccccagatgacagcttcctggcccctgagttcaagattgagcggctgggcggcagcggccgggccactggaggagagcggggcctgcggggctgcttcttctctggaacagtgaatggagagcctgagagcctggccgctgtgtccctgtgccggggcctgagcggcagcttcctgctggatggagaggagttcaccatccagccccagggcgctgggggcagcctggcccagccccaccggctgcagcgctggggccctgctggggcccggcccctgccccggggccctgagtgggaggtggagactggagagggccagaggcaggagcggggggaccaccaggaggacagcgaggaggagagccaggaggaggaggccgagggcgccagcgagcccccaccacccctgggcgccaccagcaggaccaagagatttgtgtctgaggccaggtttgtggagaccctgctggtggctgatgcctccatggccgccttctatggagctgacctgcagaaccacatcctgaccctgatgtctgtggccgcccgcatctacaagcaccccagcatcaagaacagcatcaacctgatggtggtgaaggtgctgattgtggaggatgagaagtggggccctgaggtgtctgacaatggaggcctgaccctgaggaacttctgcaactggcagaggcgcttcaaccagcccagcgacagacaccctgagcactatgacacagccatcctgctgacccggcagaacttctgtggccaggagggcctgtgtgacaccctgggcgtggccgacatcggcaccatctgtgaccccaacaagagctgcagcgtgattgaagatgagggcctgcaggccgcccacaccctggcccacgagctgggccacgtgctgtccatgcctcatgatgacagcaagccctgcacccggctgtttggccccatgggcaagcaccacgtgatggcccccctgtttgtgcacctgaaccagaccctgccctggagcccctgcagcgccatgtacctgacagagctgctggatggcggccatggagactgcctgctggatgccccagctgctgccctgcccctgcccaccggcctgcccggccgcatggccctgtaccagctggaccagcagtgccggcagatcttcggccctgacttccgccactgccccaacaccagcgcccaggatgtgtgtgcccagctgtggtgccacacagatggagctgagcccctgtgccacaccaagaatggcagcctgccctgggcagatggcaccccctgtggccctggccacctgtgcagcgagggcagctgcctgcctgaggaggaggtggagcggcccaagcctgtggctgatggcggctgggccccctggggcccctggggagaatgttccaggacctgtggcggcggcgtgcagttcagccaccgggagtgcaaggaccctgagccccagaatggaggccgctactgcctgggccggcgggccaagtaccagagctgccacacagaagaatgtcctccagatggcaagagcttccgggagcagcagtgtgagaagtacaatgcctacaactacacagacatggatggcaacctgctgcagtgggtgcccaagtatgccggcgtgagcccccgggaccgctgcaagctgttctgccgggcccggggccgctctgagttcaaggtgtttgaggccaaggtgattgatggcaccctgtgtggccctgagaccctggccatctgtgtgcggggccagtgtgtgaaggccggctgtgaccacgtggtggacagccccaggaagctggacaagtgtggggtgtgtggcggcaaaggaaacagctgcaggaaggtgtctggcagcctgacccccaccaactacggctacaatgacatcgtgaccatcccagctggggccaccaacattgatgtgaagcagaggagccaccctggggtgcagaatgatggcaactacctggccctgaagacagcagatggccagtacctgctgaatggaaacctggccatcagcgccatcgagcaggacatcctggtgaagggcaccatcctgaagtacagcggcagcatcgccaccctggagcggctgcagagcttccggcccctgcctgagcccctgactgtgcagctgctgactgtgcctggagaggtgtttcctcccaaggtgaagtacaccttctttgtgcccaatgatgtggacttctccatgcagagcagcaaggagcgggccaccaccaacatcatccagcccctgctgcacgcccagtgggtgctgggggactggagcgaatgtagcagcacctgtggggccggctggcagaggagaacagtggagtgccgggaccccagcggccaggccagcgccacctgcaacaaggccctgaagccagaagatgccaagccctgtgagagccagctgtgccccctgtag

SEQ ID NO: 142663 - DNA, 2757 bp, Artificial Sequence
  Description of Artificial Sequence: Synthetic coding sequence
gctgcccgggcccggctgggcggcggcggggccggcggggccggctgtgccagccagaggggccggcggggcagcgccccagctgctggcccccggggccccagccggccctgcaccaggctcatccccctcttcctggagagagctgctggccccaggagcggccggcagcacctgcctgcccctgggggcctgctgcccagccctgcccggagccaccggcgcagcccccacgccccccggcccaggaggcctcctgtggccagcgccccagctgctgctgctgctgctgctgctgctggccccaggaggcctggccctgcccggagcagaggagctggcctgggcgccggcggggcccatgctgtggcccggctgcggggctgcttcttcagcggcaccgtgaatggagagcctgagagcctggccgctgtgtccctgtgccggggcctgagcggcagcttcctgctggatggagaggagttcaccatccagccccagggcgccggcggcagcctggcccagccccaccggctgcagcgctggggccctgctggggcccggcccctgccccggggccctgagtgggaggtggagaccggggagggccagaggcaggagcggggggaccaccaggaggacagcgaggaggagagccaggaggaggaggccgagggcgccagcgagcccccaccacccctgggcgccaccagcaggaccaagagatttgtgtctgaggccaggtttgtggagaccctgctggtggctgatgcctccatggccgccttctacggggctgacctgcagaaccacatcctgaccctgatgtctgtggccgcccgcatctacaagcaccccagcatcaagaacagcatcaacctgatggtggtgaaggtgctgattgtggaggatgagaagtggggccctgaggtgtctgacaatggaggcctgaccctgaggaacttctgcaactggcagaggcgcttcaaccagcccagcgacagacaccctgagcactatgacacagccatcctgctgacccggcagaacttctgtggccaggagggcctgtgtgacaccctgggcgtggccgacatcggcaccatctgtgaccccaacaagagctgcagcgtgattgaagatgagggcctgcaggccgcccacaccctggcccacgagctgggccacgtgctgtccatgcctcatgatgacagcaagccctgcacccggctgtttggccccatgggcaagcaccacgtgatggcccccctgtttgtgcacctgaaccagaccctgccctggagcccctgcagcgccatgtacctgacagagctgctggatggcggccacggggactgcctgctggatgccccagctgctgccctgcccctgcccaccggcctgcccggccgcatggccctgtaccagctggaccagcagtgccggcagatctttggaccagacttccgccactgccccaacaccagcgcccaggatgtgtgtgcccagctgtggtgccacacagatggagctgagcccctgtgccacaccaagaatggcagcctgccctgggcagatggcaccccctgtggccctggccacctgtgcagcgagggcagctgcctgcctgaggaggaggtggagcggcccaagcctgtggctgatggcggctgggccccctggggcccctggggcgagtgcagcaggacctgtggcggcggcgtgcagttcagccaccgggagtgcaaggaccctgagccccagaatggaggccgctactgcctgggcagaagagccaagtaccagagctgccacacagaggagtgccccccagatggcaagagcttccgggagcagcagtgtgagaagtacaatgcctacaactacacagacatggatggcaacctgctgcagtgggtgcccaagtatgctggggtgagcccccgggaccgctgcaagctgttctgccgggcccggggccgctctgagttcaaggtgtttgaggccaaggtgattgatggcaccctgtgtggccctgagaccctggccatctgtgtgcggggccagtgtgtgaaggccggctgtgaccacgtggtggacagccccaggaagctggacaagtgtggggtgtgtggcggcaagggcaacagctgcaggaaggtgtctggcagcctgacccccaccaactacggctacaatgacatcgtgaccatcccagctggggccaccaacattgatgtgaagcagaggagccaccctggggtgcagaatgatggcaactacctggccctgaagacagcagatggccagtacctgctgaatggaaacctggccatcagcgccatcgagcaggacatcctggtgaagggcaccatcctgaagtacagcggcagcatcgccaccctggagcggctgcagagcttccggcccctgcctgagcccctgactgtgcagctgctgactgtgcctggagaggtgttcccccccaaggtgaagtacaccttctttgtgcccaatgatgtggacttctccatgcagagcagcaaggagcgggccaccaccaacatcatccagcccctgctgcacgcccagtgggtgctgggggactggagcgagtgcagcagcacctgtggggccggctggcagaggagaacagtggagtgccgggaccccagcggccaggccagcgccacctgcaacaaggccctgaagccagaagatgccaagccctgtgagagccagctgtgccccctgtag

SEQ ID NO: 142664 - DNA, 5724 bp, Artificial Sequence
  Description of Artificial Sequence: Synthetic coding sequence
atgcagtttgtgtcctgggccaccctgctgaccctgctggtgcgggacctggccgagatgggcagcccagatgctgctgctgctgtgaggaaggaccggctgcacccccggcaggtgaagctgctggagaccctgtctgaatatgagatcgtgagccccatccgggtgaatgccctgggggagcccttccccaccaacgtgcacttcaagaggaccaggaggagcatcaacagcgccacagacccctggccagcctttgccagcagcagcagcagcagcaccagcagccaggcccactaccgcctgagcgccttcggccagcagttcctgttcaacctgacagccaatgccggcttcatcgcccccctcttcaccgtgaccctgctgggcaccccaggagtgaaccagaccaagttctacagcgaggaggaggccgagctgaagcactgcttctacaagggctacgtgaacaccaacagcgagcacacagctgtgatcagcctgtgcagcggcatgctgggcaccttccgcagccatgatggagactacttcatcgagcccctgcagagcatggatgagcaggaggatgaggaggagcagaacaagccccacatcatctaccgccgcagcgccccccagcgggagcccagcactggaagacatgcctgtgacaccagcgagcacaagaacagacacagcaaggacaagaagaagacccgggccaggaagtggggcgagcgcatcaacctggccggagatgtggccgccctgaacagcggcctggccacagaggccttcagcgcctacggcaacaagacagacaacacccgggagaagaggacccacaggaggaccaagcgcttcctgagctaccccaggtttgtggaggtgctggtggtggccgacaacaggatggtgtcctaccatggagagaacctgcagcactacatcctgaccctgatgagcattgatggccccagcatctccttcaatgcccagaccaccctgaagaacttctgccagtggcagcacagcaagaacagccctgggggcatccaccacgacacagctgtgctgctgacccggcaggacatctgccgggcccatgacaagtgtgacaccctgggcctggccgagctgggcaccatctgtgacccctaccgcagctgcagcatcagcgaggacagcggcctgagcacagccttcaccatcgcccacgagctgggccacgtgttcaacatgcctcatgatgacaacaacaagtgcaaggaggagggcgtgaagagcccccagcacgtgatggcccccaccctgaacttctacaccaacccctggatgtggagcaagtgcagcaggaagtacatcacagagttcctggacaccggctatggagaatgtctgctgaatgaacctgagagccggccctaccccctgcctgtgcagctgcccggcatcctgtacaacgtgaacaagcagtgtgagctgatctttggacctggcagccaggtgtgcccctacatgatgcagtgccggcggctgtggtgcaacaacgtgaatggagtgcacaagggctgcaggacccagcacaccccctgggcagatggaacagaatgtgagcccgggaagcactgcaagtatggcttctgtgtgcccaaggagatggatgtgcctgtgacagatggctcctggggctcctggagccccttcggcacctgcagcaggacctgtggcggcggcatcaagacagccatccgggagtgcaacagacctgagcccaagaatggaggcaagtactgtgtgggccgcaggatgaagttcaagagctgcaacacagagccctgcctgaagcagaagagggacttcagagatgagcagtgtgcccactttgatggcaagcacttcaacatcaatggcctgctgcccaacgtgcgctgggtgcccaagtacagcggcatcctgatgaaggaccgctgcaagctgttctgccgggtggccggcaacacagcctactaccagctgcgggacagagtgattgatggcaccccctgtggccaggacaccaatgacatctgtgtgcagggcctgtgccggcaggccggctgtgaccacgtgctgaacagcaaggcccggcgggacaagtgtggggtgtgtggcggggacaacagcagctgcaagacagtggccggcaccttcaacacagtgcactacggctacaacacagtggtgcgcatcccagctggggccaccaacattgatgtgcggcagcacagcttctctggagaaacagatgatgacaactacctggccctgagcagcagcaagggggagttcctgctgaatggaaactttgtggtgaccatggccaagcgggagatcagaattggaaatgctgtggtggagtacagcggcagcgagacagctgtggagcgcatcaacagcacagacagaattgagcaggagctgctgctgcaggtgctgtctgtgggcaagctgtacaacccagatgtgcgctacagcttcaacatccccatcgaggacaagccccagcagttctactggaacagccacggcccctggcaggcctgcagcaagccctgccagggcgagaggaagaggaagctggtgtgcacccgggagagtgaccagctgactgtgtctgaccagagatgtgaccggctgccccagcccggccacatcacagagccctgtggcacagactgtgacctgcgctggcacgtggccagccgctctgagtgcagcgcccagtgtggcctgggctaccgcaccctggacatctactgtgccaagtacagccggctggatggcaagacagagaaggtggatgatggcttctgcagcagccaccccaagcccagcaaccgggagaagtgcagcggggagtgcaacacaggaggctggagatacagcgcctggacagagtgcagcaagagctgtgatggcggcacccagaggcggcgggccatctgtgtgaacaccagaaatgatgtgctggatgacagcaagtgcacccaccaggagaaggtgaccatccagcgctgcagcgagttcccctgcccccagtggaagagcggggactggagcgaatgtctggtgacctgtgggaagggccacaagcaccggcaggtgtggtgccagtttggagaagatcggctgaatgacaggatgtgtgaccctgagaccaagcccacctccatgcagacctgccagcagccagaatgtgcctcctggcaggccggcccctggggccagtgcagcgtgacctgtggccagggctaccagctgcgggctgtgaagtgcatcatcggcacctacatgtctgtggtggatgacaatgactgcaatgctgccacccggcccacagacacccaggactgtgagctgcccagctgccaccccccacctgctgcccctgagaccaggaggagcacctacagcgcccccaggacccagtggaggtttggctcctggaccccctgcagcgccacctgtgggaagggcaccaggatgagatatgtgtcctgcagagatgaaaatggatctgtggctgatgagagcgcctgtgccaccctgcccaggcctgtggccaaggaggagtgcagcgtgaccccctgtggccagtggaaggccctggactggagcagctgcagcgtgacctgtggccagggccgggccacccggcaggtgatgtgtgtgaactacagcgaccacgtgattgacagaagtgaatgtgaccaggactacatccctgagacagaccaggactgcagcatgagcccctgcccccagaggaccccagacagcggcctggcccagcaccccttccagaatgaagactaccggcccaggtctgccagccccagcaggacccacgtgctgggcggcaaccagtggaggacaggcccctggggcgcctgcagcagcacctgtgccggcggcagccagaggagagtggtggtgtgccaggatgaaaatggctacacagccaatgactgtgtggagcgcatcaagccagatgagcagagggcctgtgagagcggcccctgcccccagtgggcctacggcaactggggagaatgtaccaagctgtgtggcggcggcatccgcacccggctggtggtgtgccagaggagcaatggagagcgcttcccagacctgagctgtgagatcctggacaagcccccagaccgggagcagtgcaacacccacgcctgcccccatgatgctgcctggagcacaggcccctggagcagctgcagcgtgtcctgtggccggggccacaagcagagaaatgtgtactgcatggccaaggatggcagccacctggagagtgactactgcaagcacctggccaagccccacggccacaggaagtgccggggcggccgctgccccaagtggaaggccggggcctggagccagtgcagcgtgtcctgtggccggggcgtgcagcagagacatgtgggctgccagatcggcacccacaagatcgcccgggagacagagtgcaacccctacaccaggcctgagagcgagcgggactgccagggcccccgctgccccctgtacacctggagggctgaggagtggcaggagtgcaccaagacctgtggggagggcagccgctacaggaaggtggtgtgtgtggatgacaacaagaatgaggtgcatggagcccgctgtgatgtgtccaagaggcctgtggaccgggagagctgcagcctgcagccctgtgaatatgtgtggatcaccggggagtggagcgaatgttctgtgacctgtgggaagggctacaagcagaggctggtgtcctgcagcgagatctacaccgggaaggaaaattatgagtacagctaccagaccaccatcaactgccccggcacccagccccccagcgtgcacccctgctacctgcgggactgccctgtgtctgccacctggagggtgggcaactggggcagctgcagcgtgtcctgtggggtgggcgtgatgcagaggtctgtgcagtgcctgaccaatgaagaccagcccagccacctgtgccacacagacctgaagccagaggagaggaagacctgcagaaatgtgtacaactgtgagctgccccagaactgcaaggaggtgaagaggctgaagggggcctctgaagatggagagtacttcctgatgatccggggcaagctgctgaagatcttctgtgccggcatgcacagcgaccaccccaaggagtatgtgaccctggtgcatggagacagcgagaacttcagcgaggtgtatggccaccggctgcacaaccccacagagtgcccctacaacggcagcagaagagatgactgccagtgcaggaaggactacacagctgctggcttcagcagcttccagaagatcagaattgacctgacctccatgcagatcatcaccacagacctgcagtttgcccggaccagcgagggccaccctgtgccctttgccacagctggggactgctacagcgctgccaagtgcccccagggccgcttcagcatcaacctgtatggaacaggcctgagcctgacagagagcgcccgctggatcagccagggcaactatgctgtgtctgacatcaagaagagcccagatggcaccagggtggtgggcaaatgtggcggctactgtgggaagtgcacccccagcagcggcaccggcctggaggtgcgggtgctgtag

SEQ ID NO: 142665 - DNA, 2976 bp, Artificial Sequence
  Description of Artificial Sequence: Synthetic coding sequence
tgagaatgttctgcccagtgtggcctgggctaccgcaccctggacatctactgtgccaagtacagccggctggatggcaagacagagaaggtggatgatggcttctgcagcagccaccccaagcccagcaaccgggagaagtgcagcggggagtgcaacacaggaggctggagatacagcgcctggacagagtgcagcaagagctgtgatggcggcacccagaggcggcgggccatctgtgtgaacaccagaaatgatgtgctggatgacagcaagtgcacccaccaggagaaggtgaccatccagcgctgcagcgagttcccctgcccccagtggaagagcggggactggagcgaatgtctggtgacctgtgggaagggccacaagcaccggcaggtgtggtgccagtttggagaagatcggctgaatgacaggatgtgtgaccctgagaccaagcccacctccatgcagacctgccagcagccagaatgtgcctcctggcaggccggcccctggggccagtgcagcgtgacctgtggccagggctaccagctgcgggctgtgaagtgcatcatcggcacctacatgtctgtggtggatgacaatgactgcaatgctgccacccggcccacagacacccaggactgtgagctgcccagctgccaccccccacctgctgcccctgagaccaggaggagcacctacagcgcccccaggacccagtggaggtttggctcctggaccccctgcagcgccacctgtgggaagggcaccaggatgagatatgtgtcctgcagagatgaaaatggatctgtggctgatgagagcgcctgtgccaccctgcccaggcctgtggccaaggaggagtgcagcgtgaccccctgtggccagtggaaggccctggactggagcagctgcagcgtgacctgtggccagggccgggccacccggcaggtgatgtgtgtgaactacagcgaccacgtgattgacagaagtgaatgtgaccaggactacatccctgagacagaccaggactgcagcatgagcccctgcccccagaggaccccagacagcggcctggcccagcaccccttccagaatgaagactaccggcccaggtctgccagccccagcaggacccacgtgctgggcggcaaccagtggaggacaggcccctggggcgcctgcagcagcacctgtgccggcggcagccagaggagagtggtggtgtgccaggatgaaaatggctacacagccaatgactgtgtggagcgcatcaagccagatgagcagagggcctgtgagagcggcccctgcccccagtgggcctacggcaactggggagaatgtaccaagctgtgtggcggcggcatccgcacccggctggtggtgtgccagaggagcaatggagagcgcttcccagacctgagctgtgagatcctggacaagcccccagaccgggagcagtgcaacacccacgcctgcccccatgatgctgcctggagcacaggcccctggagcagctgcagcgtgtcctgtggccggggccacaagcagagaaatgtgtactgcatggccaaggatggcagccacctggagagtgactactgcaagcacctggccaagccccacggccacaggaagtgccggggcggccgctgccccaagtggaaggccggggcctggagccagtgcagcgtgtcctgtggccggggcgtgcagcagagacatgtgggctgccagatcggcacccacaagatcgcccgggagacagagtgcaacccctacaccaggcctgagagcgagcgggactgccagggcccccgctgccccctgtacacctggagggctgaggagtggcaggagtgcaccaagacctgtggggagggcagccgctacaggaaggtggtgtgtgtggatgacaacaagaatgaggtgcatggagcccgctgtgatgtgtccaagaggcctgtggaccgggagagctgcagcctgcagccctgtgaatatgtgtggatcaccggggagtggagcgaatgttctgtgacctgtgggaagggctacaagcagaggctggtgtcctgcagcgagatctacaccgggaaggaaaattatgagtacagctaccagaccaccatcaactgccccggcacccagccccccagcgtgcacccctgctacctgcgggactgccctgtgtctgccacctggagggtgggcaactggggcagctgcagcgtgtcctgtggggtgggcgtgatgcagaggtctgtgcagtgcctgaccaatgaagaccagcccagccacctgtgccacacagacctgaagccagaggagaggaagacctgcagaaatgtgtacaactgtgagctgccccagaactgcaaggaggtgaagaggctgaagggggcctctgaagatggagagtacttcctgatgatccggggcaagctgctgaagatcttctgtgccggcatgcacagcgaccaccccaaggagtatgtgaccctggtgcatggagacagcgagaacttcagcgaggtgtatggccaccggctgcacaaccccacagagtgcccctacaacggcagcagaagagatgactgccagtgcaggaaggactacacagctgctggcttcagcagcttccagaagatcagaattgacctgacctccatgcagatcatcaccacagacctgcagtttgcccggaccagcgagggccaccctgtgccctttgccacagctggggactgctacagcgctgccaagtgcccccagggccgcttcagcatcaacctgtatggaacaggcctgagcctgacagagagcgcccgctggatcagccagggcaactatgctgtgtctgacatcaagaagagcccagatggcaccagggtggtgggcaaatgtggcggctactgtgggaagtgcacccccagcagcggcaccggcctggaggtgcgggtgctgtag

SEQ ID NO: 142666 - DNA, 5808 bp, Artificial Sequence
  Description of Artificial Sequence: Synthetic coding sequence
atgcagtttgtgtcctgggccaccctgctgaccctgctggtgcgggacctggccgagatgggcagcccagatgctgctgctgctgtgaggaaggaccggctgcacccccggcaggtgaagctgctggagaccctgtctgaatatgagatcgtgagccccatccgggtgaatgccctgggggagcccttccccaccaacgtgcacttcaagaggaccaggaggagcatcaacagcgccacagacccctggccagcctttgccagcagcagcagcagcagcaccagcagccaggcccactaccgcctgagcgccttcggccagcagttcctgttcaacctgacagccaatgccggcttcatcgcccccctcttcaccgtgaccctgctgggcaccccaggagtgaaccagaccaagttctacagcgaggaggaggccgagctgaagcactgcttctacaagggctacgtgaacaccaacagcgagcacacagctgtgatcagcctgtgcagcggcatgctgggcaccttccgcagccatgatggagactacttcatcgagcccctgcagagcatggatgagcaggaggatgaggaggagcagaacaagccccacatcatctaccgccgcagcgccccccagcgggagcccagcactggaagacatgcctgtgacaccagcgagcacaagaacagacacagcaaggacaagaagaagacccgggccaggaagtggggcgagcgcatcaacctggccggagatgtggccgccctgaacagcggcctggccacagaggccttcagcgcctacggcaacaagacagacaacacccgggagaagaggacccacaggaggaccaagcgcttcctgagctaccccaggtttgtggaggtgctggtggtggccgacaacaggatggtgtcctaccatggagagaacctgcagcactacatcctgaccctgatgagcatcgtggccagcatctacaaggaccccagcatcggcaacctgatcaacatcgtgattgtgaacctgattgtcatccacaatgagcaggacggccccagcatctccttcaatgcccagaccaccctgaagaacttctgccagtggcagcacagcaagaacagccctgggggcatccaccacgacacagctgtgctgctgacccggcaggacatctgccgggcccatgacaagtgtgacaccctgggcctggccgagctgggcaccatctgtgacccctaccgcagctgcagcatcagcgaggacagcggcctgagcacagccttcaccatcgcccacgagctgggccacgtgttcaacatgcctcatgatgacaacaacaagtgcaaggaggagggcgtgaagagcccccagcacgtgatggcccccaccctgaacttctacaccaacccctggatgtggagcaagtgcagcaggaagtacatcacagagttcctggacaccggctatggagaatgtctgctgaatgaacctgagagccggccctaccccctgcctgtgcagctgcccggcatcctgtacaacgtgaacaagcagtgtgagctgatctttggacctggcagccaggtgtgcccctacatgatgcagtgccggcggctgtggtgcaacaacgtgaatggagtgcacaagggctgcaggacccagcacaccccctgggcagatggaacagaatgtgagcccgggaagcactgcaagtatggcttctgtgtgcccaaggagatggatgtgcctgtgacagatggctcctggggctcctggagccccttcggcacctgcagcaggacctgtggcggcggcatcaagacagccatccgggagtgcaacagacctgagcccaagaatggaggcaagtactgtgtgggccgcaggatgaagttcaagagctgcaacacagagccctgcctgaagcagaagagggacttcagagatgagcagtgtgcccactttgatggcaagcacttcaacatcaatggcctgctgcccaacgtgcgctgggtgcccaagtacagcggcatcctgatgaaggaccgctgcaagctgttctgccgggtggccggcaacacagcctactaccagctgcgggacagagtgattgatggcaccccctgtggccaggacaccaatgacatctgtgtgcagggcctgtgccggcaggccggctgtgaccacgtgctgaacagcaaggcccggcgggacaagtgtggggtgtgtggcggggacaacagcagctgcaagacagtggccggcaccttcaacacagtgcactacggctacaacacagtggtgcgcatcccagctggggccaccaacattgatgtgcggcagcacagcttctctggagaaacagatgatgacaactacctggccctgagcagcagcaagggggagttcctgctgaatggaaactttgtggtgaccatggccaagcgggagatcagaattggaaatgctgtggtggagtacagcggcagcgagacagctgtggagcgcatcaacagcacagacagaattgagcaggagctgctgctgcaggtgctgtctgtgggcaagctgtacaacccagatgtgcgctacagcttcaacatccccatcgaggacaagccccagcagttctactggaacagccacggcccctggcaggcctgcagcaagccctgccagggcgagaggaagaggaagctggtgtgcacccgggagagtgaccagctgactgtgtctgaccagagatgtgaccggctgccccagcccggccacatcacagagccctgtggcacagactgtgacctgcgctggcacgtggccagccgctctgagtgcagcgcccagtgtggcctgggctaccgcaccctggacatctactgtgccaagtacagccggctggatggcaagacagagaaggtggatgatggcttctgcagcagccaccccaagcccagcaaccgggagaagtgcagcggggagtgcaacacaggaggctggagatacagcgcctggacagagtgcagcaagagctgtgatggcggcacccagaggcggcgggccatctgtgtgaacaccagaaatgatgtgctggatgacagcaagtgcacccaccaggagaaggtgaccatccagcgctgcagcgagttcccctgcccccagtggaagagcggggactggagcgaatgtctggtgacctgtgggaagggccacaagcaccggcaggtgtggtgccagtttggagaagatcggctgaatgacaggatgtgtgaccctgagaccaagcccacctccatgcagacctgccagcagccagaatgtgcctcctggcaggccggcccctggggccagtgcagcgtgacctgtggccagggctaccagctgcgggctgtgaagtgcatcatcggcacctacatgtctgtggtggatgacaatgactgcaatgctgccacccggcccacagacacccaggactgtgagctgcccagctgccaccccccacctgctgcccctgagaccaggaggagcacctacagcgcccccaggacccagtggaggtttggctcctggaccccctgcagcgccacctgtgggaagggcaccaggatgagatatgtgtcctgcagagatgaaaatggatctgtggctgatgagagcgcctgtgccaccctgcccaggcctgtggccaaggaggagtgcagcgtgaccccctgtggccagtggaaggccctggactggagcagctgcagcgtgacctgtggccagggccgggccacccggcaggtgatgtgtgtgaactacagcgaccacgtgattgacagaagtgaatgtgaccaggactacatccctgagacagaccaggactgcagcatgagcccctgcccccagaggaccccagacagcggcctggcccagcaccccttccagaatgaagactaccggcccaggtctgccagccccagcaggacccacgtgctgggcggcaaccagtggaggacaggcccctggggcgcctgcagcagcacctgtgccggcggcagccagaggagagtggtggtgtgccaggatgaaaatggctacacagccaatgactgtgtggagcgcatcaagccagatgagcagagggcctgtgagagcggcccctgcccccagtgggcctacggcaactggggagaatgtaccaagctgtgtggcggcggcatccgcacccggctggtggtgtgccagaggagcaatggagagcgcttcccagacctgagctgtgagatcctggacaagcccccagaccgggagcagtgcaacacccacgcctgcccccatgatgctgcctggagcacaggcccctggagcagctgcagcgtgtcctgtggccggggccacaagcagagaaatgtgtactgcatggccaaggatggcagccacctggagagtgactactgcaagcacctggccaagccccacggccacaggaagtgccggggcggccgctgccccaagtggaaggccggggcctggagccagtgcagcgtgtcctgtggccggggcgtgcagcagagacatgtgggctgccagatcggcacccacaagatcgcccgggagacagagtgcaacccctacaccaggcctgagagcgagcgggactgccagggcccccgctgccccctgtacacctggagggctgaggagtggcaggagtgcaccaagacctgtggggagggcagccgctacaggaaggtggtgtgtgtggatgacaacaagaatgaggtgcatggagcccgctgtgatgtgtccaagaggcctgtggaccgggagagctgcagcctgcagccctgtgaatatgtgtggatcaccggggagtggagcgaatgttctgtgacctgtgggaagggctacaagcagaggctggtgtcctgcagcgagatctacaccgggaaggaaaattatgagtacagctaccagaccaccatcaactgccccggcacccagccccccagcgtgcacccctgctacctgcgggactgccctgtgtctgccacctggagggtgggcaactggggcagctgcagcgtgtcctgtggggtgggcgtgatgcagaggtctgtgcagtgcctgaccaatgaagaccagcccagccacctgtgccacacagacctgaagccagaggagaggaagacctgcagaaatgtgtacaactgtgagctgccccagaactgcaaggaggtgaagaggctgaagggggcctctgaagatggagagtacttcctgatgatccggggcaagctgctgaagatcttctgtgccggcatgcacagcgaccaccccaaggagtatgtgaccctggtgcatggagacagcgagaacttcagcgaggtgtatggccaccggctgcacaaccccacagagtgcccctacaacggcagcagaagagatgactgccagtgcaggaaggactacacagctgctggcttcagcagcttccagaagatcagaattgacctgacctccatgcagatcatcaccacagacctgcagtttgcccggaccagcgagggccaccctgtgccctttgccacagctggggactgctacagcgctgccaagtgcccccagggccgcttcagcatcaacctgtatggaacaggcctgagcctgacagagagcgcccgctggatcagccagggcaactatgctgtgtctgacatcaagaagagcccagatggcaccagggtggtgggcaaatgtggcggctactgtgggaagtgcacccccagcagcggcaccggcctggaggtgcgggtgctgtag

SEQ ID NO: 142667 - DNA, 1176 bp, Artificial Sequence
  Description of Artificial Sequence: Synthetic coding sequence
atgatcctgaatggagaggagatcatcctgagcctgcagaagaccaagcacctgctgggccctgactacacagagaccctgtacagccccagaggagaggagatcaccaccaagccagagaacatggagcactgctactacaagggcaacatcctgaatgagaagaacagcgtggccagcatcagcacctgtgatggcctgcggggctacttcacccaccaccaccagcgctaccagatcaagcccctgaagagcacagatgagaaggagcacgctgtgttcaccagcaaccaggaggagcaggaccctgccaaccacacctgtggggtgaagagcacagatggcaagcagggccccatccgcatcagccgcagcctgaagagccctgagaaggaggacttcctgcgggcccagaagtacatcgacctgtacctggtgctggacaatgccttctacaagaactacaatgaaaacctgaccctcatccgcagctttgtgtttgatgtgatgaacctgctgaatgtcatctacaacaccattgatgtgcaggtggccctggtgggcatggagatctggagcgatggagacaagatcaaggtggtgcccagcgccagcaccacctttgacaacttcctgcgctggcacagcagcaacctgggcaagaagatccatgaccacgcccagctgctgagcggcatctccttcaacaacagaagagtgggcctggccgccagcaacagcctgtgcagccccagctctgtggccgtgattgaggccaagaagaagaacaacgtggccctggtgggcgtgatgagccatgagctgggccacgtgctgggcatgccagatgtgcccttcaacaccaagtgccccagcggcagctgtgtgatgaaccagtacctgagcagcaagttccccaaggacttcagcaccagctgccgggcccactttgagcgctacctgctgagccagaagcccaagtgcctgctgcaggcccccatccccaccaacatcatgaccacccctgtgtgtggcaaccacctgctggaggtgggggaggactgtgactgtggcagccccaaggagtgcaccaacctgtgctgtgaggccctgacctgcaagctgaagccaggcacagactgtggaggagatgcccccaaccacaccacagaatag

SEQ ID NO: 142668 - DNA, 1413 bp, Artificial Sequence
  Description of Artificial Sequence: Synthetic coding sequence
atgctgcggggcatcagccagctgcctgctgtggccaccatgtcctgggtgctgctgcctgtgctgtggctgattgtgcagacccaggccatcgccatcaagcagaccccagagctgaccctgcacgagatcgtgtgccccaagaagctgcacatcctgcacaagcgggagatcaagaacaaccagacagagaagcacggcaaggaggagagatatgagcctgaggtgcagtaccagatgatcctgaatggagaggagatcatcctgagcctgcagaagaccaagcacctgctgggccctgactacacagagaccctgtacagccccagaggagaggagatcaccaccaagccagagaacatggagcactgctactacaagggcaacatcctgaatgagaagaacagcgtggccagcatcagcacctgtgatggcctgcggggctacttcacccaccaccaccagcgctaccagatcaagcccctgaagagcacagatgagaaggagcacgctgtgttcaccagcaaccaggaggagcaggaccctgccaaccacacctgtggggtgaagagcacagatggcaagcagggccccatccgcatcagccgcagcctgaagagccctgagaaggaggacttcctgcgggcccagaagtacatcgacctgtacctggtgctggacaatgccttctacaagaactacaatgaaaacctgaccctcatccgcagctttgtgtttgatgtgatgaacctgctgaatgtcatctacaacaccattgatgtgcaggtggccctggtgggcatggagatctggagcgatggagacaagatcaaggtggtgcccagcgccagcaccacctttgacaacttcctgcgctggcacagcagcaacctgggcaagaagatccatgaccacgcccagctgctgagcggcatctccttcaacaacagaagagtgggcctggccgccagcaacagcctgtgcagccccagctctgtggccgtcatcgaggccaagaagaagaacaacgtggccctggtgggcgtgatgagccatgagctgggccacgtgctgggcatgccagatgtgcccttcaacaccaagtgccccagcggcagctgtgtgatgaaccagtacctgagcagcaagttccccaaggacttcagcaccagctgccgggcccactttgagcgctacctgctgagccagaagcccaagtgcctgctgcaggcccccatccccaccaacatcatgaccacccctgtgtgtggcaaccacctgctggaggtgggggaggactgtgactgtggcagccccaaggaatgtaccaacctgtgctgtgaggccctgacctgcaagctgaagccaggcacagactgtggaggagatgcccccaaccacaccacagaatag

SEQ ID NO: 142669 - DNA, 1176 bp, Artificial Sequence; identical to SEQ ID NO: 142667
  Description of Artificial Sequence: Synthetic coding sequence

SEQ ID NO: 142670 - DNA, 2052 bp, Artificial Sequence
  Description of Artificial Sequence: Synthetic coding sequence
atggagtgctgcagaagagccaccccaggcaccctgctgctcttcctggccttcctgctgctgagcagcaggacagcccggtctgaggaggacagagatggcctgtgggatgcctggggcccctggagcgagtgcagcaggacctgtggcggcggggccagctacagcctgcggcgctgcctgagcagcaagagctgtgagggcaggaacatccgctaccgcacctgcagcaatgtggactgccccccagaggccggggacttccgggcccagcagtgcagcgcccacaatgatgtgaagcaccacggccagttctatgagtggctgcctgtgtccaatgaccctgacaacccctgcagcctgaagtgccaggccaagggcaccaccctggtggtggagctggcccccaaggtgctggatggcacccgctgctacacagagagcctggacatgtgcatcagcggcctgtgccagatcgtgggctgtgaccaccagctgggcagcacagtgaaggaggacaactgtggggtgtgcaatggagatggcagcacctgccgcctggtgcggggccagtacaagagccagctgagcgccaccaagagtgatgacacagtggtggccatcccctacggcagccgccacatccggctggtgctgaagggccctgaccacctgtacctggagaccaagaccctgcagggcaccaagggggagaacagcctgagcagcacaggcaccttcctggtggacaacagctctgtggacttccagaagttcccagacaaggagatcctgaggatggccggccccctgacagctgacttcatcgtgaagatccggaacagcggcagcgctgacagcacagtgcagttcatcttctaccagcccatcatccaccgctggagggagacagacttcttcccctgcagcgccacctgtggcggcggctaccagctgaccagcgcagaatgttatgacctgcggagcaacagagtggtggccgaccagtactgccactactacccagagaacatcaagcccaagcccaagctgcaggagtgcaacctggacccctgcccagccagtgatggctacaagcagatcatgccctatgacctgtaccaccccctgccccgctgggaggccaccccctggacagcctgcagcagcagctgtggcggcggcatccagagcagagctgtgtcctgtgtggaggaggacatccagggccacgtgacctctgtggaggagtggaagtgcatgtacacccccaagatgcccatcgcccagccctgcaacatctttgactgccccaagtggctggcccaggagtggagcccctgcaccgtgacctgtggccagggcctgcgctacagagtggtgctgtgcatcgaccaccggggcatgcacactggaggctgcagccccaagaccaagccccacatcaaggaggagtgcatcgtgcccaccccctgctacaagcccaaggagaagctgcctgtggaggccaagctgccctggttcaagcaggcccaggagctggaggagggcgctgctgtgtctgaggagcccagcttcatccctgaggcctggagcgcctgcaccgtgacctgtggggtgggcacccaggtgcgcatcgtgcgctgccaggtgctgctgtccttcagccagagcgtggccgacctgcccattgatgaatgtgagggccccaagccagccagccagagggcctgctacgccggcccctgcagcggggagatccctgagttcaacccagatgaaacagatggcctgtttggaggcctgcaggactttgatgagctgtatgactgggagtatgagggcttcaccaagtgcagcgagagctgtggcggcggcgtgcaggaggccgtggtgtcctgcctgaacaagcagacccgggagcctgctgaggagaacctgtgtgtgaccagccggcggcccccccagctgctgaagagctgcaacctggacccctgcccagcccggagcagcattgacagcgcctggaatgcctgcaatgtgctgtgctag

SEQ ID NO: 142671 - DNA, 1401 bp, Artificial Sequence
  Description of Artificial Sequence: Synthetic coding sequence
atgtgcctgacagatgagtggggcttcttcttcttcttcttcctgggcgtgcctgaggccgaggtgacctggttcaggaacaagagcaagctgggcagcccccaccacctgcacgagggcagcctgctgctgaccaacgtgagcagcagtgaccagggcctgtacagctgcagagctgccaacctgcatggagagctgacagagagcacccagctgctgatcctggaccccccccaggtgcccacccagctggaggacatccgggccctgctggccgccaccggccccaacctgcccagcgtgctgaccagccccctgggcacccagctggtgctggaccccggcaacagcgccctgctgggctgccccatcaagggccaccctgtgcccaacatcacctggttccacggcggccagcccatcgtgacagccaccggcctgacccaccacatcctggccgccggccagatcctgcaggtggccaacctgagcggcggcagccagggcgagttcagctgcctggcccagaatgaagctggggtgctgatgcagaaggccagcctggtgatccaggactactggtggagcgtggaccggctggccacctgcagcgccagctgtggcaacagaggagtgcagcagccccggctgcgctgcctgctgaacagcacagaggtgaacccagcccactgtgccggcaaggtgcggcctgctgtgcagcccatcgcctgcaacagaagagactgccccagccgctggatggtgacctcctggagcgcctgcaccaggagctgtggcggcggcgtgcagacccggcgggtgacctgccagaagctgaaggccagcggcatcagcacccctgtgtccaatgacatgtgcacccaggtggccaagaggcctgtggacacccaggcctgcaaccagcagctgtgtgtggagtgggccttcagctcctggggccagtgcaatggcccctgcatcggcccccacctggccgtgcagcaccggcaggtgttctgccagaccagagatggcatcaccctgcccagcgagcagtgcagcgccctgcccaggcctgtgtccacccagaactgctggagcgaggcctgcagcgtgcactggagggtgtccctgtggaccctgtgcacagccacctgtggcaactacggcttccagagccggcgggtggagtgtgtgcacgcccggaccaacaaggctgtgcctgagcacctgtgctcctggggccccaggcctgccaactggcagcgctgcaacatcaccccctgtgagaacatggagtgccgggacaccacccgctactgtgagaaggtgaagcagctgaagctgtgccagctgagccagttcaagagccgctgctgcggcacctgtgggaaggcctag

SEQ ID NO: 142672 - DNA, 1578 bp, Artificial Sequence
  Description of Artificial Sequence: Synthetic coding sequence
atggagtgctgcagaagagccaccccaggcaccctgctgctcttcctggccttcctgctgctgagcagcaggacagcccggtctgaggaggacagagatggcctgtgggatgcctggggcccctggagcgagtgcagcaggacctgtggcggcggggccagctacagcctgcggcgctgcctgagcagcaagagctgtgagggcaggaacatccgctaccgcacctgcagcaatgtggactgccccccagaggccggggacttccgggcccagcagtgcagcgcccacaatgatgtgaagcaccacggccagttctatgagtggctgcctgtgtccaatgaccctgacaacccctgcagcctgaagtgccaggccaagggcaccaccctggtggtggagctggcccccaaggtgctggatggcacccgctgctacacagagagcctggacatgtgcatcagcggcctgtgccagatcgtgggctgtgaccaccagctgggcagcacagtgaaggaggacaactgtggggtgtgcaatggagatggcagcacctgccgcctggtgcggggccagtacaagagccagctgagcgccaccaagagtgatgacacagtggtggccatcccctacggcagccgccacatccggctggtgctgaagggccctgaccacctgtacctggagaccaagaccctgcagggcaccaagggggagaacagcctgagcagcacaggcaccttcctggtggacaacagctctgtggacttccagaagttcccagacaaggagatcctgaggatggccggccccctgacagctgacttcatcgtgaagatccggaacagcggcagcgctgacagcacagtgcagttcatcttctaccagcccatcatccaccgctggagggagacagacttcttcccctgcagcgccacctgtggcggcggctaccagctgaccagcgcagaatgttatgacctgcggagcaacagagtggtggccgaccagtactgccactactacccagagaacatcaagcccaagcccaagctgcaggagtgcaacctggacccctgcccagccagtgatggctacaagcagatcatgccctatgacctgtaccaccccctgccccgctgggaggccaccccctggacagcctgcagcagcagctgtggcggcggcatccagagcagagctgtgtcctgtgtggaggaggacatccagggccacgtgacctctgtggaggagtggaagtgcatgtacacccccaagatgcccatcgcccagccctgcaacatctttgactgccccaagtggctggcccaggagtggagcccctgcaccgtgacctgtggccagggcctgcgctacagagtggtgctgtgcatcgaccaccggggcatgcacactggaggctgcagccccaagaccaagccccacatcaaggaggagtgcatcgtgcccaccccctgctacaagcccaaggagaagctgcctgtggaggccaagctgccctggttcaagcaggcccaggagctggaggagggcgctgctgtgtctgaggagcccagctag

SEQ ID NO: 142673 - DNA, 786 bp, Artificial Sequence
  Description of Artificial Sequence: Synthetic coding sequence
atgtgcctgacagatgagtggggcttcttcttcttcttcttcctgggcgtgcctgaggccgaggtgacctggttcaggaacaagagcaagctgggcagcccccaccacctgcacgagggcagcctgctgctgaccaacgtgagcagcagtgaccagggcctgtacagctgcagagctgccaacctgcatggagagctgacagagagcacccagctgctgatcctggaccccccccaggtgcccacccagctggaggacatccgggccctgctggccgccaccggccccaacctgcccagcgtgctgaccagccccctgggcacccagctggtgctggaccccggcaacagcgccctgctgggctgccccatcaagggccaccctgtgcccaacatcacctggttccacggcggccagcccatcgtgacagccaccggcctgacccaccacatcctggccgccggccagatcctgcaggtggccaacctgagcggcggcagccagggcgagttcagctgcctggcccagaatgaagctggggtgctgatgcagaaggccagcctggtgatccaggactactggtggagcgtggaccggctggccacctgcagcgccagctgtggcaacagaggagtgcagcagccccggctgcgctgcctgctgaacagcacagaggtgaacccagcccactgtgccggcaaggtgcggcctgctgtgcagcccatcgcctgcaacagaagagactgccccagccgggccatgggcctggccagcggcctgacctag

SEQ ID NO: 142674 - DNA, 5289 bp, Artificial Sequence
  Description of Artificial Sequence: Synthetic coding sequence
atggagtgctgcagaagagccaccccaggcaccctgctgctcttcctggccttcctgctgctgagcagcaggacagcccggtctgaggaggacagagatggcctgtgggatgcctggggcccctggagcgagtgcagcaggacctgtggcggcggggccagctacagcctgcggcgctgcctgagcagcaagagctgtgagggcaggaacatccgctaccgcacctgcagcaatgtggactgccccccagaggccggggacttccgggcccagcagtgcagcgcccacaatgatgtgaagcaccacggccagttctatgagtggctgcctgtgtccaatgaccctgacaacccctgcagcctgaagtgccaggccaagggcaccaccctggtggtggagctggcccccaaggtgctggatggcacccgctgctacacagagagcctggacatgtgcatcagcggcctgtgccagatcgtgggctgtgaccaccagctgggcagcacagtgaaggaggacaactgtggggtgtgcaatggagatggcagcacctgccgcctggtgcggggccagtacaagagccagctgagcgccaccaagagtgatgacacagtggtggccatcccctacggcagccgccacatccggctggtgctgaagggccctgaccacctgtacctggagaccaagaccctgcagggcaccaagggggagaacagcctgagcagcacaggcaccttcctggtggacaacagctctgtggacttccagaagttcccagacaaggagatcctgaggatggccggccccctgacagctgacttcatcgtgaagatccggaacagcggcagcgctgacagcacagtgcagttcatcttctaccagcccatcatccaccgctggagggagacagacttcttcccctgcagcgccacctgtggcggcggctaccagctgaccagcgcagaatgttatgacctgcggagcaacagagtggtggccgaccagtactgccactactacccagagaacatcaagcccaagcccaagctgcaggagtgcaacctggacccctgcccagccagtgatggctacaagcagatcatgccctatgacctgtaccaccccctgccccgctgggaggccaccccctggacagcctgcagcagcagctgtggcggcggcatccagagcagagctgtgtcctgtgtggaggaggacatccagggccacgtgacctctgtggaggagtggaagtgcatgtacacccccaagatgcccatcgcccagccctgcaacatctttgactgccccaagtggctggcccaggagtggagcccctgcaccgtgacctgtggccagggcctgcgctacagagtggtgctgtgcatcgaccaccggggcatgcacactggaggctgcagccccaagaccaagccccacatcaaggaggagtgcatcgtgcccaccccctgctacaagcccaaggagaagctgcctgtggaggccaagctgccctggttcaagcaggcccaggagctggaggagggcgctgctgtgtctgaggagcccagcttcatccctgaggcctggagcgcctgcaccgtgacctgtggggtgggcacccaggtgcgcatcgtgcgctgccaggtgctgctgtccttcagccagagcgtggccgacctgcccattgatgaatgtgagggccccaagccagccagccagagggcctgctacgccggcccctgcagcggggagatccctgagttcaacccagatgaaacagatggcctgtttggaggcctgcaggactttgatgagctgtatgactgggagtatgagggcttcaccaagtgcagcgagagctgtggcggcggcgtgcaggaggccgtggtgtcctgcctgaacaagcagacccgggagcctgctgaggagaacctgtgtgtgaccagccggcggcccccccagctgctgaagagctgcaacctggacccctgcccagcccgctgggagatcggcaagtggagcccctgcagcctgacctgtggggtgggcctgcagaccagagatgtgttctgcagccacctgctgagccgggagatgaatgagaccgtcatcctggctgatgagctgtgccggcagcccaagcccagcacagtgcaggcctgcaaccgcttcaactgccccccagcctggtacccagcccagtggcagccctgcagcaggacctgtggcggcggcgtgcagaagcgggaggtgctgtgcaagcagaggatggctgatggcagcttcctggagctgcctgagaccttctgcagcgccagcaagccagcctgccagcaggcctgcaagaaggatgactgccccagcgagtggctgctgagtgactggacagaatgttccaccagctgtggggagggcacccagaccaggtctgccatctgcaggaagatgctgaagacaggcctgagcacagtggtgaacagcaccctgtgcccccccctgcccttcagcagcagcatccggccctgcatgctggccacctgtgcccggcccggccggcccagcaccaagcacagcccccacatcgctgctgccaggaaggtgtacatccagacccggcggcagaggaagctgcactttgtggtgggcggctttgcctacctgctgcccaagacagctgtggtgctgcgctgcccagcccggcgggtgaggaagcccctcatcacctgggagaaggatggccagcacctgatcagcagcacccacgtgacagtggcccccttcggctacctgaagatccaccggctgaagcccagtgatgctggggtgtacacctgcagcgctggccctgcccgggagcacttcgtcatcaagctgattggaggcaacaggaagctggtggcccggcccctgagccccaggtctgaggaggaggtgctggccggcaggaaaggaggccccaaggaggccctgcagacccacaagcaccagaatggcatcttcagcaatggcagcaaggccgagaagaggggcctggccgccaaccctggcagccgctatgatgacctggtgtcccggctgctggagcagggcggctggccaggagagctgctggcctcctgggaggcccaggacagcgctgagaggaacaccaccagcgaggaggaccccggggctgagcaggtgctgctgcacctgcccttcaccatggtgacagagcagaggcggctggatgacatcctgggcaacctgagccagcagcctgaggagctgcgggacctgtacagcaagcacctggtggcccagctggcccaggagatcttccgcagccacctggagcaccaggacaccctgctgaagcccagcgagaggaggaccagccctgtgaccctgagcccccacaagcacgtgtctggcttcagcagcagcctgcggaccagcagcactggagatgctgggggcggcagccggcggccccacaggaagcccaccatcctgaggaagatctctgctgcccagcagctgagcgccagcgaggtggtgacccacctgggccagacagtggccctggccagcggcaccctgtctgtgctgctgcactgtgaggccatcggccacccccggcccaccatctcctgggccagaaatggagaggaggtgcagttcagtgaccgcatcctgctgcagccagatgacagcctgcagatcctggcccctgtggaggctgatgtgggcttctacacctgcaatgccaccaatgccctgggctatgacagcgtgtccattgctgtgaccctggccggcaagcccctggtgaagaccagcaggatgaccgtcatcaacacagagaagccagctgtgacagtggacatcggcagcaccatcaagacagtgcagggcgtgaatgtgaccatcaactgccaggtggccggcgtgcctgaggccgaggtgacctggttcaggaacaagagcaagctgggcagcccccaccacctgcacgagggcagcctgctgctgaccaacgtgagcagcagtgaccagggcctgtacagctgcagagctgccaacctgcatggagagctgacagagagcacccagctgctgatcctggaccccccccaggtgcccacccagctggaggacatccgggccctgctggccgccaccggccccaacctgcccagcgtgctgaccagccccctgggcacccagctggtgctggaccccggcaacagcgccctgctgggctgccccatcaagggccaccctgtgcccaacatcacctggttccacggcggccagcccatcgtgacagccaccggcctgacccaccacatcctggccgccggccagatcctgcaggtggccaacctgagcggcggcagccagggcgagttcagctgcctggcccagaatgaagctggggtgctgatgcagaaggccagcctggtgatccaggactactggtggagcgtggaccggctggccacctgcagcgccagctgtggcaacagaggagtgcagcagccccggctgcgctgcctgctgaacagcacagaggtgaacccagcccactgtgccggcaaggtgcggcctgctgtgcagcccatcgcctgcaacagaagagactgccccagccgctggatggtgacctcctggagcgcctgcaccaggagctgtggcggcggcgtgcagacccggcgggtgacctgccagaagctgaaggccagcggcatcagcacccctgtgtccaatgacatgtgcacccaggtggccaagaggcctgtggacacccaggcctgcaaccagcagctgtgtgtggagtgggccttcagctcctggggccagtgcaatggcccctgcatcggcccccacctggccgtgcagcaccggcaggtgttctgccagaccagagatggcatcaccctgcccagcgagcagtgcagcgccctgcccaggcctgtgtccacccagaactgctggagcgaggcctgcagcgtgcactggagggtgtccctgtggaccctgtgcacagccacctgtggcaactacggcttccagagccggcgggtggagtgtgtgcacgcccggaccaacaaggctgtgcctgagcacctgtgctcctggggccccaggcctgccaactggcagcgctgcaacatcaccccctgtgagaacatggagtgccgggacaccacccgctactgtgagaaggtgaagcagctgaagctgtgccagctgagccagttcaagagccgctgctgcggcacctgtgggaaggcctag

SEQ ID NO: 142675 - DNA, 1320 bp, Artificial Sequence
  Description of Artificial Sequence: Synthetic coding sequence
atggagtgctgcagaagagccaccccaggcaccctgctgctcttcctggccttcctgctgctgagcagcaggacagcccggtctgaggaggacagagatggcctgtgggatgcctggggcccctggagcgagtgcagcaggacctgtggcggcggggccagctacagcctgcggcgctgcctgagcagcaagagctgtgagggcaggaacatccgctaccgcacctgcagcaatgtggactgccccccagaggccggggacttccgggcccagcagtgcagcgcccacaatgatgtgaagcaccacggccagttctatgagtggctgcctgtgtccaatgaccctgacaacccctgcagcctgaagtgccaggccaagggcaccaccctggtggtggagctggcccccaaggtgctggatggcacccgctgctacacagagagcctggacatgtgcatcagcggcctgtgccagatcgtgggctgtgaccaccagctgggcagcacagtgaaggaggacaactgtggggtgtgcaatggagatggcagcacctgccgcctggtgcggggccagtacaagagccagctgagcgccaccaagagtgatgacacagtggtggccatcccctacggcagccgccacatccggctggtgctgaagggccctgaccacctgtacctggagaccaagaccctgcagggcaccaagggggagaacagcctgagcagcacaggcaccttcctggtggacaacagctctgtggacttccagaagttcccagacaaggagatcctgaggatggccggccccctgacagctgacttcatcgtgaagatccggaacagcggcagcgctgacagcacagtgcagttcatcttctaccagcccatcatccaccgctggagggagacagacttcttcccctgcagcgccacctgtggcggcggctaccagctgaccagcgcagaatgttatgacctgcggagcaacagagtggtggccgaccagtactgccactactacccagagaacatcaagcccaagcccaagctgcaggagtgcaacctggacccctgcccagcccgctgggaggccaccccctggacagcctgcagcagcagctgtggcggcggcatccagagcagagctgtgtcctgtgtggaggaggacatccagggccacgtgacctctgtggaggagtggaagtgcatgtacacccccaagatgcccatcgcccagccctgcaacatctttgactgccccaagtggctggcccaggagtggagccctgtgacagtgcccagcttctttgtgcactag

SEQ ID NO: 142676 - DNA, 2856 bp, Artificial Sequence
  Description of Artificial Sequence: Synthetic coding sequence
atggatggccgctggcagtgcagctgctgggcctggttcctgctggtgctggccgtggtggccggggacacagtgtccacaggcagcacagacaacagccccaccagcaacagcctggagggcggcacagatgccacagccttctggtggggcgagtggaccaagtggacagcctgcagccgcagctgtggcggcggcgtgaccagccaggagcggcactgcctgcagcagaggaggaagtctgtgcccggccctggcaacagaacctgcaccggcaccagcaagcgctaccagctgtgccgggtgcaggagtgccccccagatggccgctccttccgggaggagcagtgtgtgtccttcaacagccacgtgtacaacggccgcacccaccagtggaagcccctgtacccagatgattatgtgcacatcagcagcaagccctgtgacctgcactgcaccaccgtggatggccagaggcagctgatggtgcctgccagagatggcaccagctgcaagctgacagacctgcggggcgtgtgtgtgtctggaaaatgtgagcccatcggctgtgatggagtgctcttcagcacccacaccctggacaagtgtggcatctgccagggagatggcagcagctgcacccacgtgactggaaactacagaaaaggaaatgcccacctgggctacagcctggtgacccacatcccagctggggcccgggacatccagatcgtggagaggaagaagtctgcagatgtgctggccctggctgatgaggccggctactacttcttcaacggcaactacaaggtggacagccccaagaacttcaacattgctggcaccgtggtgaagtacagaagacccatggatgtgtatgaaacaggaattgagtacatcgtggcccagggccccaccaaccagggcctgaatgtgatggtgtggaaccagaatggcaagagccccagcatcacctttgagtacaccctgctgcagccccctcatgagagccggccccagcccatctactacggcttcagcgagagcgctgagagccagggcctggatggagctggcctgatgggctttgtgccccacaacggcagcctgtatggccaggccagcagcgagcggctgggcctggacaacagactctttggccaccctggcctggacatggagctgggccccagccagggccaggagaccaatgaggtgtgtgagcaggccggcggcggggcctgtgagggccccccccggggcaagggcttccgggacagaaatgtgacaggcacccccctgactggagacaaggatgatgaggaggtggacacccactttgccagccaggagttcttcagcgccaatgccatcagtgaccagctgctgggcgccggcagtgacctgaaggacttcaccctgaatgaaacagtgaacagcatctttgcccagggcgcccccaggagcagcctggccgagagcttctttgtggactatgaagaaaatgaaggagctggcccctacctgctgaatggcagctacctggagctgagcagtgacagagtggccaacagcagcagcgaggcccccttccccaacgtgtccaccagcctgctgaccagcgctggcaacagaacccacaaggcccggacccggcccaaggccaggaagcagggcgtgtccccagctgacatgtaccgctggaagctgagcagccatgagccctgcagcgccacctgcaccaccggggtgatgtctgcctatgccatgtgtgtgcgctatgatggagtggaggtggatgacagctactgtgatgccctgaccaggcctgagcctgtgcatgagttctgtgccggccgggagtgccagccccgctgggagaccagctcctggagcgaatgttccaggacctgtggggagggctaccagttccgggtggtgcgctgctggaagatgctgagccctggctttgacagctctgtgtacagcgacctgtgtgaggccgctgaggccgtgcggcctgaggagaggaagacctgcagaaatcctgcctgtggcccccagtgggagatgtctgagtggagcgagtgcacagccaagtgtggggagaggtctgtggtgacccgggacatccgctgcagtgaagatgagaagctgtgtgaccccaacaccaggcctgtgggggagaagaactgcaccggccccccctgtgaccggcagtggacagtgtctgactggggcccctgcagcggcagctgtggccagggccgcaccatcagacatgtgtactgcaagaccagtgatggccgggtggtgcctgagagccagtgccagatggagaccaagcccctggccatccacccctgtggggacaagaactgcccagcccactggctggcccaggactgggagcgctgcaacaccacctgtggccggggcgtgaagaagaggctggtgctgtgcatggagctggccaacgggaagccccagaccaggagcggcccagaatgtggcctggccaagaagcccccagaggagagcacctgctttgagcggccctgcttcaagtggtacaccagcccctggagcgagtgcaccaagacctgtggggtgggcgtgaggatgagagatgtgaagtgctaccagggcacagacatcgtgcggggctgtgaccccctggtgaagcctgtgggccggcaggcctgtgacctgcagccctgccccacagagcccccagatgacagctgccaggaccagcccggcaccaactgtgccctggccatcaaggtgaacctgtgtggccactggtactacagcaaggcctgctgccgcagctgccggcccccccacagctag

SEQ ID NO: 142677 - DNA, 2856 bp, Artificial Sequence; identical to SEQ ID NO: 142676
  Description of Artificial Sequence: Synthetic coding sequence

SEQ ID NO: 142678 - DNA, 3183 bp, Artificial Sequence
  Description of Artificial Sequence: Synthetic coding sequence
atgctgtttgaggtgggggagggcggcggggccggggaggagggcaagggccggggccggcccggccgcagcctgtgcacccatgctgccccagccaggacagcccacctggcccccagcgccctgcggagcgcccggcccttcctgtgggaggacaacctgctgaccaggagccagggcctgcctgacaaccacgaccagctggtgcctgacaacctggaggcctgggccctggccggcccccggggcctcttccccaagaggaccctggtgatctggaagagaattggagctggcctggtggtgacagtggccctgctgcccaggatggatggccgctggcagtgcagctgctgggcctggttcctgctggtgctggccgtggtggccggggacacagtgtccacaggcagcacagacaacagccccaccagcaacagcctggagggcggcacagatgccacagccttctggtggggcgagtggaccaagtggacagcctgcagccgcagctgtggcggcggcgtgaccagccaggagcggcactgcctgcagcagaggaggaagtctgtgcccggccctggcaacagaacctgcaccggcaccagcaagcgctaccagctgtgccgggtgcaggagtgccccccagatggccgctccttccgggaggagcagtgtgtgtccttcaacagccacgtgtacaatggaagaacccaccagtggaagcccctgtacccagatgattatgtgcacatcagcagcaagccctgtgacctgcactgcaccaccgtggatggccagaggcagctgatggtgcctgccagagatggcaccagctgcaagctgacagacctgcggggcgtgtgtgtgtctggaaaatgtgagcccatcggctgtgatggagtgctcttcagcacccacaccctggacaagtgtggcatctgccagggagatggcagcagctgcacccacgtgacaggcaactacagaaaaggaaatgcccacctgggctacagcctggtgacccacatcccagctggggcccgggacatccagatcgtggagaggaagaagtctgcagatgtgctggccctggctgatgaagctggctactacttcttcaatggaaactacaaggtggacagccccaagaacttcaacattgctggcaccgtggtgaagtaccgccggcccatggatgtgtatgagaccggcatcgagtacatcgtggcccagggccccaccaaccagggcctgaatgtgatggtgtggaaccagaatggcaagagccccagcatcacctttgagtacaccctgctgcagccccctcatgagagccggccccagcccatctactacggcttcagcgagagcgctgagagccagggcctggatggagctggcctgatgggctttgtgccccacaacggcagcctgtatggccaggccagcagcgagcggctgggcctggacaaccggctgtttggccaccctggcctggacatggagctgggccccagccagggccaggagaccaatgaggtgtgtgagcaggccggcggcggggcctgtgagggccccccccggggcaagggcttccgggacagaaatgtgacaggcacccccctgaccggggacaaggatgatgaggaggtggacacccactttgccagccaggagttcttcagcgccaatgccatcagtgaccagctgctgggcgccggcagtgacctgaaggacttcaccctgaatgagaccgtgaacagcatctttgcccagggcgcccccaggagcagcctggccgagagcttctttgtggactatgaggagaatgaaggagctggcccctacctgctgaatggcagctacctggagctgagcagtgacagagtggccaacagcagcagcgaggcccccttccccaacgtgtccaccagcctgctgaccagcgctggcaacagaacccacaaggcccggacccggcccaaggccaggaagcagggcgtgtccccagctgacatgtaccgctggaagctgagcagccatgagccctgcagcgccacctgcaccactggagtgatgtctgcctatgccatgtgtgtgcgctatgatggagtggaggtggatgacagctactgtgatgccctgaccaggcctgagcctgtgcatgagttctgtgccggccgggagtgccagccccgctgggagaccagctcctggagcgagtgcagcaggacctgtggggagggctaccagttccgggtggtgcgctgctggaagatgctgagccctggctttgacagctctgtgtacagcgacctgtgtgaggccgctgaggccgtgcggcctgaggagaggaagacctgcaggaacccagcctgtggcccccagtgggagatgtctgagtggagcgaatgtacagccaagtgtggggagaggtctgtggtgacccgggacatccgctgcagtgaagatgagaagctgtgtgaccccaacaccaggcctgtgggggagaagaactgcaccggccccccctgtgaccggcagtggacagtgtctgactggggcccctgcagcggcagctgtggccagggccgcaccatccgccacgtgtactgcaagaccagtgatggccgggtggtgcctgagagccagtgccagatggagaccaagcccctggccatccacccctgtggggacaagaactgcccagcccactggctggcccaggactgggagcgctgcaacaccacctgtggccggggcgtgaagaagaggctggtgctgtgcatggagctggccaacgggaagccccagaccaggagcggcccagaatgtggcctggccaagaagcccccagaggagagcacctgctttgagcggccctgcttcaagtggtacaccagcccctggagcgaatgtaccaagacctgtggggtgggcgtgaggatgagagatgtgaagtgctaccagggcacagacatcgtgcggggctgtgaccccctggtgaagcctgtgggccggcaggcctgtgacctgcagccctgccccacagagcccccagatgacagctgccaggaccagcccggcaccaactgtgccctggccatcaaggtgaacctgtgtggccactggtactacagcaaggcctgctgccgcagctgcaggcctccccacagctag

SEQ ID NO: 142679 - DNA, 5076 bp, Artificial Sequence
  Description of Artificial Sequence: Synthetic coding sequence
atggcctcctggaccagcccctggtgggtgctgattggcatggtgttcatgcacagccccctgccccagaccacagctgagaagagccctggggcctacttcctgcctgagtttgccctgagcccccagggcagcttcctggaggacaccactggagagcagttcctgacctaccgctatgatgaccagaccagcaggaacaccaggagtgatgaggacaaggatggcaactgggatgcctggggagactggagcgactgcagcaggacctgtggcggcggggccagctacagcctgcggcgctgcctgaccggcaggaactgtgagggccagaacatccgctacaagacctgcagcaaccacgactgccccccagatgctgaggacttccgggcccagcagtgcagcgcctacaatgatgtgcagtaccagggccactactatgagtggctgccccgctacaatgaccctgctgccccctgtgccctgaagtgccacgcccagggccagaacctggtggtggagctggcccccaaggtgctggatggcacccgctgcaacacagacagcctggacatgtgcatcagcggcatctgccaggccgtgggctgtgaccggcagctgggcagcaatgccaaggaggacaactgtggggtgtgtgctggagatggcagcacctgccgcctggtgcggggccagagcaagagccacgtgtccccagagaagcgggaggagaatgtgattgctgtgcccctgggcagccgctctgtgcgcatcaccgtgaagggccctgcccacctgttcatcgagagcaagaccctgcagggcagcaagggggagcacagcttcaacagccctggggtcttcctggtggagaacaccaccgtggagttccagaggggcagcgagcggcagaccttcaagatccctggccccctgatggctgacttcatcttcaagacccgctacacagctgccaaggacagcgtggtgcagttcttcttctaccagcccatcagccaccagtggaggcagacagacttcttcccctgcaccgtgacctgtggcggcggctaccagctgaacagcgcagaatgtgtggacatccggctgaagagggtggtgcctgaccactactgccactactacccagaaaatgtgaagcccaagcccaagctgaaggaatgttccatggacccctgccccagcagtgatggcttcaaggagatcatgccctatgaccacttccagcccctgccccgctgggagcacaacccctggacagcctgcagcgtgtcctgtggcggcggcatccagaggaggagctttgtgtgtgtggaggagagcatgcatggagagatcctgcaggtggaggagtggaagtgcatgtatgcccccaagcccaaggtgatgcagacctgcaacctgtttgactgccccaagtggatcgccatggagtggagccagtgcaccgtgacctgtggccggggcctgcgctacagagtggtgctgtgcatcaaccacagaggagagcacgtgggcggctgcaacccccagctgaagctgcacatcaaggaggagtgtgtgatccccatcccctgctacaagcccaaggagaagagccctgtggaggccaagctgccctggctgaagcaggcccaggagctggaggagaccagaattgccacagaggagcccaccttcatccctgagccctggagcgcctgcagcaccacctgtggccctggggtgcaggtgcgggaggtgaagtgccgggtgctgctgaccttcacccagacagaaacagagctgcctgaggaggagtgtgagggccccaagctgcccacagagcggccctgcctgctggaggcctgtgatgagagccctgccagccgggagctggacatccccctgcctgaggacagcgagaccacctatgactgggagtatgccggcttcaccccctgcacagccacctgtgtgggcggccaccaggaggccatcgctgtgtgcctgcacatccagacccagcagacagtgaatgacagcctgtgtgacatggtgcaccggcccccagccatgagccaggcctgcaacacagagccctgccccccacgctggcacgtgggctcctggggcccctgcagcgccacctgtggggtgggcatccagaccagagatgtgtactgcctgcaccctggagagaccccagcccctcctgaggagtgcagagatgagaagccccacgccctgcaggcctgcaaccagtttgactgccccccaggctggcacatcgaggagtggcagcagtgcagcaggacctgtggcggcggcacccagaacagaagagtgacctgccggcagctgctgacagatggcagcttcctgaacctgagtgatgagctgtgccagggccccaaggccagcagccacaagagctgtgccaggacagactgccccccccacctggccgtgggggactggagcaagtgcagcgtgtcctgtggggtgggcatccagaggaggaagcaggtgtgccagaggctggccgccaagggccgccgcatccccctgtctgagatgatgtgccgggacctgcccggcctgcccctggtgcgcagctgccagatgccagaatgttccaagatcaagtctgagatgaagaccaagctgggggagcagggcccccagatcctgtctgtgcagagggtgtacatccagacccgggaggagaagaggatcaacctgaccatcggcagccgggcctacctgctgcccaacaccagcgtcatcatcaagtgccctgtgcggcgcttccagaagagcctcatccagtgggagaaggatggccgctgcctgcagaacagcaagaggctgggcatcaccaagagcggcagcctgaagatccacggcctggccgccccagacattggagtgtaccgctgcatcgccggcagcgcccaggagaccgtggtgctgaagctgattggaacagacaaccggctgattgcccggcctgccctgcgggagcccatgagggagtacccaggcatggaccacagcgaggccaacagcctgggcgtgacctggcacaagatgaggcagatgtggaacaacaagaatgacctgtacctggatgatgaccacatcagcaaccagcccttcctgcgggccctgctgggccactgcagcaacagcgctggcagcaccaacagctgggagctgaagaacaagcagtttgaggccgctgtgaagcagggcgcctacagcatggacacagcccagtttgatgagctgatccggaacatgagccagctgatggagactggagaggtgtctgatgacctggccagccagctgatctaccagctggtggccgagctggccaaggcccagcccacccacatgcagtggaggggcatccaggaggagaccccacctgctgcccagctgcggggggagactggatctgtgtcccagagcagccacgccaagaacagcggcaagctgaccttcaagcccaagggccctgtgctgatgaggcagagccagcccccatccatctccttcaacaagaccatcaacagccgcatcggcaacacagtgtacatcaccaagaggacagaggtgatcaacatcctgtgtgacctgatcaccccatctgaggccacctacacctggaccaaggatggcaccctgctgcagcccagcgtgaagatcatcctggatggcaccgggaagatccagatccagaaccccaccaggaaggagcagggcatctatgagtgcagcgtggccaaccacctgggcagtgatgtggagagcagctctgtgctgtatgcagaggcccctgtgatcctgtctgtggagaggaacatcaccaagccagagcacaaccacctgtctgtggtggtgggcggcatcgtggaggccgccctgggcgccaacgtgaccatccgctgccctgtgaagggcgtgccccagcccaacatcacctggctgaagagaggaggcagcctgtctggaaatgtgtccctgctcttcaacggcagcctgctgctgcagaatgtgtccctggagaatgaaggcacctacgtgtgcatcgccaccaatgccctgggcaaggctgtggccacctctgtgctgcacctgctggagcggcgctggccagagagccgcatcgtgttcctgcagggccacaagaagtacatcctgcaggccaccaacaccaggaccaacagcaatgaccccaccggggagcccccaccccaggagcccttctgggagcccggcaactggagccactgcagcgccacctgtggccacctgggcgcccgcatccagaggccccagtgtgtgatggccaacggccaggaggtgtctgaggccctgtgtgaccacctgcagaagcccctggccggctttgagccctgcaacatccgggactgcccagcccgctggttcacctctgtgtggagccagtgcagcgtgtcctgtggggagggctaccacagccggcaggtgacctgcaagaggaccaaggccaacggcaccgtgcaggtggtgagcccccgggcctgtgcccccaaggaccggcccctgggcaggaagccctgcttcggccacccctgtgtgcagtgggagcccggcaaccgctgccccggccgctgcatgggccgggctgtgaggatgcagcagaggcacacagcctgccagcacaacagcagtgacagcaactgtgatgacaggaagaggcccaccctgcggaggaactgcaccagcggggcctgtgatgtgtgctggcacacaggcccctggaagccctgcacagctgcctgtggccggggcttccagagcaggaaggtggactgcatccacaccaggagctgcaagcctgtggccaagaggcactgtgtgcagaagaagaagcccatctcctggaggcactgcctgggccccagctgtgaccgggactgcacagacaccacccactactgcatgtttgtgaagcacctgaacctgtgcagcctggaccgctacaagcagcgctgctgccagagctgccaggagggctag

SEQ ID NO: 142680 - DNA, 3225 bp, Artificial Sequence
  Description of Artificial Sequence: Synthetic coding sequence
atggagaactggacaggccggccctggctgtacctgctgctgctgctgagcctgccccagctgtgcctggaccaggaggtgctgagcggccacagcctgcagacccccacagaggagggccagggccctgagggcgtgtggggcccctgggtgcagtgggccagctgcagccagccctgtggggtgggcgtgcagaggaggagcaggacctgccagctgcccaccgtgcagctgcaccccagcctgcccctgcccccccggccccccaggcaccctgaggccctgctgccccggggccagggcccccggccccagaccagccctgagaccctgcccctgtaccgcacccagagccggggccggggcggccccctgcggggccctgccagccacctgggccgggaggagacccaggagatccgggccgcccggcgcagccggctgcgggaccccatcaagccaggcatgtttggctacggccgggtgccctttgccctgcccctgcacaggaacagaagacaccccaggagcccccccaggtctgagctgagcctcatcagcagcagaggagaggaggccatccccagccccacccccagggctgagcccttcagcgccaacggcagcccccagacagagctgcccccaacagagctgtctgtgcacacccccagcccccaggccgagcccctgagccctgagacagcccagacagaggtggcccccaggaccaggcctgcccccctgcggcaccacccccgggcccaggccagcggcacagagccccccagccccacccacagcctgggggagggcggcttcttccgggccagcccccagccccggcggcccagcagccagggctgggccagcccccaggtggccggcagaagaccagaccccttccccagcgtgccccggggccggggccagcagggccagggcccctggggcactggaggcaccccccacggcccccggctggagccagacccccagcaccctggggcctggctgcccctgctgagcaatggcccccacgccagcagcctgtggagcctgtttgcccccagcagccccatcccccgctgcagcggggagagcgagcagctgcgggcctgcagccaggccccctgccccccagagcagcctgacccccgggccctgcagtgtgccgccttcaacagccaggagttcatgggccagctgtaccagtgggagcccttcacagaggtgcagggcagccagagatgtgagctgaactgccggccccggggcttccgcttctacgtgcgccacacagagaaggtgcaggacggcaccctgtgccagcccggggccccagacatctgtgtggccggccgctgcctgagccctggctgtgatggcatcctgggcagcggcagaagaccagatggctgcggcgtgtgtggaggagatgacagcacctgccgcctggtgtctggcaacctgacagacagaggaggccccctgggctaccagaagatcctgtggatcccagctggggccctgcggctgcagatcgcccagctgcggcccagcagcaactacctggccctgcggggccctgggggccgcagcatcatcaatggaaactgggccgtggaccccccaggcagctaccgggccggcggcaccgtcttccgctacaaccggcccccccgggaggagggcaagggggagagcctgtctgctgagggccccaccacccagcctgtggatgtgtacatgatcttccaggaggagaaccctggggtcttctaccagtatgtgatcagcagccccccacccatcctggagaaccccaccccagagccccctgtgccccagctgcagcctgagatcctgcgggtggagccccccctggccccagcccccaggcctgcccggaccccaggcaccctgcagaggcaggtgcgcatcccccagatgcctgccccaccccaccccaggacccccctgggcagccctgctgcctactggaagagggtgggccacagcgcctgcagcgccagctgtgggaagggcgtgtggaggcccatcttcctgtgcatcagccgggagagcggggaggagctggatgagaggagctgtgccgccggggcccggcccccagccagccctgagccctgccacggcaccccctgccccccctactgggaggccggggagtggaccagctgcagccgcagctgtggccctggcacccagcaccggcagctgcagtgccggcaggagtttggaggcggcggcagctctgtgcccccagagcgctgtggccacctgccccggcccaacatcacccagagctgccagctgcggctgtgtggccactgggaggtgggcagcccctggagccagtgcagcgtgcgctgtggccggggccagaggagccggcaggtgcgctgtgtgggcaacaatggagatgaggtgtctgagcaggagtgtgccagcggccccccccagccccccagccgggaggcctgtgacatgggcccctgcaccacagcctggttccacagcgactggagcagcaaatgttctgcagaatgtggcaccggcatccagaggagatctgtggtgtgcctgggcagcggggccgccctgggccctggccagggcgaggccggggccggcaccggccagagctgccccaccggcagccggcccccagacatgagggcctgcagcctgggcccctgtgagaggacctggcgctggtacacaggcccctggggagaatgttccagtgaatgtggcagcggcacccagaggcgggacatcatctgtgtgtccaagctgggcacagagttcaacgtgaccagccccagcaactgcagccacctgccccggcccccagccctgcagccctgccagggccaggcctgccaggaccgctggttcagcaccccctggagcccctgcagccgcagctgccagggcggcacccagacccgggaggtgcagtgcctgagcaccaaccagaccctgagcacccgctgccccccccagctgcggcccagcaggaagaggccctgcaacagccagccctgcagccagaggccagatgaccagtgcaaggacagcagcccccactgccccctggtggtgcaggcccggctgtgtgtgtacccctactacacagccacctgctgccgcagctgtgcccacgtgctggagaggagcccccaggaccccagctag

SEQ ID NO: 142681 - DNA, 3225 bp, Artificial Sequence; identical to SEQ ID NO: 142680
  Description of Artificial Sequence: Synthetic coding sequence

SEQ ID NO: 142682 - DNA, 3294 bp, Artificial Sequence
  Description of Artificial Sequence: Synthetic coding sequence
atggagaactggacaggccggccctggctgtacctgctgctgctgctgagcctgccccagctgtgcctggaccaggaggtgctgagcggccacagcctgcagacccccacagaggagggccagggccctgagggcgtgtggggcccctgggtgcagtgggccagctgcagccagccctgtggggtgggcgtgcagaggaggagcaggacctgccagctgcccaccgtgcagctgcaccccagcctgcccctgcccccccggccccccaggcaccctgaggccctgctgccccggggccagggcccccggccccagaccagccctgagaccctgcccctgtaccgcacccagagccggggccggggcggccccctgcggggccctgccagccacctgggccgggaggagacccaggagatccgggccgcccggcgcagccggctgcgggaccccatcaagccaggcatgtttggctacggccgggtgccctttgccctgcccctgcacaggaacagaagacaccccaggagcccccccaggtctgagctgagcctcatcagcagcagaggagaggaggccatccccagccccacccccagggctgagcccttcagcgccaacggcagcccccagacagagctgcccccaacagagctgtctgtgcacacccccagcccccaggccgagcccctgagccctgagacagcccagacagaggtggcccccaggaccaggcctgcccccctgcggcaccacccccgggcccaggccagcggcacagagccccccagccccacccacagcctgggggagggcggcttcttccgggccagcccccagccccggcggcccagcagccagggctgggccagcccccaggtggccggcagaagaccagaccccttccccagcgtgccccggggccggggccagcagggccagggcccctggggcactggaggcaccccccacggcccccggctggagccagacccccagcaccctggggcctggctgcccctgctgagcaatggcccccacgccagcagcctgtggagcctgtttgcccccagcagccccatcccccgctgcagcggggagagcgagcagctgcgggcctgcagccaggccccctgccccccagagcagcctgacccccgggccctgcagtgtgccgccttcaacagccaggagttcatgggccagctgtaccagtgggagcccttcacagaggcccccctgctgcccctgcggcatgccttcttcctgctgcctggagctggcagcggggacagcactggagtgcagggcagccagagatgtgagctgaactgccggccccggggcttccgcttctacgtgcgccacacagagaaggtgcaggacggcaccctgtgccagcccggggccccagacatctgtgtggccggccgctgcctgagccctggctgtgatggcatcctgggcagcggccggcggccagatggctgcggcgtgtgtggaggagatgacagcacctgccgcctggtgtctggcaacctgacagaccggggcggccccctgggctaccagaagatcctgtggatcccagctggggccctgcggctgcagatcgcccagctgcggcccagcagcaactacctggccctgcggggccctgggggccgcagcatcatcaatggaaactgggccgtggaccccccaggcagctacagagctgggggcaccgtcttccgctacaacagaccaccccgggaggagggcaaaggagagagcctgtctgctgagggccccaccacccagcctgtggatgtgtacatgatcttccaggaggagaaccctggggtcttctaccagtatgtgatcagcagccccccacccatcctggagaaccccaccccagagccccctgtgccccagctgcagcctgagatcctgcgggtggagccccccctggccccagcccccaggcctgcccggaccccaggcaccctgcagaggcaggtgcgcatcccccagatgcctgccccaccccaccccaggacccccctgggcagccctgctgcctactggaagagggtgggccacagcgcctgcagcgccagctgtgggaaaggagtgtggaggcccatcttcctgtgcatcagccgggagagcggggaggagctggatgagaggagctgtgccgccggggcccggcccccagccagccctgagccctgccacggcaccccctgccccccctactgggaggccggggagtggaccagctgcagccgcagctgtggccctggcacccagcaccggcagctgcagtgccggcaggagtttggaggcggcggcagctctgtgcccccagagcgctgtggccacctgccccggcccaacatcacccagagctgccagctgcggctgtgtggccactgggaggtgggcagcccctggagccagtgcagcgtgcgctgtggccggggccagaggagccggcaggtgcgctgtgtgggcaacaatggagatgaggtgtctgagcaggagtgtgccagcggccccccccagccccccagccgggaggcctgtgacatgggcccctgcaccacagcctggttccacagcgactggagcagcaagtgcagcgcagaatgtggcaccggcatccagaggagatctgtggtgtgcctgggcagcggggccgccctgggccctggccagggcgaggccggggccggcaccggccagagctgccccaccggcagccggcccccagacatgagggcctgcagcctgggcccctgtgagaggacctggcgctggtacacaggcccctggggcgagtgcagcagtgaatgtggcagcggcacccagaggcgggacatcatctgtgtgtccaagctgggcacagagttcaacgtgaccagccccagcaactgcagccacctgccccggcccccagccctgcagccctgccagggccaggcctgccaggaccgctggttcagcaccccctggagcccctgcagccgcagctgccagggcggcacccagacccgggaggtgcagtgcctgagcaccaaccagaccctgagcacccgctgccccccccagctgcggcccagcaggaagaggccctgcaacagccagccctgcagccagaggccagatgaccagtgcaaggacagcagcccccactgccccctggtggtgcaggcccggctgtgtgtgtacccctactacacagccacctgctgccgcagctgtgcccacgtgctggagaggagcccccaggaccccagctag

SEQ ID NO: 142683 - DNA, 2634 bp, Artificial Sequence
  Description of Artificial Sequence: Synthetic coding sequence
atggagaactggacaggccggccctggctgtacctgctgctgctgctgagcctgccccagctgtgcctggaccaggaggtgctgagcggccacagcctgcagacccccacagaggagggccagggccctgagggcgtgtggggcccctgggtgcagtgggccagctgcagccagccctgtggggtgggcgtgcagaggaggagcaggacctgccagctgcccaccgtgcagctgcaccccagcctgcccctgcccccccggccccccaggcaccctgaggccctgctgccccggggccagggcccccggccccagaccagccctgagaccctgcccctgtaccgcacccagagccggggccggggcggccccctgcggggccctgccagccacctgggccgggaggagacccaggagatccgggccgcccggcgcagccggctgcgggaccccatcaagccaggcatgtttggctacggccgggtgccctttgccctgcccctgcacaggaacagaagacaccccaggagcccccccaggtctgagctgagcctcatcagcagcagaggagaggaggccatccccagccccacccccagggctgagcccttcagcgccaacggcagcccccagacagagctgcccccaacagagctgtctgtgcacacccccagcccccaggccgagcccctgagccctgagacagcccagacagaggtggcccccaggaccaggcctgcccccctgcggcaccacccccgggcccaggccagcggcacagagccccccagccccacccacagcctgggggagggcggcttcttccgggccagcccccagccccggcggcccagcagccagggctgggccagcccccaggtggccggcagaagaccagaccccttccccagcgtgccccggggccggggccagcagggccagggcccctggggcactggaggcaccccccacggcccccggctggagccagacccccagcaccctggggcctggctgcccctgctgagcaatggcccccacgccagcagcctgtggagcctgtttgcccccagcagccccatcccccgctgcagcggggagagcgagcagctgcgggcctgcagccaggccccctgccccccagagcagcctgacccccgggccctgcagtgtgccgccttcaacagccaggagttcatgggccagctgtaccagtgggagcccttcacagaggtgcagggcagccagagatgtgagctgaactgccggccccggggcttccgcttctacgtgcgccacacagagaaggtgcaggacggcaccctgtgccagcccggggccccagacatctgtgtggccggccgctgcctgagccctggctgtgatggcatcctgggcagcggcagaagaccagatggctgcggcgtgtgtggaggagatgacagcacctgccgcctggtgtctggcaacctgacagacagaggaggccccctgggctaccagaagatcctgtggatcccagctggggccctgcggctgcagatcgcccagctgcggcccagcagcaactacctggccctgcggggccctgggggccgcagcatcatcaatggaaactgggccgtggaccccccaggcagctaccgggccggcggcaccgtcttccgctacaaccggcccccccgggaggagggcaagggggagagcctgtctgctgagggccccaccacccagcctgtggatgtgtacatgatcttccaggaggagaaccctggggtcttctaccagtatgtgatcagcagccccccacccatcctggagaaccccaccccagagccccctgtgccccagctgcagcctgagatcctgcgggtggagccccccctggccccagcccccaggcctgcccggaccccaggcaccctgcagaggcaggtgcgcatcccccagatgcctgccccaccccaccccaggacccccctgggcagccctgctgcctactggaagagggtgggccacagcgcctgcagcgccagctgtgggaagggcgtgtggaggcccatcttcctgtgcatcagccgggagagcggggaggagctggatgagaggagctgtgccgccggggcccggcccccagccagccctgagccctgccacggcaccccctgccccccctactgggaggccggggagtggaccagctgcagccgcagctgtggccctggcacccagcaccggcagctgcagtgccggcaggagtttggaggcggcggcagctctgtgcccccagagcgctgtggccacctgccccggcccaacatcacccagagctgccagctgcggctgtgtggccactgggaggtgggcagcccctggagccagtgcagcgtgcgctgtggccggggccagaggagccggcaggtgcgctgtgtgggcaacaatggagatgaggtgtctgagcaggagtgtgccagcggccccccccagccccccagccgggaggcctgtgacatgggcccctgcaccacagcctggttccacagcgactggagcagcaaggtgtccccagagcccccagccatcagctgcatcctgggcaaccacgcccaggacaccagcgccttccctgcctag

SEQ ID NO: 142684 - DNA, 1311 bp, Artificial Sequence
  Description of Artificial Sequence: Synthetic coding sequence
atgggcagcctggccctggccggcgtgctgatggctgtggagagcgtgggcgtgatgatcctgcctgtggccctcttccggggcaccagcctgacagagggcgccccctgggccatccgccgcagctgtggcttccagcgggagccctgtggcagccggctgcccagcagcggcctggcccccaccacctggcactttgtggccctgggccgcagcatcatcaatggaaactgggccgtggaccccccaggcagctaccgggccggcggcaccgtcttccgctacaaccggcccccccgggaggagggcaagggggagagcctgtctgctgagggccccaccacccagcctgtggatgtgtacatgatcttccaggaggagaaccctggggtcttctaccagtatgtgatcagcagccccccacccatcctggagaaccccaccccagagccccctgtgccccagctgcagcctgagatcctgcgggtggagccccccctggccccagcccccaggcctgcccggaccccaggcaccctgcagaggcaggtgcgcatcccccagatgcctgccccaccccaccccaggacccccctgggcagccctgctgcctactggaagagggtgggccacagcgcctgcagcgccagctgtgggaagggcgtgtggaggcccatcttcctgtgcatcagccgggagagcggggaggagctggatgagaggagctgtgccgccggggcccggcccccagccagccctgagccctgccacggcaccccctgccccccctactgggaggccggggagtggaccagctgcagccgcagctgtggccctggcacccagcaccggcagctgcagtgccggcaggagtttggaggcggcggcagctctgtgcccccagagcgctgtggccacctgccccggcccaacatcacccagagctgccagctgcggctgtgtggccactgggaggtgggcagcccctggagccagtgcagcgtgcgctgtggccggggccagaggagccggcaggtgcgctgtgtgggcaacaatggagatgaggtgtctgagcaggagtgtgccagcggccccccccagccccccagccgggaggcctgtgacatgggcccctgcaccacagcctggttccacagcgactggagcagcaaatgttctgcagaatgtggcaccggcatccagaggagatctgtggtgtgcctgggcagcggggccgccctgggccctggccagggcgaggccggggccggcaccggccagagctgccccaccggcagcaggcctccttag

SEQ ID NO: 142685 - DNA, 2130 bp, Artificial Sequence
  Description of Artificial Sequence: Synthetic coding sequence
atgcctggcatcgacaagctgcccatcgaggagaccctggaggacagcccccagaccaggagcctgctgggcgtgtttgaggaggatgccacagccatcagcaactacatgaaccagctgtaccaggccatgcaccgcatctatgatgcccagaatgagctgtctgctgccacccacctgaccagcaagctgctgaaggagtatgagaagcagcgcttccccctgggcggagatgatgaggtgatgagcagcaccctgcagcagttcagcaaggtgattgatgagctgagcagctgccacgctgtgctgagcacccagctggctgatgccatgatgttccccatcacccagttcaaggagcgggacctgaaggagatcctgaccctgaaggaggtgttccagatcgccagcaatgaccatgatgctgccatcaaccgctacagccggctgagcaagaagagagaaaatgacaaggtgaagtatgaggtgacagaagatgtgtacaccagcaggaagaagcagcaccagaccatgatgcactacttctgtgccctgaacaccctgcagtacaagaagaagatcgccctgctggagcccctgctgggctacatgcaggcccagatctccttcttcaagatgggcagcgagaacctgaatgagcagctggaggagttcctggccaacatcggcacctctgtgcagaatgtgagaagagagatggacagcgacatcgagaccatgcagcagaccatcgaggacctggaggtggccagtgaccccctgtatgtgcctgaccctgaccccaccaagtttcctgtgaacagaaacctgaccaggaaggccggctacctgaatgccaggaacaagacaggcctggtgagcagcacctgggaccggcagttctacttcacccagggcggcaacctgatgagccaggcccggggagatgtggccggcggcctggccatggacatcgacaactgcagcgtgatggctgtggactgtgaggaccggcgctactgcttccagatcaccagctttgatggcaagaagagcagcatcctgcaggccgagagcaagaaggaccacgaggagtggatctgcaccatcaacaacatcagcaagcagatctacctgtctgaaaatcctgaggagacagctgcccgggtgaaccagagcgccctggaggccgtgacccccagccccagcttccagcagagacatgagagcctgcggcctgctgctggccagagccggcccccaacagcccggaccagcagcagcggcagcctgggcagcgagagcaccaacctggccgccctgagcctggacagcctggtggccccagacacccccatccagtttgacatcatcagccctgtgtgtgaggaccagcccggccaggccaaggccttcggccagggcggccgccgcaccaacccctttggagagagcggcggcagcaccaagtcagaaacagaggacagcatcctgcaccagctgttcatcgtgcgcttcctgggctccatggaggtgaagagtgatgaccacccagatgtggtgtatgagaccatgaggcagatcctggccgcccgggccatccacaacatcttcaggatgacagagagccacctgctggtgacctgtgactgcctgaagctgattgacccccagacccaggtgacccggctgaccttccccctgccctgtgtggtgctgtatgccacccaccaggagaacaagaggctgtttggatttgtgctgcggaccagcagcggccgctctgagagcaacctgagctctgtgtgctacatctttgagagcaacaatgaaggagagaagatctgtgacagcgtgggcctggccaagcagatcgccctgcatgctgagctggacagaagagccagcgagaagcagaaggagattgaaagagtgaaggagaagcagcagaaggagctgaacaagcagaagcagatcgagaaggacctggaggagcagagccggctgattgctgccagcagccggcccaaccaggccagcagcgagggccagtttgtggtgctgagcagcagccagagcgaggagagtgacctgggggagggcggcaagaagcgggagagcgaggcctag

SEQ ID NO: 142686 - DNA, 1995 bp, Artificial Sequence
  Description of Artificial Sequence: Synthetic coding sequence
atgcctgctgtggacaagctgctgctggaggaggccctgcaggacagcccccagaccaggagcctgctgtctgtgtttgaggaggatgctggcaccctgacagactacaccaaccagctgctgcaggccatgcagagggtgtatggagcccagaatgagatgtgcctggccacccagcagctgagcaagcagctgctggcctatgagaagcagaactttgccctgggcaaaggagatgaggaggtgatcagcaccctgcactacttcagcaaggtggtggatgagctgaacctgctgcacacagagctggccaagcagctggccgacaccatggtgctgcccatcatccagttccgggagaaggacctgacagaggtgtccaccctgaaggacctgtttggcctggccagcaatgaacatgacctgtccatggccaagtacagccggctgcccaagaagaaggaaaatgagaaggtgaagacagaggtgggcaaggaggtggccgccgcccggaggaagcagcacctgagcagcctgcagtactactgtgccctgaatgccctgcagtacaggaagcagatggccatgatggagcccatgattggatttgcccacggccagatcaacttcttcaagaagggagctgagatgttcagcaagaggatggacagcttcctgagctctgtggccgacatggtgcagagcatccaggtggagctggaggccgaggccgagaagatgagggtgtcccagcaggagctgctgtctgtggatgagagcgtgtacaccccagacagtgatgtggccgccccccagatcaacagaaacctgatccagaaggccggctacctgaacctgaggaacaagacaggcctggtgaccaccacctgggagcggctgtacttcttcacccagggcggcaacctgatgtgccagcccagaggagctgtggccggcggcctcatccaggacctggacaactgcagcgtgatggctgtggactgtgaggaccggcgctactgcttccagatcaccacccccaacgggaagagcggcatcatcctgcaggccgagagcaggaaagaaaatgaggagtggatctgtgccatcaacaacatcagccggcagatctacctgacagacaaccctgaggccgtggccatcaagctgaaccagacagccctgcaggccgtgacccccatcaccagctttgggaagaagcaggagagcagctgccccagccagaacctgaagaacagcgagatggagaatgaaaatgacaagatcgtgcccaaggccacagccagcctgcctgaggccgaggagctgattgcccctggcacccccatccagtttgacatcgtgctgcctgccacagagttcctggaccagaacagaggcagcaggaggaccaacccctttggagaaacagaagatgagagcttccctgaggccgaggacagcctgctgcagcagatgtttattgtgcgcttcctgggctccatggctgtgaagacagacagcaccacagaggtgatctatgaggccatgaggcaggtgctggccgcccgggccatccacaacatcttcaggatgacagagagccacctgatggtgaccagccagagcctgcggctgattgacccccagacccaggtgtcccgggccaactttgagctgacctctgtgacccagtttgctgcccaccaggagaacaagaggctggtgggcttcgtcatccgggtgcctgagagcactggagaggagagcctgagcacctacatctttgagagcaacagcgagggggagaagatctgctacgccatcaacctgggcaaggagatcatcgaggtgcagaaggaccctgaggccctggcccagctgatgctgagcatccccctgaccaatgatggcaagtatgtgctgctgaatgaccagccagatgatgatgatggcaaccccaatgagcacagaggagctgagagcgaggcctag

SEQ ID NO: 142687 - DNA, 2013 bp, Artificial Sequence
  Description of Artificial Sequence: Synthetic coding sequence
atgcctgctgtggacaagctgctgctggaggaggccctgcaggacagcccccagaccaggagcctgctgtctgtgtttgaggaggatgctggcaccctgacagactacaccaaccagctgctgcaggccatgcagagggtgtatggagcccagaatgagatgtgcctggccacccagcagctgagcaagcagctgctggcctatgagaagcagaactttgccctgggcaaaggagatgaggaggtgatcagcaccctgcactacttcagcaaggtggtggatgagctgaacctgctgcacacagagctggccaagcagctggccgacaccatggtgctgcccatcatccagttccgggagaaggacctgacagaggtgtccaccctgaaggacctgtttggcctggccagcaatgatgtgtgcctcttcctggagcatgacctgtccatggccaagtacagccggctgcccaagaagaaggaaaatgagaaggtgaagacagaggtgggcaaggaggtggccgccgcccggaggaagcagcacctgagcagcctgcagtactactgtgccctgaatgccctgcagtacaggaagcagatggccatgatggagcccatgattggatttgcccacggccagatcaacttcttcaagaagggagctgagatgttcagcaagaggatggacagcttcctgagctctgtggccgacatggtgcagagcatccaggtggagctggaggccgaggccgagaagatgagggtgtcccagcaggagctgctgtctgtggatgagagcgtgtacaccccagacagtgatgtggccgccccccagatcaacagaaacctgatccagaaggccggctacctgaacctgaggaacaagacaggcctggtgaccaccacctgggagcggctgtacttcttcacccagggcggcaacctgatgtgccagcccagaggagctgtggccggcggcctcatccaggacctggacaactgcagcgtgatggctgtggactgtgaggaccggcgctactgcttccagatcaccacccccaacgggaagagcggcatcatcctgcaggccgagagcaggaaagaaaatgaggagtggatctgtgccatcaacaacatcagccggcagatctacctgacagacaaccctgaggccgtggccatcaagctgaaccagacagccctgcaggccgtgacccccatcaccagctttgggaagaagcaggagagcagctgccccagccagaacctgaagaacagcgagatggagaatgaaaatgacaagatcgtgcccaaggccacagccagcctgcctgaggccgaggagctgattgcccctggcacccccatccagtttgacatcgtgctgcctgccacagagttcctggaccagaacagaggcagcaggaggaccaacccctttggagaaacagaagatgagagcttccctgaggccgaggacagcctgctgcagcagatgtttattgtgcgcttcctgggctccatggctgtgaagacagacagcaccacagaggtgatctatgaggccatgaggcaggtgctggccgcccgggccatccacaacatcttcaggatgacagagagccacctgatggtgaccagccagagcctgcggctgattgacccccagacccaggtgtcccgggccaactttgagctgacctctgtgacccagtttgctgcccaccaggagaacaagaggctggtgggcttcgtcatccgggtgcctgagagcactggagaggagagcctgagcacctacatctttgagagcaacagcgagggggagaagatctgctacgccatcaacctgggcaaggagatcatcgaggtgcagaaggaccctgaggccctggcccagctgatgctgagcatccccctgaccaatgatggcaagtatgtgctgctgaatgaccagccagatgatgatgatggcaaccccaatgagcacagaggagctgagagcgaggcctag

SEQ ID NO: 142688 - DNA, 2760 bp, Artificial Sequence
  Description of Artificial Sequence: Synthetic coding sequence
atgacagacagcaagtacttcaccaccaccaagaagggggagatctttgagctgaaggccgagctgaacagcgacaagaaggagaagaagaaggaggccgtgaagaaggtgattgcctccatgacagtgggcaaggatgtgtctgccctcttcccagatgtggtgaactgcatgcagacagacaacctggagctgaagaagctggtgtacctgtacctgatgaactatgccaagagccagcctgacatggccatcatggctgtgaacacctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagctggtggaggaccagggcttcctggacaccctgaaggacctgatcagtgacagcaaccccatggtggtggccaatgctgtggccgccctgtctgaaattgctgagagccaccccagcagcaacctgctggacctgaacccccagagcatcaacaagctgctgacagccctgaatgaatgtacagagtggggccagatcttcatcctggactgcctggccaactacatgcccaaggatgaccgggaggcccagagcatctgtgagcgggtgaccccccggctgagccacgccaacagcgctgtggtgctgtctgctgtgaaggtgctgatgaagttcatggagatgctgagcaaggacctggactactacggcaccctgctgaagaagctggccccacccctggtgaccctgctgtctgctgagcctgagctgcagtatgtggccctgaggaacatcaacctgattgtgcagaagaggcctgagatcctgaagcatgagatgaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatcaaggacatcttcaggaagtaccccaacaagtatgaatctgtgattgccaccctgtgtgagaacctggacagcctggatgagcctgaggcccgggccgccatgatctggatcgtgggggagtatgcagagagaattgacaatgctgatgagctgctggagagcttcctggagggcttccatgatgagagcacccaggtgcagctgcagctgctgacagccatcgtgaagctgttcctgaagaagcccacagagacccaggagctggtgcagcaggtgctgagcctggccacccaggacagcgacaacccagacctgcgggaccggggctacatctactggaggctgctgagcacagatcctgtggccgccaaggaggtggtgctggccgagaagcccctcatcagcgaggagacagacctgattgagcccaccctgctggatgagctgatctgctacatcggcaccctggcctctgtgtaccacaagcccccatctgcctttgtggagggcggccggggcgtggtgcacaagagcctgccccccaggacagccagcagcgagagcgctgagagccctgagacagcccccactggagcccctcctggagagcagccagatgtgatcccagcccagggcgacctgctgggggacctgctgaacctggacctgggcccccctgtgtctggcccccccctggccaccagctctgtgcagatgggcgctgtggacctgctgggcggcggcctggacagcctgattggaggcaccaactttgtggccccacccacagctgctgtgcctgccaacctgggcgcccccatcggcagcggcctgagtgacctgtttgacctgaccagcggcgtgggcaccctgagcggcagctatgtggcccccaaggctgtgggcagcatctccatggacctgcagctgaccaacaaggccctgcaggtgatgacagactttgccatccagttcaacagaaattcctttggcctggccccagccacccccctgcaggtgcacgcccccctgagccccaaccagacagtggagatcagcctgcccctgagcacagtgggctctgtgatgaagatggagcccctgaacaacctgcaggtggccgtgaagaacaacattgatgtgttctacttcagcaccctgtaccccctgcacatcctgtttgtggaggatggcaagatggaccggcagatgttcctggccacctggaaggacatccccaatgaaaatgaggcccagttccagatccgggactgccccctgaatgctgaggccgccagcagcaagctgcagagcagcaacatcttcaccgtggccaagagaaatgtggagggccaggacatgctgtaccagagcctgaagctgaccaacggcatctgggtgctggccgagctgcgcatccagcccggcaaccccagctgcaccctgagcctgaagtgccgggcccctgaggtgtcccagcacgtgtaccaggcctatgagaccatcctgaagaactag

SEQ ID NO: 142689 - DNA, 2829 bp, Artificial Sequence
  Description of Artificial Sequence: Synthetic coding sequence
atgacagacagcaagtacttcaccaccaccaagaagggggagatctttgagctgaaggccgagctgaacagcgacaagaaggagaagaagaaggaggccgtgaagaaggtgattgcctccatgacagtgggcaaggatgtgtctgccctcttcccagatgtggtgaactgcatgcagacagacaacctggagctgaagaagctggtgtacctgtacctgatgaactatgccaagagccagcctgacatggccatcatggctgtgaacacctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagctggtggaggaccagggcttcctggacaccctgaaggacctgatcagtgacagcaaccccatggtggtggccaatgctgtggccgccctgtctgaaattgctgagagccaccccagcagcaacctgctggacctgaacccccagagcatcaacaagctgctgacagccctgaatgaatgtacagagtggggccagatcttcatcctggactgcctggccaactacatgcccaaggatgaccgggaggcccagagcatctgtgagcgggtgaccccccggctgagccacgccaacagcgctgtggtgctgtctgctgtgaaggtgctgatgaagttcatggagatgctgagcaaggacctggactactacggcaccctgctgaagaagctggccccacccctggtgaccctgctgtctgctgagcctgagctgcagtatgtggccctgaggaacatcaacctgattgtgcagaagaggcctgagatcctgaagcatgagatgaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatcaaggacatcttcaggaagtaccccaacaagtatgaatctgtgattgccaccctgtgtgagaacctggacagcctggatgagcctgaggcccgggccgccatgatctggatcgtgggggagtatgcagagagaattgacaatgctgatgagctgctggagagcttcctggagggcttccatgatgagagcacccaggtgcagctgcagctgctgacagccatcgtgaagctgttcctgaagaagcccacagagacccaggagctggtgcagcaggtgctgagcctggccacccaggacagcgacaacccagacctgcgggaccggggctacatctactggaggctgctgagcacagatcctgtggccgccaaggaggtggtgctggccgagaagcccctcatcagcgaggagacagacctgattgagcccaccctgctggatgagctgatctgctacatcggcaccctggcctctgtgtaccacaagcccccatctgcctttgtggagggcggccggggcgtggtgcacaagagcctgccccccaggacagccagcagcgagagcgctgagagccctgagacagcccccactggagcccctcctggagagcagccagatgtgatcccagcccagggcgacctgctgggggacctgctgaacctggacctgggcccccctgtgtctggcccccccctggccaccagctctgtgcagatgggcgctgtggacctgctgggcggcggcctggacagcctgattggaggcaccaactttgtggccccacccacagctgctgtgcctgccaacctgggcgcccccatcggcagcggcctgagtgacctgtttgacctgaccagcggcgtgggcaccctgagcggcagctatgtggcccccaaggctgtgtggctgcctgccatgaaggccaagggcctggagatcagcggcaccttcacccggcaggtgggcagcatctccatggacctgcagctgaccaacaaggccctgcaggtgatgacagactttgccatccagttcaacagaaattcctttggcctggccccagccacccccctgcaggtgcacgcccccctgagccccaaccagacagtggagatcagcctgcccctgagcacagtgggctctgtgatgaagatggagcccctgaacaacctgcaggtggccgtgaagaacaacattgatgtgttctacttcagcaccctgtaccccctgcacatcctgtttgtggaggatggcaagatggaccggcagatgttcctggccacctggaaggacatccccaatgaaaatgaggcccagttccagatccgggactgccccctgaatgctgaggccgccagcagcaagctgcagagcagcaacatcttcaccgtggccaagagaaatgtggagggccaggacatgctgtaccagagcctgaagctgaccaacggcatctgggtgctggccgagctgcgcatccagcccggcaaccccagctgcacagacctggagctgagcctgaagtgccgggcccctgaggtgtcccagcacgtgtaccaggcctatgagaccatcctgaagaactag

SEQ ID NO: 142690 - DNA, 2850 bp, Artificial Sequence
  Description of Artificial Sequence: Synthetic coding sequence
atgacagacagcaagtacttcaccaccaccaagaagggggagatctttgagctgaaggccgagctgaacagcgacaagaaggagaagaagaaggaggccgtgaagaaggtgattgcctccatgacagtgggcaaggatgtgtctgccctcttcccagatgtggtgaactgcatgcagacagacaacctggagctgaagaagctggtgtacctgtacctgatgaactatgccaagagccagcctgacatggccatcatggctgtgaacacctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagctggtggaggaccagggcttcctggacaccctgaaggacctgatcagtgacagcaaccccatggtggtggccaatgctgtggccgccctgtctgaaattgctgagagccaccccagcagcaacctgctggacctgaacccccagagcatcaacaagctgctgacagccctgaatgaatgtacagagtggggccagatcttcatcctggactgcctggccaactacatgcccaaggatgaccgggaggcccagagcatctgtgagcgggtgaccccccggctgagccacgccaacagcgctgtggtgctgtctgctgtgaaggtgctgatgaagttcatggagatgctgagcaaggacctggactactacggcaccctgctgaagaagctggccccacccctggtgaccctgctgtctgctgagcctgagctgcagtatgtggccctgaggaacatcaacctgattgtgcagaagaggcctgagatcctgaagcatgagatgaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatcaaggacatcttcaggaagtaccccaacaagtatgaatctgtgattgccaccctgtgtgagaacctggacagcctggatgagcctgaggcccgggccgccatgatctggatcgtgggggagtatgcagagagaattgacaatgctgatgagctgctggagagcttcctggagggcttccatgatgagagcacccaggtgcagctgcagctgctgacagccatcgtgaagctgttcctgaagaagcccacagagacccaggagctggtgcagcaggtgctgagcctggccacccaggacagcgacaacccagacctgcgggaccggggctacatctactggaggctgctgagcacagatcctgtggccgccaaggaggtggtgctggccgagaagcccctcatcagcgaggagacagacctgattgagcccaccctgctggatgagctgatctgctacatcggcaccctggcctctgtgtaccacaagcccccatctgcctttgtggagggcggccggggcgtggtgcacaagagcctgccccccaggacagccagcagcgagagcgctgagagccctgagacagcccccactggagcccctcctggagagcagccagatgtgatcccagcccagggcgacctgctgggggacctgctgaacctggacctgggcccccctgtgtctggcccccccctggccaccagctctgtgcagatgggcgctgtggacctgctgggcggcggcctggacagcctgatgggagatgagcctgagggcatcggcggcaccaactttgtggccccacccacagctgctgtgcctgccaacctgggcgcccccatcggcagcggcctgagtgacctgtttgacctgaccagcggcgtgggcaccctgagcggcagctatgtggcccccaaggctgtgtggctgcctgccatgaaggccaagggcctggagatcagcggcaccttcacccggcaggtgggcagcatctccatggacctgcagctgaccaacaaggccctgcaggtgatgacagactttgccatccagttcaacagaaacagctttggcctggccccagccacccccctgcaggtgcacgcccccctgagccccaaccagacagtggagatcagcctgcccctgagcacagtgggctctgtgatgaagatggagcccctgaacaacctgcaggtggccgtgaagaacaacattgatgtgttctacttcagcaccctgtaccccctgcacatcctgtttgtggaggatggcaagatggaccggcagatgttcctggccacctggaaggacatccccaatgaaaatgaggcccagttccagatccgggactgccccctgaatgctgaggccgccagcagcaagctgcagagcagcaacatcttcaccgtggccaagagaaatgtggagggccaggacatgctgtaccagagcctgaagctgaccaacggcatctgggtgctggccgagctgcgcatccagcccggcaaccccagctgcacagacctggagctgagcctgaagtgccgggcccctgaggtgtcccagcacgtgtaccaggcctatgagaccatcctgaagaactag

SEQ ID NO: 142691 - DNA, 2820 bp, Artificial Sequence
  Description of Artificial Sequence: Synthetic coding sequence
atgacagacagcaagtacttcaccaccaccaagaagggggagatctttgagctgaaggccgagctgaacagcgacaagaaggagaagaagaaggaggccgtgaagaaggtgattgcctccatgacagtgggcaaggatgtgtctgccctcttcccagatgtggtgaactgcatgcagacagacaacctggagctgaagaagctggtgtacctgtacctgatgaactatgccaagagccagcctgacatggccatcatggctgtgaacacctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagctggtggaggaccagggcttcctggacaccctgaaggacctgatcagtgacagcaaccccatggtggtggccaatgctgtggccgccctgtctgaaattgctgagagccaccccagcagcaacctgctggacctgaacccccagagcatcaacaagctgctgacagccctgaatgaatgtacagagtggggccagatcttcatcctggactgcctggccaactacatgcccaaggatgaccgggaggcccagagcatctgtgagcgggtgaccccccggctgagccacgccaacagcgctgtggtgctgtctgctgtgaaggtgctgatgaagttcatggagatgctgagcaaggacctggactactacggcaccctgctgaagaagctggccccacccctggtgaccctgctgtctgctgagcctgagctgcagtatgtggccctgaggaacatcaacctgattgtgcagaagaggcctgagatcctgaagcatgagatgaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatcaaggacatcttcaggaagtaccccaacaagtatgaatctgtgattgccaccctgtgtgagaacctggacagcctggatgagcctgaggcccgggccgccatgatctggatcgtgggggagtatgcagagagaattgacaatgctgatgagctgctggagagcttcctggagggcttccatgatgagagcacccaggtgcagctgcagctgctgacagccatcgtgaagctgttcctgaagaagcccacagagacccaggagctggtgcagcaggtgctgagcctggccacccaggacagcgacaacccagacctgcgggaccggggctacatctactggaggctgctgagcacagatcctgtggccgccaaggaggtggtgctggccgagaagcccctcatcagcgaggagacagacctgattgagcccaccctgctggatgagctgatctgctacatcggcaccctggcctctgtgtaccacaagcccccatctgcctttgtggagggcggccggggcgtggtgcacaagagcctgccccccaggacagccagcagcgagagcgctgagagccctgagacagcccccactggagcccctcctggagagcagccagatgtgatcccagcccagggcgacctgctgggggacctgctgaacctggacctgggcccccctgtgtctggcccccccctggccaccagctctgtgcagatgggcgctgtggacctgctgggcggcggcctggacagcctgattggaggcaccaactttgtggccccacccacagctgctgtgcctgccaacctgggcgcccccatcggcagcggcctgagtgacctgtttgacctgaccagcggcgtgggcaccctgagcggcagctatgtggcccccaaggctgtgtggctgcctgccatgaaggccaagggcctggagatcagcggcaccttcacccggcaggtgggcagcatctccatggacctgcagctgaccaacaaggccctgcaggtgatgacagactttgccatccagttcaacagaaattcctttggcctggccccagccacccccctgcaggtgcacgcccccctgagccccaaccagacagtggagatcagcctgcccctgagcacagtgggctctgtgatgaagatggagcccctgaacaacctgcaggtggccgtgaagaacaacattgatgtgttctacttcagcaccctgtaccccctgcacatcctgtttgtggaggatggcaagatggaccggcagatgttcctggccacctggaaggacatccccaatgaaaatgaggcccagttccagatccgggactgccccctgaatgctgaggccgccagcagcaagctgcagagcagcaacatcttcaccgtggccaagagaaatgtggagggccaggacatgctgtaccagagcctgaagctgaccaacggcatctgggtgctggccgagctgcgcatccagcccggcaaccccagctgcaccctgagcctgaagtgccgggcccctgaggtgtcccagcacgtgtaccaggcctatgagaccatcctgaagaactag

SEQ ID NO: 142692 - DNA, 2850 bp, Artificial Sequence; identical to SEQ ID NO: 142690
  Description of Artificial Sequence: Synthetic coding sequence

SEQ ID NO: 142693 - DNA, 2820 bp, Artificial Sequence; identical to SEQ ID NO: 142691
  Description of Artificial Sequence: Synthetic coding sequence

SEQ ID NO: 142694 - DNA, 1737 bp, Artificial Sequence
  Description of Artificial Sequence: Synthetic coding sequence
atgacagacagcaagtacttcaccaccaccaagaagggggagatctttgagctgaaggccgagctgaacagcgacaagaaggagaagaagaaggaggccgtgaagaaggtgattgcctccatgacagtgggcaaggatgtgtctgccctcttcccagatgtggtgaactgcatgcagacagacaacctggagctgaagaagctggtgtacctgtacctgatgaactatgccaagagccagcctgacatggccatcatggctgtgaacacctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagctggtggaggaccagggcttcctggacaccctgaaggacctgatcagtgacagcaaccccatggtggtggccaatgctgtggccgccctgtctgaaattgctgagagccaccccagcagcaacctgctggacctgaacccccagagcatcaacaagctgctgacagccctgaatgaatgtacagagtggggccagatcttcatcctggactgcctggccaactacatgcccaaggatgaccgggaggcccagagcatctgtgagcgggtgaccccccggctgagccacgccaacagcgctgtggtgctgtctgctgtgaaggtgctgatgaagttcatggagatgctgagcaaggacctggactactacggcaccctgctgaagaagctggccccacccctggtgaccctgctgtctgctgagcctgagctgcagtatgtggccctgaggaacatcaacctgattgtgcagaagaggcctgagatcctgaagcatgagatgaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatcaaggacatcttcaggaagtaccccaacaagtatgaatctgtgattgccaccctgtgtgagaacctggacagcctggatgagcctgaggcccgggccgccatgatctggatcgtgggggagtatgcagagagaattgacaatgctgatgagctgctggagagcttcctggagggcttccatgatgagagcacccaggtgcagctgcagctgctgacagccatcgtgaagctgttcctgaagaagcccacagagacccaggagctggtgcagcaggtgctgagcctggccacccaggacagcgacaacccagacctgcgggaccggggctacatctactggaggctgctgagcacagatcctgtggccgccaaggaggtggtgctggccgagaagcccctcatcagcgaggagacagacctgattgagcccaccctgctggatgagctgatctgctacatcggcaccctggcctctgtgtaccacaagcccccatag

SEQ ID NO: 142695 - DNA, 2820 bp, Artificial Sequence; identical to SEQ ID NO: 142691
  Description of Artificial Sequence: Synthetic coding sequence

SEQ ID NO: 142696 - DNA, 2469 bp, Artificial Sequence
  Description of Artificial Sequence: Synthetic coding sequence
atgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgagaccgtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagagaagagccatggagctgagctttgccctggtgaatggaaacaacatccggggcatgatgaaggagctgctgtacttcctggacagctgtgagcctgagttcaaggctgactgtgccagcggcatcttcctggccgctgagaagtatgcccccagcaagcgctggcacatcgacaccatcatgagggtgctgaccacagctggcagctatgtgagagatgatgctgtgcccaacctgatccagctgatcaccaacagcgtggagatgcacgcctacacagtgcagaggctgtacaaggccatcctgggggactacagccagcagcccctggtgcaggtggccgcctggtgcatcggggagtatggagacctgctggtgtctggccagtgtgaggaggaggagcccatccaggtgacagaagatgaggtgctggacatcctggagagcgtgctgatcagcaacatgagcacctctgtgacccggggctacgccctgacagccatcatgaagctgagcacccgcttcacctgcaccgtgaaccgcatcaagaaggtggtgtccatctacggcagcagcattgatgtggagctgcagcagagagctgtggagtacaatgccctcttcaagaagtatgaccacatgaggtctgccctgctggagaggatgcctgtgatggagaaggtgaccaccaacggccccacagagatcgtgcagaccaacggggagacagagcccgcccccctggagaccaagcccccaccttctggcccccagcccaccagccaggccaatgacctgctggacctgctgggcggcaatgacatcacccctgtgatccccacagcccccaccagcaagcccagcagcgctggaggagagctgctggacctgctgggggacatcaacctgaccggggccccagctgctgccccagccccagcctctgtgccccagatcagccagccccccttcctgctggatggcctgagcagccagcccctcttcaatgacattgctgctggcatccccagcatcacagcctacagcaagaatggcctgaagattgagttcacctttgagaggagcaacaccaaccccagcgtgaccgtcatcaccatccaggccagcaacagcacagagctggacatgacagactttgtgttccaggccgctgtgcccaagaccttccagctgcagctgctgagccccagcagcagcatcgtgcctgccttcaacacaggcaccatcacccaggtgatcaaggtgctgaacccccagaagcagcagctgaggatgaggatcaagctgacctacaaccacaagggcagcgccatgcaggacctggccgaggtgaacaacttccccccccagagctggcagtag

SEQ ID NO: 142697 - DNA, 2478 bp, Artificial Sequence
  Description of Artificial Sequence: Synthetic coding sequence
atgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaagaatgagaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgaaacagtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagaggcgggccatggagctgagctttgccctggtgaatggaaacaacatccggggcatgatgaaggagctgctgtacttcctggacagctgtgagcctgagttcaaggctgactgtgccagcggcatcttcctggccgctgagaagtatgcccccagcaagcgctggcacatcgacaccatcatgagggtgctgaccacagctggcagctatgtgagagatgatgctgtgcccaacctgatccagctgatcaccaacagcgtggagatgcacgcctacacagtgcagaggctgtacaaggccatcctgggggactacagccagcagcccctggtgcaggtggccgcctggtgcattggagaatatggagacctgctggtgtctggccagtgtgaggaggaggagcccatccaggtgacagaagatgaggtgctggacatcctggagagcgtgctgatcagcaacatgagcacctctgtgacccggggctacgccctgacagccatcatgaagctgagcacccgcttcacctgcaccgtgaaccgcatcaagaaggtggtgtccatctacggcagcagcattgatgtggagctgcagcagagagctgtggagtacaatgccctcttcaagaagtatgaccacatgaggtctgccctgctggagaggatgcctgtgatggagaaggtgaccaccaacggccccacagaaattgtgcagaccaatggagaaacagagcccgcccccctggagaccaagcccccacccagcggcccccagcccaccagccaggccaatgacctgctggacctgctgggcggcaatgacatcacccctgtgatccccacagcccccaccagcaagcccagcagcgctggaggagagctgctggacctgctgggggacatcaacctgactggagccccagctgctgccccagccccagcctctgtgccccagatcagccagccccccttcctgctggatggcctgagcagccagcccctcttcaatgacattgctgctggcatccccagcatcacagcctacagcaagaatggcctgaagattgagttcacctttgagaggagcaacaccaaccccagcgtgaccgtcatcaccatccaggccagcaacagcacagagctggacatgacagactttgtgttccaggccgctgtgcccaagaccttccagctgcagctgctgagccccagcagcagcatcgtgcctgccttcaacacaggcaccatcacccaggtgatcaaggtgctgaacccccagaagcagcagctgaggatgaggatcaagctgacctacaaccacaagggcagcgccatgcaggacctggccgaggtgaacaacttccccccccagagctggcagtag

SEQ ID NO: 142698 - DNA, 2478 bp, Artificial Sequence
  Description of Artificial Sequence: Synthetic coding sequence
atgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaaggagagcaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgaaacagtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagaggcgggccatggagctgagctttgccctggtgaatggaaacaacatccggggcatgatgaaggagctgctgtacttcctggacagctgtgagcctgagttcaaggctgactgtgccagcggcatcttcctggccgctgagaagtatgcccccagcaagcgctggcacatcgacaccatcatgagggtgctgaccacagctggcagctatgtgagagatgatgctgtgcccaacctgatccagctgatcaccaacagcgtggagatgcacgcctacacagtgcagaggctgtacaaggccatcctgggggactacagccagcagcccctggtgcaggtggccgcctggtgcattggagaatatggagacctgctggtgtctggccagtgtgaggaggaggagcccatccaggtgacagaagatgaggtgctggacatcctggagagcgtgctgatcagcaacatgagcacctctgtgacccggggctacgccctgacagccatcatgaagctgagcacccgcttcacctgcaccgtgaaccgcatcaagaaggtggtgtccatctacggcagcagcattgatgtggagctgcagcagagagctgtggagtacaatgccctcttcaagaagtatgaccacatgaggtctgccctgctggagaggatgcctgtgatggagaaggtgaccaccaacggccccacagaaattgtgcagaccaatggagaaacagagcccgcccccctggagaccaagcccccacccagcggcccccagcccaccagccaggccaatgacctgctggacctgctgggcggcaatgacatcacccctgtgatccccacagcccccaccagcaagcccagcagcgctggaggagagctgctggacctgctgggggacatcaacctgactggagccccagctgctgccccagccccagcctctgtgccccagatcagccagccccccttcctgctggatggcctgagcagccagcccctcttcaatgacattgctgctggcatccccagcatcacagcctacagcaagaatggcctgaagattgagttcacctttgagaggagcaacaccaaccccagcgtgaccgtcatcaccatccaggccagcaacagcacagagctggacatgacagactttgtgttccaggccgctgtgcccaagaccttccagctgcagctgctgagccccagcagcagcatcgtgcctgccttcaacacaggcaccatcacccaggtgatcaaggtgctgaacccccagaagcagcagctgaggatgaggatcaagctgacctacaaccacaagggcagcgccatgcaggacctggccgaggtgaacaacttccccccccagagctggcagtag

SEQ ID NO: 142699 - DNA, 1698 bp, Artificial Sequence
  Description of Artificial Sequence: Synthetic coding sequence
atgtttggcagctgctgccactgctgccggcggcccaggagctgctggttccacagccgcttccgggctgtgtctggagtgcagagccaggccgtgggcgtggagaagaggcggcagaggtcctgggcccggcggggccgggagccccagggcctgctgcggctgctggagggccggccccggggcctgggccctgggggcagcgcccggcggggcgtgccctgctgcggcgtggccccacccaggatgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaaggagagcaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgaaacagtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagaggcgggccatggagctgagctttgccctggtgaatggaaacaacatccggggcatgatgaaggagctgctgtacttcctggacagctgtgagcctgagttcaaggctgactgtgccagcggcatcttcctggccgctgagaagtatgcccccagcaagcgctggcacatcgacaccatcatgagggtgctgaccacagctggcagctatgtgagagatgatgctgtgcccaacctgatccagctgatcaccaacagcgtggagatgcacgcctacacagtgcagaggctgtacaaggccatcctgggggactacagccccaccttcggcaccagcggctgcatggtgtacagatag

SEQ ID NO: 142700 - DNA, 2538 bp, Artificial Sequence
  Description of Artificial Sequence: Synthetic coding sequence
atggagaagaacatcaacctgaggaactgccagaccctgaacacctacgtgatgctgacccacctgaggatgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgaaacagtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagaggcgggccatggagctgagctttgccctggtgaatggaaacaacatccggggcatgatgaaggagctgctgtacttcctggacagctgtgagcctgagttcaaggctgactgtgccagcggcatcttcctggccgctgagaagtatgcccccagcaagcgctggcacatcgacaccatcatgagggtgctgaccacagctggcagctatgtgagagatgatgctgtgcccaacctgatccagctgatcaccaacagcgtggagatgcacgcctacacagtgcagaggctgtacaaggccatcctgggggactacagccagcagcccctggtgcaggtggccgcctggtgcattggagaatatggagacctgctggtgtctggccagtgtgaggaggaggagcccatccaggtgacagaagatgaggtgctggacatcctggagagcgtgctgatcagcaacatgagcacctctgtgacccggggctacgccctgacagccatcatgaagctgagcacccgcttcacctgcaccgtgaaccgcatcaagaaggtggtgtccatctacggcagcagcattgatgtggagctgcagcagagagctgtggagtacaatgccctcttcaagaagtatgaccacatgaggtctgccctgctggagaggatgcctgtgatggagaaggtgaccaccaacggccccacagaaattgtgcagaccaatggagaaacagagcccgcccccctggagaccaagcccccacccagcggcccccagcccaccagccaggccaatgacctgctggacctgctgggcggcaatgacatcacccctgtgatccccacagcccccaccagcaagcccagcagcgctggaggagagctgctggacctgctgggggacatcaacctgactggagccccagctgctgccccagccccagcctctgtgccccagatcagccagccccccttcctgctggatggcctgagcagccagcccctcttcaatgacattgctgctggcatccccagcatcacagcctacagcaagaatggcctgaagattgagttcacctttgagaggagcaacaccaaccccagcgtgaccgtcatcaccatccaggccagcaacagcacagagctggacatgacagactttgtgttccaggccgctgtgcccaagaccttccagctgcagctgctgagccccagcagcagcatcgtgcctgccttcaacacaggcaccatcacccaggtgatcaaggtgctgaacccccagaagcagcagctgaggatgaggatcaagctgacctacaaccacaagggcagcgccatgcaggacctggccgaggtgaacaacttccccccccagagctggcagtag

SEQ ID NO: 142701 - DNA, 531 bp, Artificial Sequence
  Description of Artificial Sequence: Synthetic coding sequence
atgcctgcccccatccggctgcgggagctgatccgcaccatcagaacagcccggacccaggccgaggagcgggagatgatccagaaggaatgtgccgccatccgcagcagcttccgggaggaggacaacacctaccgctgcagaaatgtggccaagctgctgtacatgcacatgctgggctacccagcccacttcggccagctggagtgcctgaagctgattgccagccagaagttcacagacaagagaattggctacctgggcgccatgctgctgctggatgagcggcaggatgtgcacctgctgatgaccaactgcatcaagaatgacctgaaccacagcacccagtttgtgcagggcctggccctgtgcaccctgggctgcatgggcagcagcgagatgtgccgggacctggccggggaggtggagaagctgctgaagaccagcaacagctacctgaggaagaaggagatgatctacaagcagaccaacgtgacaggctacatcctgggcggcatccccaacagctag

SEQ ID NO: 142702 - DNA, 1047 bp, Artificial Sequence
  Description of Artificial Sequence: Synthetic coding sequence
atgaaggacaagatgtgccgggacctggccggggaggtggagaagctgctgaagaccagcaacagctacctgaggaagaaggccgccctgtgtgctgtgcacgtgatcaggaaggtgcctgagctgatggagatgttcctgcctgccaccaagaacctgctgaatgagaagaaccacggcgtgctgcacacctctgtggtgctgctgacagagatgtgtgagaggagcccagacatgctggcccacttcaggaagctggtgccccagctggtgcgcatcctgaagaacctgatcatgagcggctacagccctgagcatgatgtgtctggcatcagtgaccccttcctgcaggtgcgcatcctgcggctgctgcgcatcctgggcagaaatgatgatgacagcagcgaggccatgaatgacatcctggcccaggtggccaccaacacagagaccagcaagaatgtgggcaatgccatcctgtatgaaacagtgctgaccatcatggacatcaagtctgagagcggcctgcgggtgctggccatcaacatcctgggccgcttcctgctgaacaatgacaagaacatccgctacgtggccctgaccagcctgctgaagacagtgcagacagaccacaatgctgtgcagaggcacaggagcaccatcgtggactgcctgaaggacctggatgtgtccatcaagaggcgggccatggagctgagctttgccctggtgaatggaaacaacatccggggcatgatgaaggagctgctgtacttcctggacagctgtgagcctgagttcaaggctgactgtgccagcggcatcttcctggccgctgtgcccaagaccttccagctgcagctgctgagccccagcagcagcatcgtgcctgccttcaacacaggcaccatcacccaggtgatcaaggtgctgaacccccagaagcagcagctgaggatgaggatcaagctgacctacaaccacaagggcagcgccatgcaggacctggccgaggtgaacaacttccccccccagagctggcagtag

SEQ ID NO: 142703 - DNA, 1272 bp, Artificial Sequence
  Description of Artificial Sequence: Synthetic coding sequence
atgtctgccagcgctgtgtatgtgctggacctgaagggcaaggtgctgatctgcaggaactacagaggagatgtggacatgtctgaggtggagcacttcatgcccatcctgatggagaaggaggaggagggcatgctgagccccatcctggcccacggcggcgtgcgcttcatgtggatcaagcacaacaacctgtacctggtggccaccagcaagaagaatgcctgtgtgtccctggtgttctccttcctgtacaaggtggtgcaggtgttcagcgagtacttcaaggagctggaggaggagagcatccgggacaactttgtgatcatctatgagctgctggatgagctgatggactttggctacccccagaccacagacagcaagatcctgcaggagtacatcacccaggagggccacaagctggagaccggggccccccggcccccagccaccgtgaccaatgctgtgtcctggaggtctgagggcatcaagtacaggaagaatgaggtgttcctggatgtgattgagagcgtgaacctgctggtgtctgccaatggaaatgtgctgcggtctgagatcgtgggcagcatcaagatgagggtcttcctgagcggcatgcctgagctgcggctgggcctgaatgacaaggtgctgtttgacaacacaggccggggcaagagcaagtctgtggagctggaggatgtgaagttccaccagtgtgtgcggctgagcagatttgaaaatgacaggaccatctccttcatccccccagatggagaatttgagctgatgagctaccgcctgaacacccacgtgaagcccctcatctggattgaatctgtgattgagaagcacagccacagcagaattgagtacatgatcaaggccaagagccagttcaagagaagaagcacagccaacaacgtggagatccacatccctgtgcccaatgatgctgacagccccaagttcaagaccaccgtgggctctgtgaagtgggtgcctgaaaattctgaaattgtgtggagcatcaagagcttccctgggggcaaggagtacctgatgagggcccacttcggcctgcccagcgtggaggccgaggacaaggagggcaagccacccatctctgtgaagtttgagatcccctacttcaccaccagcggcatccaggtgcgctacctgaagatcatcgagaagagcggctaccaggccctgccctgggtgcgctacatcacccagaatggagactaccagctgcggacccagtag

SEQ ID NO: 142704 - DNA, 1113 bp, Artificial Sequence
  Description of Artificial Sequence: Synthetic coding sequence
atgtctgccagcgctgtgtatgtgctggacctgaagggcaaggtgctgatctgcaggaactacagaggagatgtggacatgtctgaggtggagcacttcatgcccatcctgatggagaaggaggaggagggcatgctgagccccatcctggcccacggcggcgtgcgcttcatgtggatcaagcacaacaacctgtacctggtggccaccagcaagaagaatgcctgtgtgtccctggtgttctccttcctgtacaaggtggtgcaggtgttcagcgagtacttcaaggagctggaggaggagagcatccgggacaactttgtgatcatctatgagctgctggatgagctgatggactttggctacccccagaccacagacagcaagatcctgcaggagtacatcacccaggagggccacaagctggagaccggggccccccggcccccagccaccgtgaccaatgctgtgtcctggaggtctgagggcatcaagtacaggaagaatgaggtgttcctggatgtgattgagagcgtgaacctgctggtgtctgccaatggaaatgtgctgcggtctgagatcgtgggcagcatcaagatgagggtcttcctgagcggcatgcctgagctgcggctgggcctgaatgacaaggtgctgtttgacaacacaggccggggcaagagcaagtctgtggagctggaggatgtgaagttccaccagtgtgtgcggctgagcagatttgaaaatgacaggaccatctccttcatccccccagatggagaatttgagctgatgagctaccgcctgaacacccacgtgaagcccctcatctggattgaatctgtgattgagaagcacagccacagcagaattgagtacatgatcaagggcggcaaggagtacctgatgagggcccacttcggcctgcccagcgtggaggccgaggacaaggagggcaagccacccatctctgtgaagtttgagatcccctacttcaccaccagcggcatccaggtgcgctacctgaagatcatcgagaagagcggctaccaggccctgccctgggtgcgctacatcacccagaatggagactaccagctgcggacccagtag

SEQ ID NO: 142705 - DNA, 1308 bp, Artificial Sequence
  Description of Artificial Sequence: Synthetic coding sequence
atgtctgccagcgctgtgtatgtgctggacctgaagggcaaggtgctgatctgcaggaactacagaggagatgtggacatgtctgaggtggagcacttcatgcccatcctgatggagaaggaggaggagggcatgctgagccccatcctggcccacggcggcgtgcgcttcatgtggatcaagcacaacaacctgtacctggtggccaccagcaagaagaatgcctgtgtgtccctggtgttctccttcctgtacaaggtggtgcaggtgttcagcgagtacttcaaggagctggaggaggagagcatccgggacaactttgtgatcatctatgagctgctggatgagctgatggactttggctacccccagaccacagacagcaagatcctgcaggagtacatcacccaggagggccacaagctggagaccggggccccccggcccccagccaccgtgaccaatgctgtgtcctggaggtctgagggcatcaagtacaggaagaatgaggtgttcctggatgtgattgagagcgtgaacctgctgggcaagtacccaggagtgggctggctgggccacacagtgtctgccaatggaaatgtgctgcggtctgagatcgtgggcagcatcaagatgagggtcttcctgagcggcatgcctgagctgcggctgggcctgaatgacaaggtgctgtttgacaacacaggccggggcaagagcaagtctgtggagctggaggatgtgaagttccaccagtgtgtgcggctgagcagatttgaaaatgacaggaccatctccttcatccccccagatggagaatttgagctgatgagctaccgcctgaacacccacgtgaagcccctcatctggattgaatctgtgattgagaagcacagccacagcagaattgagtacatgatcaaggccaagagccagttcaagagaagaagcacagccaacaacgtggagatccacatccctgtgcccaatgatgctgacagccccaagttcaagaccaccgtgggctctgtgaagtgggtgcctgaaaattctgaaattgtgtggagcatcaagagcttccctgggggcaaggagtacctgatgagggcccacttcggcctgcccagcgtggaggccgaggacaaggagggcaagccacccatctctgtgaagtttgagatcccctacttcaccaccagcggcatccaggtgcgctacctgaagatcatcgagaagagcggctaccaggccctgccctgggtgcgctacatcacccagaatggagactaccagctgcggacccagtag

SEQ ID NO: 142706 - DNA, 1056 bp, Artificial Sequence
  Description of Artificial Sequence: Synthetic coding sequence
atgtctgccagcgctgtgtatgtgctggacctgaagggcaaggtggtgcaggtgttcagcgagtacttcaaggagctggaggaggagagcatccgggacaactttgtgatcatctatgagctgctggatgagctgatggactttggctacccccagaccacagacagcaagatcctgcaggagtacatcacccaggagggccacaagctggagaccggggccccccggcccccagccaccgtgaccaatgctgtgtcctggaggtctgagggcatcaagtacaggaagaatgaggtgttcctggatgtgattgagagcgtgaacctgctggtgtctgccaatggaaatgtgctgcggtctgagatcgtgggcagcatcaagatgagggtcttcctgagcggcatgcctgagctgcggctgggcctgaatgacaaggtgctgtttgacaacacaggccggggcaagagcaagtctgtggagctggaggatgtgaagttccaccagtgtgtgcggctgagcagatttgaaaatgacaggaccatctccttcatccccccagatggagaatttgagctgatgagctaccgcctgaacacccacgtgaagcccctcatctggattgaatctgtgattgagaagcacagccacagcagaattgagtacatgatcaaggccaagagccagttcaagagaagaagcacagccaacaacgtggagatccacatccctgtgcccaatgatgctgacagccccaagttcaagaccaccgtgggctctgtgaagtgggtgcctgaaaattctgaaattgtgtggagcatcaagagcttccctgggggcaaggagtacctgatgagggcccacttcggcctgcccagcgtggaggccgaggacaaggagggcaagccacccatctctgtgaagtttgagatcccctacttcaccaccagcggcatccaggtgcgctacctgaagatcatcgagaagagcggctaccaggccctgccctgggtgcgctacatcacccagaatggagactaccagctgcggacccagtag

SEQ ID NO: 142707 - DNA, 1272 bp, Artificial Sequence
  Description of Artificial Sequence: Synthetic coding sequence
atgtctgccagcgctgtgttcatcctggatgtgaagggcaagcccctcatcagcaggaactacaagggagatgtggccatgagcaagattgagcacttcatgcccctgctggtgcagcgggaggaggagggcgccctggcccccctgctgagccacggccaggtgcacttcctgtggatcaagcacagcaacctgtacctggtggccaccaccagcaagaatgccaatgccagcctggtgtacagcttcctgtacaagaccatcgaggtgttctgtgagtacttcaaggagctggaggaggagagcatccgggacaactttgtgattgtgtatgagctgctggatgagctgatggactttggcttcccccagaccacagacagcaagatcctgcaggagtacatcacccagcagagcaacaagctggagaccgggaagagccgggtgccccccaccgtgaccaatgctgtgtcctggaggtctgagggcatcaagtacaagaagaatgaggtgttcattgatgtgattgagagcgtgaacctgctggtgaatgccaacggctctgtgctgctgtctgagatcgtgggcaccatcaagctgaaggtgttcctgagcggcatgcctgagctgcggctgggcctgaatgacagagtgctgtttgagctgaccggccgcagcaagaacaagtctgtggagctggaggatgtgaagttccaccagtgtgtgcggctgagcagatttgacaatgacaggaccatctccttcatccccccagatggagactttgagctgatgagctaccgcctgagcacccaggtgaagcccctcatctggattgaatctgtgattgagaagttcagccacagccgggtggagatcatggtgaaggccaagggccagttcaagaagcagagcgtggccaacggggtggagatctctgtgcctgtgcccagtgatgctgacagcccccgcttcaagacctctgtgggcagcgccaagtatgtgcctgagagaaatgtggtgatctggagcatcaagagcttccctgggggcaaggagtacctgatgagggcccacttcggcctgcccagcgtggagaaggaggaggtggagggccggccccccatcggcgtgaagtttgagatcccctacttcaccgtgtctggcatccaggtgcgctacatgaagatcatcgagaagagcggctaccaggccctgccctgggtgcgctacatcacccagagcggggactaccagctgcggaccagctag

SEQ ID NO: 142708 - DNA, 477 bp, Artificial Sequence
  Description of Artificial Sequence: Synthetic coding sequence
atgatgaggttcatgctgctcttcagccggcagggcaagctgcggctgcagaagtggtacctggccaccagtgacaaggagaggaagaagatggtgcgggagctgatgcaggtggtgctggccaggaagcccaagatgtgcagcttcctggagtggagggacctgaaggtggtgtacaagagatatgccagcctgtacttctgctgtgccatcgagggccaggacaatgagctgatcaccctggagctgatccacagatatgtggagctgctggacaagtactttggatctgtgtgtgagctggacatcatcttcaactttgagaaggcctacttcatcctggatgagttcctgatgggaggagatgtgcaggacaccagcaagaagtctgtgctgaaggccatcgagcaggccgacctgctgcaggaggaggatgagagccccaggtctgtgctggaggagatgggcctggcctag

SEQ ID NO: 142709 - DNA, 477 bp, Artificial Sequence; identical to SEQ ID NO: 142708
  Description of Artificial Sequence: Synthetic coding sequence

SEQ ID NO: 142710 - DNA, 474 bp, Artificial Sequence
  Description of Artificial Sequence: Synthetic coding sequence
atgcagttcatgctgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgaactcatcaccctggagatcatccaccgctacgtggagctgctggacaagtacttcggctctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggaggaggccgagacccccaggtctgtgctggaggagatcggcctgacctag

SEQ ID NO: 142711 - DNA, 462 bp, Artificial Sequence
  Description of Artificial Sequence: Synthetic coding sequence
atgctgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgagctgatcaccctggagatcatccacagatatgtggagctgctggacaagtactttggatctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagagccagaatgaggagtggggcggcctgtctgaggacatcctgtag

SEQ ID NO: 142712 - DNA, 483 bp, Artificial Sequence
  Description of Artificial Sequence: Synthetic coding sequence
atgcagttcatgctgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgaactcatcaccctggagatcatccaccgctacgtggagctgctggacaagtacttcggctctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagaagacagagaccatgtaccacagcaagagcttcatcggcttcaagaaggcctactag

SEQ ID NO: 142713 - DNA, 609 bp, Artificial Sequence
  Description of Artificial Sequence: Synthetic coding sequence
atgcctgctggctgccccccccacagcaccacagccagcctgccccagcacggggaccggggcttcccctttgctgctgctgctgctgctggccaggccccaccccggcccaggcctgctgctgccatgcagttcatgctgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgaactcatcaccctggagatcatccaccgctacgtggagctgctggacaagtacttcggctctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagaagacagagaccatgtaccacagcaagagcttcatcggcttcaagaaggcctactag

SEQ ID NO: 142714 - DNA, 441 bp, Artificial Sequence
  Description of Artificial Sequence: Synthetic coding sequence
tgaagacagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgagctgatcaccctggagatcatccacagatatgtggagctgctggacaagtactttggatctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagcccaggcatgagtacttcaacgtgcctgtgtactag

SEQ ID NO: 142715 - DNA, 462 bp, Artificial Sequence
  Description of Artificial Sequence: Synthetic coding sequence
tgactgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgagctgatcaccctggagatcatccacagatatgtggagctgctggacaagtactttggatctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagagccagaatgaggagtggggcggcctgtctgaggacatcctgtag

SEQ ID NO: 142716 - DNA, 588 bp, Artificial Sequence
  Description of Artificial Sequence: Synthetic coding sequence
atgcctgctggctgccccccccacagcaccacagccagcctgccccagcacggggaccggggcttcccctttgctgctgctgctgctgctggccaggccccaccccggcccaggcctgctgctgccatgcagttcatgctgctcttcagccggcagggcaagctgcggctgcagaagtggtacgtgcccctgagtgacaaggagaagaagaagatcacccgggagctggtgcagacagtgctggccaggaagcccaagatgtgcagcttcctggagtggagggacctgaagatcgtgtacaagagatatgccagcctgtacttctgctgtgccatcgaggaccaggacaatgaactcatcaccctggagatcatccaccgctacgtggagctgctggacaagtacttcggctctgtgtgtgagctggacatcatcttcaactttgagaaggcctacttcatcctggatgagttcctgctgggcggggaggtgcaggagaccagcaagaagaatgtgctgaaggccatcgagcaggccgacctgctgcaggagcccaggcatgagtacttcaacgtgcctgtgtactag

SEQ ID NO: 142717 - DNA, 315 bp, Artificial Sequence
  Description of Artificial Sequence: Synthetic coding sequence
atgatccgcttcatcctgatccagaacagagctgggaagacccggctggccaagtggtacatgcagtttgatgatgatgagaagcagaagctgattgaggaggtgcatgctgtggtgacagtgagagatgccaagcacaccaactttgtggaggtgctgaatgagtacttccacaacgtgtgtgagctggacctggtgttcaacttctacaaggtgtacacagtggtggatgagatgttcctggccggggagatccgggagaccagccagaccaaggtgctgaagcagctgctgatgctgcagagcctggagtag

SEQ ID NO: 142718 - DNA, 2868 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaacaagtacacagagaagcagatcggctacctgttcatctctgtgctggtgaacagcaacagcgagctgatccgcctcatcaacaatgccatcaagaatgacctggccagcaggaaccccaccttcatgtgcctggccctgcactgcatcgccaacgtgggcagccgggagatgggagaggcctttgctgctgacatcccccgcatcctggtggccggggacagcatggattctgtgaagcagagcgctgccctgtgcctgctgcggctgtacaaggccagcccagacctggtgcccatgggagagtggacagcccgggtggtgcacctgctgaatgaccagcacatgggcgtggtgacagctgctgtgtccctcatcacctgcctgtgcaagaagaacccagatgacttcaagacctgtgtgtccctggccgtgtcccggctgagccgcatcgtgtcctctgccagcacagacctgcaggactacacctactactttgtgcctgccccctggctgtctgtgaagctgctgcggctgctgcagtgctacccacctccagaagatgctgctgtgaagggccgcctggtggagtgcctggagaccgtgctgaacaaggcccaggagccccccaagagcaagaaggtgcagcacagcaatgccaagaatgccatcctgtttgagaccatcagcctcatcatccactatgacagcgagcccaacctgctggtgcgggcctgcaaccagctgggccagttcctgcagcaccgggagaccaacctgcgctacctggccctggagagcatgtgcaccctggccagcagcgagttcagccatgaagctgtgaagacccacatcgacaccgtcatcaatgccctgaagacagaaagagatgtgtctgtgcggcagagagctgctgacctgctgtatgccatgtgtgacaggagcaatgccaagcagatcgtgtctgagatgctgcgctacctggagacagctgactatgccatccgggaggagatcgtgctgaaggtggccatcctggccgagaagtatgctgtggactacagctggtacgtggacaccatcctgaacctgatcagaattgctggggactatgtgtctgaggaggtgtggtacagagtgctgcagatcgtgaccaacagagatgatgtgcagggctatgctgccaagacagtgtttgaggccctgcaggccccagcctgccacgagaacatggtgaaggtgggcggctacatcctgggggagtttggaaacctgattgctggggaccccaggagcagcccccctgtgcagttcagcctgctgcacagcaagttccacctgtgcagcgtggccacccgggccctgctgctgagcacctacatcaagttcatcaacctcttccctgagaccaaggccaccatccagggcgtgctgcgggccggcagccagctgagaaatgctgatgtggagctgcagcagagagctgtggagtacctgaccctgagctctgtggccagcacagatgtgctggccaccgtgctggaggagatgccacccttccctgagcgggagagcagcatcctggccaagctgaagaggaagaagggccctggggccggcagcgccctggatgatggccggcgggaccccagcagcaatgacatcaatggaggcatggagcccacccccagcacagtgtccacccccagccccagcgctgacctgctgggcctgcgggccgcccctcctcctgctgcccccccagccagcgctggggccggcaacctgctggtggatgtgtttgatggccctgctgcccagcccagcctgggccccaccccagaggaggccttcctgagccctggcccagaagatattggcccccccatccctgaggctgatgagctgctgaacaagtttgtgtgcaagaacaacggggtgctgtttgagaaccagctgctgcagattggagtgaagtctgagttccggcagaacctgggccgcatgtacctgttctacggcaacaagacctctgtgcagttccagaacttcagccccaccgtggtgcaccctggggacctgcagacccagctggccgtgcagaccaagagggtggccgcccaggtggatggaggagcccaggtgcagcaggtgctgaacattgaatgtctgcgggacttcctgaccccacccctgctgtctgtgcgcttccgctatggaggagccccccaggccctgaccctgaagctgcctgtgaccatcaacaagttcttccagcccacagagatggccgcccaggacttcttccagcgctggaagcagctgagcctgccccagcaggaggcccagaagatcttcaaggccaaccaccccatggatgctgaggtgaccaaggccaagctgctgggctttggaagtgccctgctggacaacgtggaccccaaccctgagaactttgtgggcgccggcatcatccagaccaaggccctgcaggtgggctgcctgctgcggctggagcccaatgcccaggcccagatgtaccgcctgaccctgcggaccagcaaggagcctgtgagccgccacctgtgtgagctgctggcccagcagttctag

SEQ ID NO: 142719 - DNA, 2934 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaacaagtacacagagaagcagatcggctacctgttcatctctgtgctggtgaacagcaacagcgagctgatccgcctcatcaacaatgccatcaagaatgacctggccagcaggaaccccaccttcatgtgcctggccctgcactgcatcgccaacgtgggcagccgggagatgggagaggcctttgctgctgacatcccccgcatcctggtggccggggacagcatggattctgtgaagcagagcgctgccctgtgcctgctgcggctgtacaaggccagcccagacctggtgcccatgggagagtggacagcccgggtggtgcacctgctgaatgaccagcacatgggcgtggtgacagctgctgtgtccctcatcacctgcctgtgcaagaagaacccagatgacttcaagacctgtgtgtccctggccgtgtcccggctgagccgcatcgtgtcctctgccagcacagacctgcaggactacacctactactttgtgcctgccccctggctgtctgtgaagctgctgcggctgctgcagtgctacccacctccagaagatgctgctgtgaagggccgcctggtggagtgcctggagaccgtgctgaacaaggcccaggagccccccaagagcaagaaggtgcagcacagcaatgccaagaatgccatcctgtttgagaccatcagcctcatcatccactatgacagcgagcccaacctgctggtgcgggcctgcaaccagctgggccagttcctgcagcaccgggagaccaacctgcgctacctggccctggagagcatgtgcaccctggccagcagcgagttcagccatgaagctgtgaagacccacatcgacaccgtcatcaatgccctgaagacagaaagagatgtgtctgtgcggcagagagctgctgacctgctgtatgccatgtgtgacaggagcaatgccaagcagatcgtgtctgagatgctgcgctacctggagacagctgactatgccatccgggaggagatcgtgctgaaggtggccatcctggccgagaagtatgctgtggactacagctggtacgtggacaccatcctgaacctgatcagaattgctggggactatgtgtctgaggaggtgtggtacagagtgctgcagatcgtgaccaacagagatgatgtgcagggctatgctgccaagacagtgtttgaggccctgcaggccccagcctgccacgagaacatggtgaaggtgggcggctacatcctgggggagtttggaaacctgattgctggggaccccaggagcagcccccctgtgcagttcagcctgctgcacagcaagttccacctgtgcagcgtggccacccgggccctgctgctgagcacctacatcaagttcatcaacctcttccctgagaccaaggccaccatccagggcgtgctgcgggccggcagccagctgagaaatgctgatgtggagctgcagcagagagctgtggagtacctgaccctgagctctgtggccagcacagatgtgctggccaccgtgctggaggagatgccacccttccctgagcgggagagcagcatcctggccaagctgaagaggaagaagggccctggggccggcagcgccctggatgatggccggcgggaccccagcagcaatgacatcaatggaggcatggagcccacccccagcacagtgtccacccccagccccagcgctgacctgctgggcctgcgggccgcccctcctcctgctgcccccccagccagcgctggggccggcaacctgctggtggatgtgtttgatggccctgctgcccagcccagcctgggccccaccccagaggaggccttcctgtctgagctggagcccccagcccctgagagccccatggccctgctggccgaccctgccccagctgctgaccccggcccagaagatattggcccccccatccctgaggctgatgagctgctgaacaagtttgtgtgcaagaacaacggggtgctgtttgagaaccagctgctgcagattggagtgaagtctgagttccggcagaacctgggccgcatgtacctgttctacggcaacaagacctctgtgcagttccagaacttcagccccaccgtggtgcaccctggggacctgcagacccagctggccgtgcagaccaagagggtggccgcccaggtggatggaggagcccaggtgcagcaggtgctgaacattgaatgtctgcgggacttcctgaccccacccctgctgtctgtgcgcttccgctatggaggagccccccaggccctgaccctgaagctgcctgtgaccatcaacaagttcttccagcccacagagatggccgcccaggacttcttccagcgctggaagcagctgagcctgccccagcaggaggcccagaagatcttcaaggccaaccaccccatggatgctgaggtgaccaaggccaagctgctgggctttggaagtgccctgctggacaacgtggaccccaaccctgagaactttgtgggcgccggcatcatccagaccaaggccctgcaggtgggctgcctgctgcggctggagcccaatgcccaggcccagatgtaccgcctgaccctgcggaccagcaaggagcctgtgagccgccacctgtgtgagctgctggcccagcagttctag

SEQ ID NO: 142720 - DNA, 1404 bp, Artificial Sequence
  Description of Artificial Sequence: Synthetic coding sequence
atgggcctggccctgcactgcatcgcctctgtgggcagccgggagatggccgaggcctttgctggggagatccccaaggtgctggtggccggggacaccatggacagcgtgaagcagagcgctgccctgtgcctgctgcggctgtaccgcaccagcccagacctggtgcccatgggagactggaccagccgggtggtgcacctgctgaatgaccagcacctgggcgtggtgacagctgccaccagcctcatcaccaccctggcccagaagaaccctgaggagttcaagacctctgtgtccctggccgtgtcccggctgagcagaattgtgaccagcgccagcacagacctgcaggactacacctactactttgtgcctgccccctggctgtctgtgaagctgctgcggctgctgcagtgctacccacctccagaccctgctgtgcggggccgcctgacagagtgcctggagaccatcctgaacaaggcccaggagccccccaagagcaagaaggtgcagcacagcaatgccaagaatgctgtgctgtttgaggccatcagcctcatcatccaccacgacagcgagcccaacctgctggtgcgggcctgcaaccagctgggccagttcctgcagcaccgggagaccaacctgcgctacctggccctggagagcatgtgcaccctggccagcagcgagttcagccatgaagctgtgaagacccacatcgagaccgtcatcaatgccctgaagacagaaagagatgtgtctgtgctgccccccaccccacccaggagcctgtgggagcagcagtgccactgtgcctggaggggcctgagcctgggcgtgtggcccagctggtggctgcacacctggaggcggcccggccccctgggcggggcccagctgaccctggtgctgctgcagagccagctggactgcttcccccggcaggacttcaacctggagttcaggaacatctgcatctgcaatgacttctggcagaagcacgtgtcctggccagatgtgacagtgctgctgagccagctgctgtttgtgaagggcgtgtgctacgccccagctgtggccgaggccctggatgtgcagcctggagaggagaggcctgctggccctgctggccccccaggcctgcagggcaaggtgtgggccggcggggcccggctgcggggcgtgctggtgtccttcctgtctgagtgggccagccctggccacggggccggcctgagccccagcacaggccctgtgcagagcagcctggagggcctgtggaggagagatgcctctgtgtggagcggcagcgagggcgccatcggccgcatgccctgtgccacctgtggcctgtgcctgacctgccacctggacagcgccccccggctgcacgtgtag

SEQ ID NO: 142721 - DNA, 2823 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaatgccatcaagaatgacctggccagcaggaaccccaccttcatgggcctggccctgcactgcatcgcctctgtgggcagccgggagatggccgaggcctttgctggggagatccccaaggtgctggtggccggggacaccatggattctgtgaagcagagcgctgccctgtgcctgctgcggctgtaccgcaccagcccagacctggtgcccatgggagactggaccagccgggtggtgcacctgctgaatgaccagcacctgggcgtggtgacagctgccaccagcctcatcaccaccctggcccagaagaaccctgaggagttcaagacctctgtgtccctggccgtgtcccggctgagccgcatcgtgaccagcgccagcacagacctgcaggactacacctactactttgtgcctgccccctggctgtctgtgaagctgctgcggctgctgcagtgctacccacctcctgaggaccctgctgtgcggggccgcctgacagagtgcctggagaccatcctgaacaaggcccaggagccccccaagagcaagaaggtgcagcacagcaatgccaagaatgctgtgctgtttgaggccatcagcctcatcatccaccacgacagcgagcccaacctgctggtgcgggcctgcaaccagctgggccagttcctgcagcaccgggagaccaacctgcgctacctggccctggagagcatgtgcaccctggccagcagcgagttcagccatgaagctgtgaagacccacatcgagaccgtcatcaatgccctgaagacagaaagagatgtgtctgtgcggcagagagctgtggacctgctgtatgccatgtgtgacaggagcaatgccccccagatcgtggccgagatgctgagctacctggagacagctgactacagcatccgggaggagatcgtgctgaaggtggccatcctggccgagaagtatgctgtggactacacctggtacgtggacaccatcctgaacctgatcagaattgctggggactatgtgtctgaggaggtgtggtacagagtcatccagatcgtcatcaacagagatgatgtgcagggctatgctgccaagacagtgtttgaggccctgcaggccccagcctgccacgagaacctggtgaaggtgggcggctacatcctgggggagtttggaaacctgattgctggggaccccaggagcagccccctcatccagttccacctgctgcacagcaagttccacctgtgcagcgtgcccacccgggccctgctgctgagcacctacatcaagtttgtgaacctcttccctgaggtgaagcccaccatccaggatgtgctgcggagtgacagccagctgagaaatgctgatgtggagctgcagcagagagctgtggagtacctgcggctgagcacagtggccagcacagacatcctggccaccgtgctggaggagatgccacccttccctgagcgggagagcagcatcctggccaagctgaagaagaagaagggccccagcacagtgacagacctggaggacaccaagagggacagatctgtggatgtgaatggaggccctgagcccgccccagccagcaccagcgctgtgtccacccccagccccagcgctgacctgctgggcctgggcgccgcccccccagccccagctggccccccacccagcagcggcggcagcggcctgctggtggatgtgttcagtgacagcgcctctgtggtggcccccctggcccctggcagcgaggacaactttgccaggtttgtgtgcaagaacaatggagtgctgtttgagaaccagctgctgcagatcggcctgaagtctgagttccggcagaacctgggccgcatgttcatcttctacggcaacaagaccagcacccagttcctgaacttcacccccaccctcatctgcagtgatgacctgcagcccaacctgaacctgcagaccaagcctgtggaccccaccgtggagggcggggcccaggtgcagcaggtggtgaacattgaatgtgtgtctgacttcacagaggcccctgtgctgaacatccagttccgctatggaggcaccttccagaatgtgtctgtgcagctgcccatcaccctgaacaagttcttccagcccacagagatggccagccaggacttcttccagcgctggaagcagctgagcaacccccagcaggaggtgcagaacatcttcaaggccaagcaccccatggacacagaggtgaccaaggccaagatcatcggcttcggcagcgccctgctggaggaggtggaccccaacccagccaactttgtgggcgccggcatcatccacaccaagaccacccagatcggctgcctgctgcggctggagcccaacctgcaggcccagatgtaccgcctgaccctgcggaccagcaaggaggccgtgtcccagaggctgtgtgagctgctgagcgcccagttctag

SEQ ID NO: 142722 - DNA, 1062 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaatgccatcaagaatgacctggccagcaggaaccccaccttcatgggcctggccctgcactgcatcgcctctgtgggcagccgggagatggccgaggcctttgctggggagatccccaaggtgctggtggccggggacaccatggattctgtgaagcagagcgctgccctgtgcctgctgcggctgtaccgcaccagcccagacctggtgcccatgggagactggaccagccgggtggtgcacctgctgaatgaccagcacctgggcgtggtgacagctgccaccagcctcatcaccaccctggcccagaagaaccctgaggagttcaagacctctgtgtccctggccgtgtcccggctgagccgcatcgtgaccagcgccagcacagacctgcaggactacacctactactttgtgcctgccccctggctgtctgtgaagctgctgcggctgctgcagtgctacccacctccagaccctgctgtgcggggccgcctgacagaatgtctggagaccatcctgaacaaggcccaggagccccccaagagcaagaaggtgcagcacagcaatgccaagaatgctgtgctgtttgaggccatcagcctcatcatccaccacgaccgggagcccaacctgcaggcccagatgtaccgcctgaccctgcggaccagcaaggaggccgtgtcccagaggctgtgtgagctgctgagcgcccagttctag

SEQ ID NO: 142723 - DNA, 1971 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaatgccatcaagaatgacctggccagcaggaaccccaccttcatgggcctggccctgcactgcatcgcctctgtgggcagccgggagatggccgaggcctttgctggggagatccccaaggtgctggtggccggggacaccatggattctgtgaagcagagcgctgccctgtgcctgctgcggctgtaccgcaccagcccagacctggtgcccatgggagactggaccagccgggtggtgcacctgctgaatgaccagcacctgggcgtggtgacagctgccaccagcctcatcaccaccctggcccagaagaaccctgaggagttcaagacctctgtgtccctggccgtgtcccggctgagccgcatcgtgaccagcgccagcacagacctgcaggactacacctactactttgtgcctgccccctggctgtctgtgaagctgctgcggctgctgcagtgctacccacctcctgaggaccctgctgtgcggggccgcctgacagagtgcctggagaccatcctgaacaaggcccaggagccccccaagagcaagaaggtgcagcacagcaatgccaagaatgctgtgctgtttgaggccatcagcctcatcatccaccacgacagcgagcccaacctgctggtgcgggcctgcaaccagctgggccagttcctgcagcaccgggagaccaacctgcgctacctggccctggagagcatgtgcaccctggccagcagcgagttcagccatgaagctgtgaagacccacatcgagaccgtcatcaatgccctgaagacagaaagagatgtgtctgtgcggcagagagctgtggacctgctgtatgccatgtgtgacaggagcaatgccccccagatcgtggccgagatgctgagctacctggagacagctgactacagcatccgggaggagatcgtgctgaaggtggccatcctggccgagaagtatgctgtggactacacctggtacgtggacaccatcctgaacctgatcagaattgctggggactatgtgtctgaggaggtgtggtacagagtcatccagatcgtcatcaacagagatgatgtgcagggctatgctgccaagacagtgtttgaggccctgcaggccccagcctgccacgagaacctggtgaaggtgggcggctacatcctgggggagtttggaaacctgattgctggggaccccaggagcagccccctcatccagttccacctgctgcacagcaagttccacctgtgcagcgtgcccacccgggccctgctgctgagcacctacatcaagtttgtgaacctcttccctgaggtgaagcccaccatccaggatgtgctgcggagtgacagccagctgagaaatgctgatgtggagctgcagcagagagctgtggagtacctgcggctgagcacagtggccagcacagacatcctggccaccgtgctggaggagatgccacccttccctgagcgggagagcagcatcctggccaagctgaagaagaagaagggccccagcacagtgacagacctggaggacaccaagagggacagatctgtggatgtgaatggaggccctgagcccgccccagccagcaccagcgctgtgctgtgcctgtag

SEQ ID NO: 142724 - DNA, 2820 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaatgccatcaagaatgacctggccagcaggaaccccaccttcatgggcctggccctgcactgcatcgcctctgtgggcagccgggagatggccgaggcctttgctggggagatccccaaggtgctggtggccggggacaccatggattctgtgaagcagagcgctgccctgtgcctgctgcggctgtaccgcaccagcccagacctggtgcccatgggagactggaccagccgggtggtgcacctgctgaatgaccagcacctgggcgtggtgacagctgccaccagcctcatcaccaccctggcccagaagaaccctgaggagttcaagacctctgtgtccctggccgtgtcccggctgagccgcatcgtgaccagcgccagcacagacctgcaggactacacctactactttgtgcctgccccctggctgtctgtgaagctgctgcggctgctgcagtgctacccacctccagaccctgctgtgcggggccgcctgacagaatgtctggagaccatcctgaacaaggcccaggagccccccaagagcaagaaggtgcagcacagcaatgccaagaatgctgtgctgtttgaggccatcagcctcatcatccaccatgattctgagcccaacctgctggtgcgggcctgcaaccagctgggccagttcctgcagcaccgggagaccaacctgcgctacctggccctggagagcatgtgcaccctggccagcagcgagttcagccatgaggccgtgaagacccacattgaaacagtcatcaatgccctgaagacagaaagagatgtgtctgtgcggcagagagctgtggacctgctgtatgccatgtgtgacaggagcaatgccccccagatcgtggccgagatgctgagctacctggagacagctgactacagcatccgggaggagatcgtgctgaaggtggccatcctggccgagaagtatgctgtggactacacctggtacgtggacaccatcctgaacctgatcagaattgctggggactatgtgtctgaggaggtgtggtacagagtcatccagatcgtcatcaacagagatgatgtgcagggctacgccgccaagacagtgtttgaggccctgcaggccccagcctgccacgagaacctggtgaaggtgggcggctacatcctgggggagtttggaaacctgattgctggggaccccaggagcagccccctcatccagttccacctgctgcacagcaagttccacctgtgcagcgtgcccacccgggccctgctgctgagcacctacatcaagtttgtgaacctcttccctgaggtgaagcccaccatccaggatgtgctgcggagtgacagccagctgagaaatgctgatgtggagctgcagcagagagctgtggagtacctgcggctgagcacagtggccagcacagacatcctggccaccgtgctggaggagatgccacccttccctgagcgggagagcagcatcctggccaagctgaagaagaagaagggccccagcacagtgacagacctggaggacaccaagagggacagatctgtggatgtgaatggaggccctgagcccgccccagccagcaccagcgctgtgtccacccccagccccagcgctgacctgctgggcctgggcgccgcccccccagccccagctggccccccacccagcagcggcggcagcggcctgctggtggatgtgttcagtgacagcgcctctgtggtggcccccctggcccctggcagcgaggacaactttgccaggtttgtgtgcaagaacaacggggtgctgtttgagaaccagctgctgcagatcggcctgaagtctgagttccggcagaacctgggccgcatgttcatcttctacggcaacaagaccagcacccagttcctgaacttcacccccaccctcatctgcagtgatgacctgcagcccaacctgaacctgcagaccaagcctgtggaccccaccgtggagggcggggcccaggtgcagcaggtggtgaacattgaatgtgtgtctgacttcacagaggcccctgtgctgaacatccagttccgctatggaggcaccttccagaatgtgtctgtgcagctgcccatcaccctgaacaagttcttccagcccacagagatggccagccaggacttcttccagcgctggaagcagctgagcaacccccagcaggaggtgcagaacatcttcaaggccaagcaccccatggacacagaggtgaccaaggccaagatcattggatttggaagtgccctgctggaggaggtggaccccaacccagccaactttgtgggcgccggcatcatccacaccaagaccacccagatcggctgcctgctgcggctggagcccaacctgcaggcccagatgtaccgcctgaccctgcggaccagcaaggaggccgtgtcccagaggctgtgtgagctgctgagcgcccagttctag

SEQ ID NO: 142725 - DNA, 2040 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaatgccatcaagacagaaagagatgtgtctgtgcggcagagagctgtggacctgctgtatgccatgtgtgacaggagcaatgccccccagatcgtggccgagatgctgagctacctggagacagctgactacagcatccgggaggagatcgtgctgaaggtggccatcctggccgagaagtatgctgtggactacacctggtacgtggacaccatcctgaacctgatcagaattgctggggactatgtgtctgaggaggtgtggtacagagtcatccagatcgtcatcaacagagatgatgtgcagggctacgccgccaagacagtgtttgaggccctgcaggccccagcctgccacgagaacctggtgaaggtgggcggctacatcctgggggagtttggaaacctgattgctggggaccccaggagcagccccctcatccagttccacctgctgcacagcaagttccacctgtgcagcgtgcccacccgggccctgctgctgagcacctacatcaagtttgtgaacctcttccctgaggtgaagcccaccatccaggatgtgctgcggagtgacagccagctgagaaatgctgatgtggagctgcagcagagagctgtggagtacctgcggctgagcacagtggccagcacagacatcctggccaccgtgctggaggagatgccacccttccctgagcgggagagcagcatcctggccaagctgaagaagaagaagggccccagcacagtgacagacctggaggacaccaagagggacagatctgtggatgtgaatggaggccctgagcccgccccagccagcaccagcgctgtgtccacccccagccccagcgctgacctgctgggcctgggcgccgcccccccagccccagctggccccccacccagcagcggcggcagcggcctgctggtggatgtgttcagtgacagcgcctctgtggtggcccccctggcccctggcagcgaggacaactttgccaggtttgtgtgcaagaacaacggggtgctgtttgagaaccagctgctgcagatcggcctgaagtctgagttccggcagaacctgggccgcatgttcatcttctacggcaacaagaccagcacccagttcctgaacttcacccccaccctcatctgcagtgatgacctgcagcccaacctgaacctgcagaccaagcctgtggaccccaccgtggagggcggggcccaggtgcagcaggtggtgaacattgaatgtgtgtctgacttcacagaggcccctgtgctgaacatccagttccgctatggaggcaccttccagaatgtgtctgtgcagctgcccatcaccctgaacaagttcttccagcccacagagatggccagccaggacttcttccagcgctggaagcagctgagcaacccccagcaggaggtgcagaacatcttcaaggccaagcaccccatggacacagaggtgaccaaggccaagatcattggatttggaagtgccctgctggaggaggtggaccccaacccagccaactttgtgggcgccggcatcatccacaccaagaccacccagatcggctgcctgctgcggctggagcccaacctgcaggcccagatgtaccgcctgaccctgcggaccagcaaggaggccgtgtcccagaggctgtgtgagctgctgagcgcccagttctag

SEQ ID NO: 142726 - DNA, 2031 bp, Artificial Sequence
  Description of Artificial Sequence: Synthetic coding sequence
atgcctgctgtgtccaaaggagatggcatgaggggcctggccgtgttcatcagtgacatccggaactgcaagagcaaggaggccgagatcaagaggatcaacaaggagctggccaacatccgcagcaagttcaagggggacaaggccctggatggctacagcaagaagaagtatgtgtgcaagctgctcttcatcttcctgctgggccatgacatcgactttggccacatggaggccgtgaacctgctgagcagcaaccgctacacagagaagcagatcggctacctgttcatctctgtgctggtgaacagcaacagcgagctgatccgcctcatcaacaacacagaaagagatgtgtctgtgcggcagagagctgtggacctgctgtatgccatgtgtgacaggagcaatgccccccagatcgtggccgagatgctgagctacctggagacagctgactacagcatccgggaggagatcgtgctgaaggtggccatcctggccgagaagtatgctgtggactacacctggtacgtggacaccatcctgaacctgatcagaattgctggggactatgtgtctgaggaggtgtggtacagagtcatccagatcgtcatcaacagagatgatgtgcagggctatgctgccaagacagtgtttgaggccctgcaggccccagcctgccacgagaacctggtgaaggtgggcggctacatcctgggggagtttggaaacctgattgctggggaccccaggagcagccccctcatccagttccacctgctgcacagcaagttccacctgtgcagcgtgcccacccgggccctgctgctgagcacctacatcaagtttgtgaacctcttccctgaggtgaagcccaccatccaggatgtgctgcggagtgacagccagctgagaaatgctgatgtggagctgcagcagagagctgtggagtacctgcggctgagcacagtggccagcacagacatcctggccaccgtgctggaggagatgccacccttccctgagcgggagagcagcatcctggccaagctgaagaagaagaagggccccagcacagtgacagacctggaggacaccaagagggacagatctgtggatgtgaatggaggccctgagcccgccccagccagcaccagcgctgtgtccacccccagccccagcgctgacctgctgggcctgggcgccgcccccccagccccagctggccccccacccagcagcggcggcagcggcctgctggtggatgtgttcagtgacagcgcctctgtggtggcccccctggcccctggcagcgaggacaactttgccaggtttgtgtgcaagaacaatggagtgctgtttgagaaccagctgctgcagatcggcctgaagtctgagttccggcagaacctgggccgcatgttcatcttctacggcaacaagaccagcacccagttcctgaacttcacccccaccctcatctgcagtgatgacctgcagcccaacctgaacctgcagaccaagcctgtggaccccaccgtggagggcggggcccaggtgcagcaggtggtgaacattgaatgtgtgtctgacttcacagaggcccctgtgctgaacatccagttccgctatggaggcaccttccagaatgtgtctgtgcagctgcccatcaccctgaacaagttcttccagcccacagagatggccagccaggacttcttccagcgctggaagcagctgagcaacccccagcaggaggtgcagaacatcttcaaggccaagcaccccatggacacagaggtgaccaaggccaagatcatcggcttcggcagcgccctgctggaggaggtggaccccaacccagccaactttgtgggcgccggcatcatccacaccaagaccacccagatcggctgcctgctgcggctggagcccaacctgcaggcccagatgtaccgcctgaccctgcggaccagcaaggaggccgtgtcccagaggctgtgtgagctgctgagcgcccagttctag

SEQ ID NO: 142727 - DNA, 2814 bp, Artificial Sequence
  Description of Artificial Sequence: Synthetic coding sequence
atgacagacagcaagtacttcaccaccaacaagaagggggagatctttgagctgaaggccgagctgaacaatgagaagaaggagaagaggaaggaggccgtgaagaaggtgattgctgccatgacagtgggcaaggatgtgagcagcctcttcccagatgtggtgaactgcatgcagacagacaacctggagctgaagaagctggtgtacctgtacctgatgaactatgccaagagccagcctgacatggccatcatggctgtgaacagctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagatggtggaggaccagggcttcctggacagcctgcgggacctgattgctgacagcaaccccatggtggtggccaatgctgtggccgccctgtctgagatcagcgagagccaccccaacagcaacctgctggacctgaacccccagaacatcaacaagctgctgacagccctgaatgaatgtacagagtggggccagatcttcatcctggactgcctgagcaactacaaccccaaggatgaccgggaggcccagagcatctgtgagcgggtgaccccccggctgagccacgccaacagcgctgtggtgctgtctgctgtgaaggtgctgatgaagttcctggagctgctgcccaaggacagcgactactacaacatgctgctgaagaagctggccccacccctggtgaccctgctgtctggagagcctgaggtgcagtatgtggccctgaggaacatcaacctgattgtgcagaagaggcctgagatcctgaagcaggagatcaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatccgggacatcttcaggaagtaccccaacaagtatgagagcatcatcgccaccctgtgtgagaacctggacagcctggatgagccagatgcccgggccgccatgatctggatcgtgggggagtatgcagagagaattgacaatgctgatgagctgctggagagcttcctggagggcttccatgatgagagcacccaggtgcagctgaccctgctgacagccatcgtgaagctgttcctgaagaagcccagcgagacccaggagctggtgcagcaggtgctgagcctggccacccaggacagcgacaacccagacctgcgggaccggggctacatctactggaggctgctgagcacagatcctgtgacagccaaggaggtggtgctgtctgagaagcccctcatcagcgaggagacagacctgattgagcccaccctgctggatgagctgatctgccacatcggcagcctggcctctgtgtaccacaagcccccaaatgcctttgtggagggcagccacggcatccacaggaagcacctgcccatccaccacggcagcacagatgctggggacagccctgtgggcaccaccacagccaccaacctggagcagccccaggtgatccccagccagggcgacctgctgggggacctgctgaacctggacctgggcccccctgtgaatgtgccccaggtgtcctccatgcagatgggcgctgtggacctgctgggcggcggcctggacagcctggtgggccagagcttcatccccagctctgtgcctgccacctttgcccccagccccaccccagctgtggtgagcagcggcctgaatgacctgtttgagctgagcacaggcatcggcatggcccctgggggctacgtggcccccaaggctgtgtggctgcctgctgtgaaggccaagggcctggagatcagcggcaccttcacccaccggcagggccacatctacatggagatgaacttcaccaacaaggccctgcagcacatgacagactttgccatccagttcaacaagaacagctttggagtcatccccagcacccccctggccatccacacccccctgatgcccaaccagagcattgatgtgtccctgcccctgaacaccctgggccctgtgatgaagatggagcccctgaacaacctgcaggtggccgtgaagaacaacattgatgtgttctacttcagctgcctgatccccctgaatgtgctgtttgtggaggatggcaagatggagcggcaggtgttcctggccacctggaaggacatccccaatgaaaatgagctgcagttccagatcaaggagtgccacctgaatgctgacacagtgagcagcaagctgcagaacaacaacgtgtacaccatcgccaagagaaatgtggagggccaggacatgctgtaccagagcctgaagctgaccaacggcatctggatcctggccgagctgcgcatccagcccggcaaccccaactacaccctgagcctgaagtgccgggcccctgaggtgtcccagtacatctaccaggtgtatgacagcatcctgaagaactag

SEQ ID NO: 142728 - DNA, 2856 bp, Artificial Sequence
  Description of Artificial Sequence: Synthetic coding sequence
atgacagacagcaagtacttcaccaccaacaagaagggggagatctttgagctgaaggccgagctgaacaatgagaagaaggagaagaggaaggaggccgtgaagaaggtgattgctgccatgacagtgggcaaggatgtgagcagcctcttcccagatgtggtgaactgcatgcagacagacaacctggagctgaagaagctggtgtacctgtacctgatgaactatgccaagagccagcctgacatggccatcatggctgtgaacagctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagatggtggaggaccagggcttcctggacagcctgcgggacctgattgctgacagcaaccccatggtggtggccaatgctgtggccgccctgtctgagatcagcgagagccaccccaacagcaacctgctggacctgaacccccagaacatcaacaagctgctgacagccctgaatgaatgtacagagtggggccagatcttcatcctggactgcctgagcaactacaaccccaaggatgaccgggaggcccagagcatctgtgagcgggtgaccccccggctgagccacgccaacagcgctgtggtgctgtctgctgtgaaggtgctgatgaagttcctggagctgctgcccaaggacagcgactactacaacatgctgctgaagaagctggccccacccctggtgaccctgctgtctggagagcctgaggtgcagtatgtggccctgaggaacatcaacctgattgtgcagaagaggcctgagatcctgaagcaggagatcaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatccgggacatcttcaggaagtaccccaacaagtatgagagcatcatcgccaccctgtgtgagaacctggacagcctggatgagccagatgcccgggccgccatgatctggatcgtgggggagtatgcagagagaattgacaatgctgatgagctgctggagagcttcctggagggcttccatgatgagagcacccaggtgcagctgaccctgctgacagccatcgtgaagctgttcctgaagaagcccagcgagacccaggagctggtgcagcaggtgctgagcctggccacccaggacagcgacaacccagacctgcgggaccggggctacatctactggaggctgctgagcacagatcctgtgacagccaaggaggtggtgctgtctgagaagcccctcatcagcgaggagacagacctgattgagcccaccctgctggatgagctgatctgccacatcggcagcctggcctctgtgtaccacaagcccccaaatgcctttgtggagggcagccacggcatccacaggaagcacctgcccatccaccacggcagcacagatgctggggacagccctgtgggcaccaccacagccaccaacctggagcagccccaggtgatccccagccagggcgacctgctgggggacctgctgaacctggacctgggcccccctgtgaatgtgccccaggtgtcctccatgcagatgggcgctgtggacctgctgggcggcggcctggacagcctgctgggcagtgacctgggcggcggcatcggcggcagccctgctgtgggccagagcttcatccccagctctgtgcctgccacctttgcccccagccccaccccagctgtggtgagcagcggcctgaatgacctgtttgagctgagcacaggcatcggcatggcccctgggggctacgtggcccccaaggctgtgtggctgcctgctgtgaaggccaagggcctggagatcagcggcaccttcacccaccggcagggccacatctacatggagatgaacttcaccaacaaggccctgcagcacatgacagactttgccatccagttcaacaagaacagctttggagtcatccccagcacccccctggccatccacacccccctgatgcccaaccagagcattgatgtgtccctgcccctgaacaccctgggccctgtgatgaagatggagcccctgaacaacctgcaggtggccgtgaagaacaacattgatgtgttctacttcagctgcctgatccccctgaatgtgctgtttgtggaggatggcaagatggagcggcaggtgttcctggccacctggaaggacatccccaatgaaaatgagctgcagttccagatcaaggagtgccacctgaatgctgacacagtgagcagcaagctgcagaacaacaacgtgtacaccatcgccaagagaaatgtggagggccaggacatgctgtaccagagcctgaagctgaccaacggcatctggatcctggccgagctgcgcatccagcccggcaaccccaactacaccctgagcctgaagtgccgggcccctgaggtgtcccagtacatctaccaggtgtatgacagcatcctgaagaactag

SEQ ID NO: 142729 - DNA, 2856 bp, Artificial Sequence; identical to SEQ ID NO: 142728
  Description of Artificial Sequence: Synthetic coding sequence

SEQ ID NO: 142730 - DNA, 2643 bp, Artificial Sequence
  Description of Artificial Sequence: Synthetic coding sequence
atgcagacagacaacctggagctgaagaagctggtgtacctgtacctgatgaactatgccaagagccagcctgacatggccatcatggctgtgaacagctttgtgaaggactgtgaggaccccaaccccctcatccgggccctggccgtgaggaccatgggctgcatccgggtggacaagatcacagagtacctgtgtgagcccctgaggaagtgcctgaaggatgaggacccctacgtgaggaagacagctgctgtgtgtgtggccaagctgcatgacatcaatgcccagatggtggaggaccagggcttcctggacagcctgcgggacctgattgctgacagcaaccccatggtggtggccaatgctgtggccgccctgtctgagatcagcgagagccaccccaacagcaacctgctggacctgaacccccagaacatcaacaagctgctgacagccctgaatgaatgtacagagtggggccagatcttcatcctggactgcctgagcaactacaaccccaaggatgaccgggaggcccagagcatctgtgagcgggtgaccccccggctgagccacgccaacagcgctgtggtgctgtctgctgtgaaggtgctgatgaagttcctggagctgctgcccaaggacagcgactactacaacatgctgctgaagaagctggccccacccctggtgaccctgctgagcggggagcctgaggtgcagtatgtggccctgaggaacatcaacctgattgtgcagaagaggcctgagatcctgaagcaggagatcaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatccgggacatcttcaggaagtaccccaacaagtatgagagcatcatcgccaccctgtgtgagaacctggacagcctggatgagccagatgcccgggccgccatgatctggatcgtgggggagtatgcagagagaattgacaatgctgatgagctgctggagagcttcctggagggcttccatgatgagagcacccaggtgcagctgaccctgctgacagccatcgtgaagctgttcctgaagaagcccagcgagacccaggagctggtgcagcaggtgctgagcctggccacccaggacagcgacaacccagacctgcgggaccggggctacatctactggaggctgctgagcacagatcctgtgacagccaaggaggtggtgctgtctgagaagcccctcatcagcgaggagacagacctgattgagcccaccctgctggatgagctgatctgccacatcggcagcctggcctctgtgtaccacaagcccccaaatgcctttgtggagggcagccacggcatccacaggaagcacctgcccatccaccacggcagcacagatgctggggacagccctgtgggcaccaccacagccaccaacctggagcagccccaggtgatccccagccagggcgacctgctgggggacctgctgaacctggacctgggcccccctgtgaatgtgccccaggtgtcctccatgcagatgggcgctgtggacctgctgggcggcggcctggacagcctggtgggccagagcttcatccccagctctgtgcctgccacctttgcccccagccccaccccagctgtggtgagcagcggcctgaatgacctgtttgagctgagcactggaattggcatggcccctgggggctacgtggcccccaaggctgtgtggctgcctgctgtgaaggccaagggcctggagatcagcggcaccttcacccaccggcagggccacatctacatggagatgaacttcaccaacaaggccctgcagcacatgacagactttgccatccagttcaacaagaacagctttggagtcatccccagcacccccctggccatccacacccccctgatgcccaaccagagcattgatgtgtccctgcccctgaacaccctgggccctgtgatgaagatggagcccctgaacaacctgcaggtggccgtgaagaacaacattgatgtgttctacttcagctgcctgatccccctgaatgtgctgtttgtggaggatggcaagatggagcggcaggtgttcctggccacctggaaggacatccccaatgaaaatgagctgcagttccagatcaaggagtgccacctgaatgctgacacagtgagcagcaagctgcagaacaacaacgtgtacaccatcgccaagagaaatgtggagggccaggacatgctgtaccagagcctgaagctgaccaacggcatctggatcctggccgagctgcgcatccagcccggcaaccccaactacaccctgagcctgaagtgccgggcccctgaggtgtcccagtacatctaccaggtgtatgacagcatcctgaagaactag

SEQ ID NO: 142731 - DNA, 2067 bp, Artificial Sequence
  Description of Artificial Sequence: Synthetic coding sequence
atgaagttcctggagctgctgcccaaggacagcgactactacaacatgctgctgaagaagctggccccacccctggtgaccctgctgagcggggagcctgaggtgcagtatgtggccctgaggaacatcaacctgattgtgcagaagaggcctgagatcctgaagcaggagatcaaggtgttctttgtgaagtacaatgaccccatctacgtgaagctggagaagctggacatcatgatccggctggccagccaggccaacatcgcccaggtgctggccgagctgaaggagtatgccacagaggtggatgtggactttgtgaggaaggctgtgcgggccatcggccgctgtgccatcaaggtggagcagagcgctgagcgctgtgtgtccaccctgctggacctgatccagaccaaggtgaactacgtggtgcaggaggccatcgtggtgatccgggacatcttcaggaagtaccccaacaagtatgagagcatcatcgccaccctgtgtgagaacctggacagcctggatgagccagatgcccgggccgccatgatctggatcgtgggggagtatgcagagagaattgacaatgctgatgagctgctggagagcttcctggagggcttccatgatgagagcacccaggtgcagctgaccctgctgacagccatcgtgaagctgttcctgaagaagcccagcgagacccaggagctggtgcagcaggtgctgagcctggccacccaggacagcgacaacccagacctgcgggaccggggctacatctactggaggctgctgagcacagatcctgtgacagccaaggaggtggtgctgtctgagaagcccctcatcagcgaggagacagacctgattgagcccaccctgctggatgagctgatctgccacatcggcagcctggcctctgtgtaccacaagcccccaaatgcctttgtggagggcagccacggcatccacaggaagcacctgcccatccaccacggcagcacagatgctggggacagccctgtgggcaccaccacagccaccaacctggagcagccccaggtgatccccagccagggcgacctgctgggggacctgctgaacctggacctgggcccccctgtgaatgtgccccaggtgtcctccatgcagatgggcgctgtggacctgctgggcggcggcctggacagcctgctgggcagtgacctgggcggcggcattggaggcagccctgctgtgggccagagcttcatccccagctctgtgcctgccacctttgcccccagccccaccccagctgtggtgagcagcggcctgaatgacctgtttgagctgagcactggaattggcatggcccctgggggctacgtggcccccaaggctgtgtggctgcctgctgtgaaggccaagggcctggagatcagcggcaccttcacccaccggcagggccacatctacatggagatgaacttcaccaacaaggccctgcagcacatgacagactttgccatccagttcaacaagaacagctttggagtcatccccagcacccccctggccatccacacccccctgatgcccaaccagagcattgatgtgtccctgcccctgaacaccctgggccctgtgatgaagatggagcccctgaacaacctgcaggtggccgtgaagaacaacattgatgtgttctacttcagctgcctgatccccctgaatgtgctgtttgtggaggatggcaagatggagcggcaggtgttcctggccacctggaaggacatccccaatgaaaatgagctgcagttccagatcaaggagtgccacctgaatgctgacacagtgagcagcaagctgcagaacaacaacgtgtacaccatcgccaagagaaatgtggagggccaggacatgctgtaccagagcctgaagctgaccaacggcatctggatcctggccgagctgcgcatccagcccggcaaccccaactacaccctgagcctgaagtgccgggcccctgaggtgtcccagtacatctaccaggtgtatgacagcatcctgaagaactag

SEQ ID NO: 142732 - DNA, 1308 bp, Artificial Sequence
  Description of Artificial Sequence: Synthetic coding sequence
atgattggaggcctcttcatctacaaccacaagggggaggtgctgatcagccgggtgtacagagatgacatcggcagaaatgctgtggatgccttccgggtgaatgtcatccacgcccggcagcaggtgcgcagccctgtgaccaacatcgcccggaccagcttcttccacgtgaagaggagcaacatctggctggccgctgtgaccaagcagaatgtgaatgctgccatggtgtttgagttcctgtacaagatgtgtgatgtgatggccgcctactttgggaagatcagcgaggagaacatcaagaacaactttgtgctgatctatgagctgctggatgagatcctggactttggctacccccagaacagcgagaccggggccctgaagaccttcatcacccagcagggcatcaagagccagcaccagaccaaggaggagcagagccagatcaccagccaggtgacaggccagatcggctggaggcgggagggcatcaagtacagaagaaatgaactcttcctggatgtgctggagagcgtgaacctgctgatgagcccccagggccaggtgctgagcgcccacgtgtctggccgggtggtgatgaagagctacctgagcggcatgcctgagtgcaagtttggcatgaatgacaagatcgtcatcgagaagcagggcaaaggaacagcagatgagaccagcaagagcggcaagcagagcatcgccattgatgactgcaccttccaccagtgtgtgcggctgagcaagtttgattctgagaggagcatctccttcatccccccagatggagaatttgagctgatgagataccgcaccaccaaggacatcatcctgcccttccgggtcatccccctggtgcgggaggtgggccgcaccaagctggaggtgaaggtggtgatcaagagcaacttcaagcccagcctgctggcccagaagattgaggtgcgcatccccacccccctgaacaccagcggcgtgcaggtgatctgcatgaagggcaaggccaagtacaaggcctctgaaaatgccatcgtgtggaagatcaagaggatggccggcatgaaggagagccagatctctgctgagattgagctgctgcccaccaatgacaagaagaagtgggcccggccccccatctccatgaactttgaggtgccctttgcccccagcggcctgaaggtgcgctacctgaaggtgtttgagcccaagctgaactacagcgaccatgatgtgatcaagtgggtgcgctacatcggccgcagcggcatctatgagacccgctgctag

SEQ ID NO: 142733 - DNA, 1302 bp, Artificial Sequence
  Description of Artificial Sequence: Synthetic coding sequence
atgattggaggcctcttcatctacaaccacaagggggaggtgctgatcagccgggtgtacagagatgacatcggcagaaatgctgtggatgccttccgggtgaatgtcatccacgcccggcagcaggtgcgcagccctgtgaccaacatcgcccggaccagcttcttccacgtgaagaggagcaacatctggctggccgctgtgaccaagcagaatgtgaatgctgccatggtgtttgagttcctgtacaagatgtgtgatgtgatggccgcctactttgggaagatcagcgaggagaacatcaagaacaactttgtgctgatctatgagctgctggatgagatcctggactttggctacccccagaacagcgagaccggggccctgaagaccttcatcacccagcagggcatcaagagccagaccaaggaggagcagagccagatcaccagccaggtgacaggccagatcggctggaggcgggagggcatcaagtacagaagaaatgaactcttcctggatgtgctggagagcgtgaacctgctgatgagcccccagggccaggtgctgagcgcccacgtgtctggccgggtggtgatgaagagctacctgagcggcatgcctgagtgcaagtttggcatgaatgacaagatcgtcatcgagaagcagggcaaaggaacagcagatgagaccagcaagagcggcaagcagagcatcgccattgatgactgcaccttccaccagtgtgtgcggctgagcaagtttgattctgagaggagcatctccttcatccccccagatggagaatttgagctgatgagataccgcaccaccaaggacatcatcctgcccttccgggtcatccccctggtgcgggaggtgggccgcaccaagctggaggtgaaggtggtgatcaagagcaacttcaagcccagcctgctggcccagaagattgaggtgcgcatccccacccccctgaacaccagcggcgtgcaggtgatctgcatgaagggcaaggccaagtacaaggcctctgaaaatgccatcgtgtggaagatcaagaggatggccggcatgaaggagagccagatctctgctgagattgagctgctgcccaccaatgacaagaagaagtgggcccggccccccatctccatgaactttgaggtgccctttgcccccagcggcctgaaggtgcgctacctgaaggtgtttgagcccaagctgaactacagcgaccatgatgtgatcaagtgggtgcgctacatcggccgcagcggcatctatgagacccgctgctag

SEQ ID NO: 142734 - DNA, 1302 bp, Artificial Sequence; identical to SEQ ID NO: 142733
  Description of Artificial Sequence: Synthetic coding sequence

SEQ ID NO: 142735 - DNA, 342 bp, Artificial Sequence
  Description of Artificial Sequence: Synthetic coding sequence
atgattggaggcctcttcatctacaaccacaagggggaggtgctgatcagccgggtgtacagagatgacatcggcagaaatgctgtggatgccttccgggtgaatgtcatccacgcccggcagcaggtgcgcagccctgtgaccaacatcgcccggaccagcttcttccacgtgaagaggagcaacatctggctggccgctgtgaccaagcagaatgtgaatgctgccatggtgtttgagttcctgtacaagatgtgtgatgtgatggccgcctactttgggaagatcagcgaggagaacatcaagaacaactttgtgctgatctatgagctgctggactag

SEQ ID NO: 142736 - DNA, 1263 bp, Artificial Sequence
  Description of Artificial Sequence: Synthetic coding sequence
atgattggaggcctcttcatctacaaccacaagggggaggtgctgatcagccgggtgtacagagatgacatcggcagaaatgctgtggatgccttccgggtgaatgtcatccacgcccggcagcaggtgcgcagccctgtgaccaacatctggctggccgctgtgaccaagcagaatgtgaatgctgccatggtgtttgagttcctgtacaagatgtgtgatgtgatggccgcctactttgggaagatcagcgaggagaacatcaagaacaactttgtgctgatctatgagctgctggatgagatcctggactttggctacccccagaacagcgagactggagccctgaagaccttcatcacccagcagggcatcaagagccagaccaaggaggagcagagccagatcaccagccaggtgacaggccagatcggctggaggcgggagggcatcaagtacagaagaaatgagctgttcctggatgtgctggagagcgtgaacctgctgatgagcccccagggccaggtgctgagcgcccacgtgtctggccgggtggtgatgaagagctacctgagcggcatgcctgagtgcaagtttggcatgaatgacaagatcgtgattgagaagcagggcaagggcacagcagatgagaccagcaagagcggcaagcagagcatcgccattgatgactgcaccttccaccagtgtgtgcggctgagcaagtttgacagcgagaggagcatctccttcatccccccagatggagaatttgagctgatgagataccgcaccaccaaggacatcatcctgcccttccgggtcatccccctggtgcgggaggtgggccgcaccaagctggaggtgaaggtggtgatcaagagcaacttcaagcccagcctgctggcccagaagattgaggtgcgcatccccacccccctgaacaccagcggcgtgcaggtgatctgcatgaagggcaaggccaagtacaaggcctctgaaaatgccatcgtgtggaagatcaagaggatggccggcatgaaggagagccagatctctgctgagattgagctgctgcccaccaatgacaagaagaagtgggcccggccccccatctccatgaactttgaggtgccctttgcccccagcggcctgaaggtgcgctacctgaaggtgtttgagcccaagctgaactacagcgaccatgatgtgatcaagtgggtgcgctacatcggccgcagcggcatctatgagacccgctgctag

SEQ ID NO: 142737 - DNA, 1128 bp, Artificial Sequence
  Description of Artificial Sequence: Synthetic coding sequence
atgattggaggcctcttcatctacaaccacaagggggaggtgctgatcagccgggtgtacagagatgacatcggcagaaatgctgtggccgcctactttgggaagatcagcgaggagaacatcaagaacaactttgtgctgatctatgagctgctggatgagatcctggactttggctacccccagaacagcgagaccggggccctgaagaccttcatcacccagcagggcatcaagagccagcaccagaccaaggaggagcagagccagatcaccagccaggtgacaggccagatcggctggaggcgggagggcatcaagtacagaagaaatgaactcttcctggatgtgctggagagcgtgaacctgctgatgagcccccagggccaggtgctgagcgcccacgtgtctggccgggtggtgatgaagagctacctgagcggcatgcctgagtgcaagtttggcatgaatgacaagatcgtcatcgagaagcagggcaaaggaacagcagatgagaccagcaagagcggcaagcagagcatcgccattgatgactgcaccttccaccagtgtgtgcggctgagcaagtttgattctgagaggagcatctccttcatccccccagatggagaatttgagctgatgagataccgcaccaccaaggacatcatcctgcccttccgggtcatccccctggtgcgggaggtgggccgcaccaagctggaggtgaaggtggtgatcaagagcaacttcaagcccagcctgctggcccagaagattgaggtgcgcatccccacccccctgaacaccagcggcgtgcaggtgatctgcatgaagggcaaggccaagtacaaggcctctgaaaatgccatcgtgtggaagatcaagaggatggccggcatgaaggagagccagatctctgctgagattgagctgctgcccaccaatgacaagaagaagtgggcccggccccccatctccatgaactttgaggtgccctttgcccccagcggcctgaaggtgcgctacctgaaggtgtttgagcccaagctgaactacagcgaccatgatgtgatcaagtgggtgcgctacatcggccgcagcggcatctatgagacccgctgctag

SEQ ID NO: 142738 - DNA, 429 bp, Artificial Sequence
  Description of Artificial Sequence: Synthetic coding sequence
atgatccgcttcatcctgatccagaacagagctgggaagacccggctggccaagtggtacatgcagtttgatgatgatgagaagcagaagctgattgaggaggtgcatgctgtggtgacagtgagagatgccaagcacaccaactttgtggagttcaggaacttcaagatcatctaccgccgctatgccggcctgtacttctgcatctgtgtggatgtgaatgacaacaacctggcctacctggaggccatccacaactttgtggaggtgctgaatgagtacttccacaacgtgtgtgagctggacctggtgttcaacttctacaaggtgtacacagtggtggatgagatgttcctggccggggagatccgggagaccagccagaccaaggtgctgaagcagctgctgatgctgcagagcctggagtag

SEQ ID NO: 142739 - DNA, 315 bp, Artificial Sequence; identical to SEQ ID NO: 142717
  Description of Artificial Sequence: Synthetic coding sequence

SEQ ID NO: 142740 - DNA, 3285 bp, Artificial Sequence
  Description of Artificial Sequence: Synthetic coding sequence
atgagcagcaacagcttcccctacaatgagcagagcggcggcggggaggccacagagctgggccaggaggccaccagcaccatcagccccagcggggccttcggcctcttcagcagtgacctgaagaagaatgaagacctgaagcagatgctggagagcaacaaggacagcgccaagctggatgccatgaagagaattgtgggcatgattgccaagggcaagaatgccagcgagctgtttcctgctgtggtgaagaatgtggccagcaagaacatcgagatcaagaagctggtgtatgtgtacctggtgcgctatgcagaggagcagcaggacctggccctgctgagcatcagcaccttccagagggccctgaaggaccccaaccagctgatccgggccagcgccctgcgggtgctgagcagcatccgggtgcccatcatcgtgcccatcatgatgctggccatcaaggaggccagcgctgacctgagcccctacgtgaggaagaatgctgcccacgccatccagaagctgtacagcctggaccctgagcagaaggagatgctgattgaagtcatcgagaagctgctgaaggacaagagcaccctggtggccggctctgtggtgatggcctttgaggaggtgtgcccagacagaattgacctgatccacaagaactacaggaagctgtgcaacctgctggtggatgtggaggagtggggccaggtggtgatcatccacatgctgaccaggtatgcccggacccagtttgtgagcccctggaaggagggagatgagctggaggacaatggcaagaacttctatgaaagtgatgatgaccagaaggagaagacagacaagaagaagaagccctacaccatggaccctgaccaccggctgctgatccggaacaccaagcccctgctgcagagcagaaatgctgctgtggtgatggctgtggcccagctgtactggcacatcagccccaagtctgaggccggcatcatcagcaagagcctggtgcggctgctgcggagcaaccgggaggtgcagtacatcgtgctgcagaacatcgccaccatgagcatccagaggaagggcatgtttgagccctacctgaagagcttctacgtgcgcagcacagaccccaccatgatcaagaccctgaagctggagatcctgaccaacctggccaatgaggccaacatcagcaccctgctgcgggagttccagacctacgtgaagagccaggacaagcagtttgctgctgccaccatccagaccatcggccgctgtgccaccaacatcctggaggtgacagacacctgcctgaatggcctggtgtgcctgctgagcaacagagatgagatcgtggtggccgagagcgtggtggtgatcaagaagctgctgcagatgcagcctgcccagcacggggagatcatcaagcacatggccaagctgctggacagcatcaccgtgcctgtggcccgggccagcatcctgtggctgattggagagaactgtgagcgggtgcccaagatcgccccagatgtgctgaggaagatggccaagagcttcaccagtgaagatgacctggtgaagctgcagatcctgaacctgggcgccaagctgtacctgaccaacagcaagcagaccaagctgctgacccagtacatcctgaacctgggcaagtatgaccagaactatgacatccgggacaggacccgcttcatccggcagctgattgtgcccaacgtgaagagcggggccctgagcaaatatgccaagaagatcttcctggcccagaagccagcccccctgctggagagccccttcaaggaccgggaccacttccagctgggcaccctgagccacaccctgaacatcaaggccaccggctacctggagctgagcaactggccagaggtggccccagaccccagcgtgagaaatgtggaggtgattgagctggccaaggagtggaccccagctgggaaggccaagcaggagaacagcgccaagaagttctacagcgagagcgaggaggaggaggacagcagtgacagcagcagtgacagcgagagcgagagcggcagcgagagcggggagcagggcgagagcggggaggagggggacagcaatgaagacagcagcgaggacagcagcagcgagcaggacagcgagagcggccgggagagcggcctggagaacaagaggacagccaagaggaacagcaaggccaagggcaagagtgacagtgaagatggagagaaggaaaatgagaagagcaagaccagtgacagcagcaatgatgagagcagcagcattgaggacagcagcagtgacagcgagagcgagagcgagcctgagagcgagagcgagagcagaagagtgaccaaggagaaggagaagaagaccaagcaggacaggacccccctgaccaaggatgtgtccctgctggacctggatgacttcaaccctgtgtccacccctgtggccctgcccaccccagccctgagccccagcctgatggctgacctggagggcctgcacctgagcaccagcagcagcgtcatctctgtgtccaccccagcctttgtgcccaccaagacccacgtgctgctgcacaggatgtctgggaagggcctggccgcccactacttcttcccccggcagccctgcatctttggagacaagatggtgtccatccagatcaccctgaacaacaccacagacaggaagattgagaacatccacatcggggagaagaagctgcccatcggcatgaagatgcacgtgttcaaccccatcgacagcctggagcctgagggcagcatcaccgtgtccatgggcatcgacttctgtgacagcacccagacagccagcttccagctgtgcaccaaggatgactgcttcaacgtgaacatccagccccctgtgggggagctgctgctgcctgtggccatgtctgagaaggacttcaagaaggagcagggcgtgctgaccggcatgaatgagaccagcgctgtgatcatcgccgccccccagaacttcacccccagcgtcatcttccagaaggtggtgaatgtggccaacgtgggcgctgtgcccagcggccaggacaacatccacagatttgctgccaagacagtgcacagcggcagcctgatgctggtgacagtggagctgaaggagggcagcacagcccagctgatcatcaacacagagaagacagtgattggctctgtgctgctgcgggagctgaagcctgtgctgagccagggctag

SEQ ID NO: 142741 - DNA, 1698 bp, Artificial Sequence
  Description of Artificial Sequence: Synthetic coding sequence
atgagcagcaacagcttcccctacaatgagcagagcggcggcggggaggccacagagctgggccaggaggccaccagcaccatcagccccagcggggccttcggcctcttcagcagtgacctgaagaagaatgaagacctgaagcagatgctggagagcaacaaggacagcgccatcaaggaggccagcgctgacctgagcccctacgtgaggaagaatgctgcccacgccatccagaagctgtacagcctggaccctgagcagaaggagatgctgattgaagtcatcgagaagctgctgaaggacaagagcaccctggtggccggctctgtggtgatggcctttgaggaggtgtgcccagacagaattgacctgatccacaagaactacaggaagctgtgcaacctgctggtggatgtggaggagtggggccaggtggtgatcatccacatgctgaccaggtatgcccggacccagtttgtgagcccctggaaggagggagatgagctggaggacaatggcaagaacttctatgaaagtgatgatgaccagaaggagaagacagacaagaagaagaagccctacaccatggaccctgaccaccggctgctgatccggaacaccaagcccctgctgcagagcagaaatgctgctgtggtgatggctgtggcccagctgtactggcacatcagccccaagtctgaggccggcatcatcagcaagagcctggtgcggctgctgcggagcaaccgggaggtgcagtacatcgtgctgcagaacatcgccaccatgagcatccagaggaagggcatgtttgagccctacctgaagagcttctacgtgcgcagcacagaccccaccatgatcaagaccctgaagctggagatcctgaccaacctggccaatgaggccaacatcagcaccctgctgcgggagttccagacctacgtgaagagccaggacaagcagtttgctgctgccaccatccagaccatcggccgctgtgccaccaacatcctggaggtgacagacacctgcctgaatggcctggtgtgcctgctgagcaacagagatgagatcgtggtggccgagagcgtggtggtgatcaagaagctgctgcagatgcagcctgcccagcacggggagatcatcaagcacatggccaagctgctggacagcatcaccgtgcctgtggcccgggccagcatcctgtggctgattggagagaactgtgagcgggtgcccaagatcgccccagatgtgctgaggaagatggccaagagcttcaccagtgaagatgacctggtgaagctgcagatcctgaacctgggcgccaagctgtacctgaccaacagcaagcagaccaagctgctgacccagtacatcctgaacctgggcaagtatgaccagaactatgacatccgggacaggacccgcttcatccggcagctgattgtgcccaacgtgaagagcggggccctgagcaaatatgccaagaagatcttcctggcccagaagccagcccccctgctggagagccccttcaaggaccgggaccacttccagctgggcaccctgagccacaccctgaacatcaaggccaccggctacctggagctgagcaactggccagaggtggccccagaccccagcgtgagaaatgtggaggtgattgagctggtggtgctgtctgagtag

SEQ ID NO: 142742 - DNA, 2403 bp, Artificial Sequence
  Description of Artificial Sequence: Synthetic coding sequence
atgagcagcaacagcttcccctacaatgagcagagcggcggcggggaggccacagagctgggccaggaggccaccagcaccatcagccccagcggggccttcggcctcttcagcagtgacctgaagaagaatgaagacctgaagcagatgctggagagcaacaaggacagcgccaagctggatgccatgaagagaattgtgggcatgattgccaagggcaagaatgccagcgagctgtttcctgctgtggtgaagaatgtggccagcaagaacatcgagatcaagaagctggtgtatgtgtacctggtgcgctatgcagaggagcagcaggacctggccctgctgagcatcagcaccttccagagggccctgaaggaccccaaccagctgatccgggccagcgccctgcgggtgctgagcagcatccgggtgcccatcatcgtgcccatcatgatgctggccatcaaggaggccagcgctgacctgagcccctacgtgaggaagaatgctgcccacgccatccagaagctgtacagcctggaccctgagcagaaggagatgctgattgaagtcatcgagaagctgctgaaggacaagagcaccctggtggccggctctgtggtgatggcctttgaggaggtgtgcccagacagaattgacctgatccacaagaactacaggaagctgtgcaacctgctggtggatgtggaggagtggggccaggtggtgatcatccacatgctgaccaggtatgcccggacccagtttgtgagcccctggaaggagggagatgagctggaggacaatggcaagaacttctatgaaagtgatgatgaccagaaggagaagacagacaagaagaagaagccctacaccatggaccctgaccaccggctgctgatccggaacaccaagcccctgctgcagagcagaaatgctgctgtggtgatggctgtggcccagctgtactggcacatcagccccaagtctgaggccggcatcatcagcaagagcctggtgcggctgctgcggagcaaccgggaggtgcagtacatcgtgctgcagaacatcgccaccatgagcatccagaggaagggcatgtttgagccctacctgaagagcttctacgtgcgcagcacagaccccaccatgatcaagaccctgaagctggagatcctgaccaacctggccaatgaggccaacatcagcaccctgctgcgggagttccagacctacgtgaagagccaggacaagcagtttgctgctgccaccatccagaccatcggccgctgtgccaccaacatcctggaggtgacagacacctgcctgaatggcctggtgtgcctgctgagcaacagagatgagatcgtggtggccgagagcgtggtggtgatcaagaagctgctgcagatgcagcctgcccagcacggggagatcatcaagcacatggccaagctgctggacagcatcaccgtgcctgtggcccgggccagcatcctgtggctgattggagagaactgtgagcgggtgcccaagatcgccccagatgtgctgaggaagatggccaagagcttcaccagtgaagatgacctggtgaagctgcagatcctgaacctgggcgccaagctgtacctgaccaacagcaagcagaccaagctgctgacccagtacatcctgaacctgggcaagtatgaccagaactatgacatccgggacaggacccgcttcatccggcagctgattgtgcccaacgtgaagagcggggccctgagcaaatatgccaagaagatcttcctggcccagaagccagcccccctgctggagagccccttcaaggaccgggaccacttccagctgggcaccctgagccacaccctgaacatcaaggccaccggctacctggagctgagcaactggccagaggtggccccagaccccagcgtgagaaatgtggaggtgattgagctggccaaggagtggaccccagctgggaaggccaagcaggagaacagcgccaagaagttctacagcgagagcgaggaggaggaggacagcagtgacagcagcagtgacagcgagagcgagagcggcagcgagagcggggagcagggcgagagcggggaggagggggacagcaatgaagacagcagcgaggacagcagcagcgagcaggacagcgagagcggccgggagagcggcctggagaacaagaggacagccaagaggaacagcaaggccaagggcaagagtgacagtgaagatggagagaaggaaaatgagaagagcaagaccagtgacagcagcaatgatgagagcagcagcattgaggacagcagcagtgacagcgagagcgagagcgagcctgagagcgagagcgagagcagaagagtgaccaaggagtag

SEQ ID NO: 142743 - DNA, 582 bp, Artificial Sequence
  Description of Artificial Sequence: Synthetic coding sequence
atgatcaaggccatcctgatcttcaacaaccacggcaagccccggctgagcaagttctaccagccctacagcgaggacacccagcagcagatcatccgggagaccttccacctggtgtccaagagagatgaaaatgtgtgcaacttcctggagggcggcctgctgattggaggcagtgacaacaagctgatctaccgccactacgccaccctgtactttgtgttctgtgtggacagcagcgagagcgagctgggcatcctggacctgatccaggtgtttgtggagaccctggacaagtgctttgaaaatgtgtgtgagctggacctgatcttccacgtggacaaggtgcacaacatcctggccgagatggtgatgggcggcatggtgctggagaccaacatgaatgaaattgtgacccagattgatgcccagaacaagctggagaagtctgaggccggcctggccggggccccagcccgggctgtgtctgctgtgaagaacatgaacctgcctgagatccccaggaacatcaacattggagacatcagcatcaaggtgcccaacctgcccagcttcaagtag

SEQ ID NO: 142744 - DNA, 450 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtgtctgagctggatgtgtccttcttcaacacagtgttccacagcacctggcagatgcacagcggcccctaccagaccaggagctgcagcgtgacccaggccggcgtgcagagatgtgaccacggcagcctgcaccctggcagccctggcctgaagtag

SEQ ID NO: 142745 - DNA, 408 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtggagcccattgatgagctgcccaagatctgcagcgccctggagccccagcagacctgcttctccccagacagcagcagcttcaagggggccgccagcaccacccccatctactag

SEQ ID NO: 142746 - DNA, 2220 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgctacatgacccagggcctggacatgtctggagtcttcatggagatggtgaaggccagcgccaccgtggacatcgtgcagaagaagctggtgtacctgtacatgtgcacctacgcccccctgaagccagacctggccctgctggccatcaacaccctgtgcaaggactgcagcgaccccaaccccatggtgcggggcctggccctgcgctccatgtgcagcctgaggatgcctggggtgcaggagtacatccagcagcccatcctgaatggcctgcgggacaaggccagctatgtgagaagagtggccgtgctgggctgtgccaagatgcacaacctgcatggagacagcgaggtggatggagccctggtgaatgagctgtacagcctgctgcgggaccaggaccccatcgtggtggtgaactgcctgcggagcctggaggagatcctgaagcaggagggcggcgtggtgatcaacaagcccatcgcccaccacctgctgaacaggatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctggccaagatgttcccccacgtgcagacagatgtgctggtgcgggtgaagggccccctgctggccgcctgcagcagcgagagccgggagctgtgctttgtggccctgtgccacgtgcggcagatcctgcacagcctgcccggccacttcagcagccactacaagaagttcttctgcagctacagcgagccccactacatcaagctgcagaaggtggaggtgctgtgtgagctggtgaatgatgaaaatgtgcagcaggtgctggaggagctgcggggctactgcacagatgtgtctgctgactttgcccaggccgccatctttgccatcggcggcatcgcccggacctacacagaccagtgtgtgcagatcctgacagagctgctgggcctgcggcaggagcacatcaccaccgtggtggtgcagaccttccgggacctggtgtggctgtgcccccagtgcacagaggccgtgtgccaggccctgcccggctgtgaggagaacatccaggacagcgagggcaagcaggccctgatctggctgctgggcgtgcacggggagcgcatccccaatgccccctacgtgctggaggactttgtggagaatgtgaagtctgagaccttccctgctgtgaagatggagctgctgacagccctgctgcggctcttcctgagcaggcctgctgagtgccaggacatgctgggccgcctgctgtactactgcatcgaggaggagaaggacatggctgtgcgggaccggggcctcttctactaccgcctgctgctggtgggcattgatgaggtgaagaggatcctgtgcagccccaagagtgaccccaccctgggcctgctggaggaccctgctgagaggcctgtgaacagctgggccagtgacttcaacaccctggtgcctgtgtatggcaaggcccactgggccaccatcagcaagtgccagggcgctgagcgctgtgaccctgagctgcccaagaccagcagctttgctgccagcggccccctcatccctgaggagaacaaggagcgggtgcaggagctgcctgattctggggccctgatgctggtgcccaaccggcagctgacagctgactactttgagaagacctggctgagcctgaaggtggcccaccagcaggtgctgccctggagaggagagttccacccagacaccctgcagatggccctgcaggtggtgaacatccagaccatcgccatgagccgggccggcagccggccctggaaggcctacctgagcgcccaggatgacaccggctgcctcttcctgacagagctgctgctggagcccggcaacagcgagatgcagatctctgtgaagcagaatgaggccaggacagagaccctgaacagcttcatctctgtgctggagaccgtgattggcaccatcgaggagatcaagagctag

SEQ ID NO: 142747 - DNA, 891 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgcatgcctggggtgcaggagtacatccagcagcccatcctgaatggcctgcgggacaaggccagctatgtgcggcgggtggccgtgctgggctgtgccaagatgcacaacctgcacggggacagcgaggtggatggagccctggtgaatgagctgtacagcctgctgcgggaccaggaccccatcgtggtggtgaactgcctgcggagcctggaggagatcctgaagcaggagggcggcgtggtgatcaacaagcccatcgcccaccacctgctgaacaggatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctggccaagatgttcccccacgtgcagacagatgtgctggtgcgggtgaagggccccctgctggccgcctgcagcagcgagagccgggagctgtgctttgtggccctgtgccacgtgcggcagatcctgcacagcctgcccggccacttcagcagccactacaagaagttcttctgcagctacagcgagccccactacatcaagctgcagaaggtggaggtgctgtgtgagctggtgaatgatgaaaatgtgcagcaggtgctggaggagctgcggggctactgcacagatgtgtctgctgactttgcccaggccgccatctttgccatctag

SEQ ID NO: 142748 - DNA, 909 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgctacatgacccagggcctggacatgtctggagtcttcatggagatggtgaaggccagcgccaccgtggacatcgtgcagaagaagctggtgtacctgtacatgtgcacctacgcccccctgaagccagacctggccctgctggccatcaacaccctgtgcaaggactgcagcgaccccaaccccatggtgcggggcctggccctgcgctccatgtgcagcctgaggatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctggccaagatgttcccccacgtgcagacagatgtgctggtgcgggtgaagggccccctgctggccgcctgcagcagcgagagccgggagctgtgctttgtggccctgtgccacgtgcggcagatcctgcacagcctgcccggccacttcagcagccactacaagaagttcttctgcagctacagcgagccccactacatcaagctgcagaaggtggaggtgctgtgtgagctggtgaatgatgaaaatgtgcagcaggtgctggaggagctgcggggctactgcacagatgtgtctgctgactttgcccaggccgccatctttgccatcggccgctgcctgctgctcttcctgctggagaacctggaccagcctgccaggaagctgtggctggaggagccctag

SEQ ID NO: 142749 - DNA, 1716 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgcatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctggccaagatgttcccccacgtgcagacagatgtgctggtgcgggtgaagggccccctgctggccgcctgcagcagcgagagccgggagctgtgctttgtggccctgtgccacgtgcggcagatcctgcacagcctgcccggccacttcagcagccactacaagaagttcttctgcagctacagcgagccccactacatcaagctgcagaaggtggaggtgctgtgtgagctggtgaatgatgaaaatgtgcagcaggtgctggaggagctgcggggctactgcacagatgtgtctgctgactttgcccaggccgccatctttgccatcggcggcatcgcccggacctacacagaccagtgtgtgcagatcctgacagagctgctgggcctgcggcaggagcacatcaccaccgtggtggtgcagaccttccgggacctggtgtggctgtgcccccagtgcacagaggccgtgtgccaggccctgcccggctgtgaggagaacatccaggacagcgagggcaagcaggccctgatctggctgctgggcgtgcacggggagcgcatccccaatgccccctacgtgctggaggactttgtggagaatgtgaagtctgagaccttccctgctgtgaagatggagctgctgacagccctgctgcggctcttcctgagcaggcctgctgagtgccaggacatgctgggccgcctgctgtactactgcatcgaggaggagaaggacatggctgtgcgggaccggggcctcttctactaccgcctgctgctggtgggcattgatgaggtgaagaggatcctgtgcagccccaagagtgaccccaccctgggcctgctggaggaccctgctgagaggcctgtgaacagctgggccagtgacttcaacaccctggtgcctgtgtatggcaaggcccactgggccaccatcagcaagtgccagggcgctgagcgctgtgaccctgagctgcccaagaccagcagctttgctgccagcggccccctcatccctgaggagaacaaggagcgggtgcaggagctgcctgattctggggccctgatgctggtgcccaaccggcagctgacagctgactactttgagaagacctggctgagcctgaaggtggcccaccagcaggtgctgccctggagaggagagttccacccagacaccctgcagatggccctgcaggtggtgaacatccagaccatcgccatgagccgggccggcagccggccctggaaggcctacctgagcgcccaggatgacaccggctgcctcttcctgacagagctgctgctggagcccggcaacagcgagatgcagatctctgtgaagcagaatgaggccaggacagagaccctgaacagcttcatctctgtgctggagaccgtgattggcaccatcgaggagatcaagagctag

SEQ ID NO: 142750 - DNA, 2220 bp, Artificial Sequence; identical to SEQ ID NO: 142746
  Description of Artificial Sequence: Synthetic coding sequence

SEQ ID NO: 142751 - DNA, 789 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgctacatgacccagggcctggacatgtctggagtcttcatggagatggtgaaggccagcgccaccgtggacatcgtgcagaagaagctggtgtacctgtacatgtgcacctacgcccccctgaagccagacctggccctgctggccatcaacaccctgtgcaaggactgcagcgaccccaaccccatggtgcggggcctggccctgcgctccatgtgcagcctgaggatgcctggggtgcaggagtacatccagcagcccatcctgaatggcctgcgggacaaggccagctatgtgagaagagtggccgtgctgggctgtgccaagatgcacaacctgcatggagacagcgaggtggatggagccctggtgaatgagctgtacagcctgctgcgggaccaggaccccatcgtggtggtgaactgcctgcggagcctggaggagatcctgaagcaggagggcggcgtggtgatcaacaagcccatcgcccaccacctgctgaacaggatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctgtag

SEQ ID NO: 142752 - DNA, 528 bp, Artificial Sequence
  Description of Artificial Sequence: Synthetic coding sequence
atgccctacctgggctctgaagatgtggtgaaggagctgaagaaggccctgtgcaacccccacatccaggccgaccggctgcgctacagaaatgtcatccagagggtcatccgcatgagcaagctggaccagtggggccaggccgaggtgctgaacttcctgctgcgctaccagcccaggtctgaggaggagctgtttgacatcctgaacctgctggacagcttcctgaagagcagcagccctggggtggtgatgggcgccaccaagctgttcctgatcctggccaagatgttcccccacgtgcagacagatgtgctggtgcgggtgaagggccccctgctggccgcctgcagcagcgagagccgggagctgtgctttgtggccctgtgccacgtgcggcagatcctgcacagcctgcccggccacttcagcagccactacaagaagttcttctgcagctacagcgagccccactacatcaagctgcagaaggtggaggtgctgtgtgagctggtgaatgatgaatag

SEQ ID NO: 142753 - DNA, 3414 bp, Artificial Sequence
  Description of Artificial Sequence: Synthetic coding sequence
atgtctgacatcgtggagaagaccctgacagccctgcccggcctcttcctgcagaaccagcccggcggcggccctgctgctgccaaggccagcttcagcagccggctgggcagcctggtgcggggcatcacagccctgaccagcaagcatgaggaggagaagctgatccagcaggagctgagcagcctgaaggccaccgtgtctgcccccaccaccaccctgaagatgatgaaggagtgcatggtgcggctcatctactgtgagatgctgggctatgatgccagctttggctacatccacgccatcaagctggcccagcagggcaacctgctggagaagagggtgggctacctggccgtgtccctcttcctgcacgagagccatgagctgctgctgctgctggtgaacacagtggtgaaggacctgcagagcaccaacctggtggaggtgtgcatggccctgactgtggtgtcccagatcttcccctgtgagatgatcccagctgtgctgcccctgattgaggacaagctgcagcacagcaaggagatcgtgcggaggaaggctgtgctggccctgtacaagttccacctgattgcccccaaccaggtgcagcacatccacatcaagttcaggaaggccctgtgtgacagagatgtgggcgtgatggccgccagcctgcacatctacctgaggatgatcaaggagaacagcagcggctacaaggacctgaccggcagctttgtgaccatcctgaagcaggtggtgggcggcaagctgcctgtggagttcaactaccacagcgtgcctgccccctggctgcagatccagctgctgcgcatcctgggcctgctgggcaaggatgaccagaggaccagcgagctgatgtatgatgtgctggatgagagcctgcggcgggcagagctgaaccacaacgtgacctacgccatcctgtttgaatgtgtgcacacagtgtacagcatctaccccaagtctgagctgctggagaaggccgccaagtgcatcggcaagtttgtgctgagccccaagatcaacctgaagtacctgggcctgaaggccctgacctacgtgatccagcaggaccccaccctggccctgcagcaccagatgaccatcatcgagtgcctggaccacccagaccccatcatcaagcgggagaccctggagctgctgtaccgcatcaccaatgcccagaacatcaccgtgattgtgcagaagatgctggagtacctgcaccagagcaaggaggagtatgtgattgtgaacctggtgggcaagattgctgagctggccgagaagtatgccccagacaatgcctggttcatccagaccatgaatgctgtgttttctgtgggcggagatgtgatgcacccagacatccccaacaacttcctgcggctgctggccgagggctttgatgatgaaacagaggaccagcagctgcggctgtatgctgtgcagagctacctgaccctgctggacatggagaatgtgttctacccccagcgcttcctgcaggtgatgtcctgggtgctgggggagtacagctacctgctggacaaggagaccccagaggaggtgattgccaagctgtacaagctgctgatgaatgattctgtgagcagcgagaccaaggcctggctgattgctgctgtgaccaagctgaccagccaggcccacagcagcaacacagtggagcggctcatccacgagttcaccatcagcctggacacctgcatgaggcagcacgcctttgagctgaagcacctgcatgaaaatgtggagctgatgaagagcctgctgcctgtggacaggagctgtgaggacctggtggtggatgccagcctgtccttcctggatggctttgtggccgagggcctgagccagggcgccgccccctacaagccaccccaccagaggcaggaggagaagctgagccaggagaaggtgctgaactttgagccctacggcctgtccttcagcagcagcggcttcaccggccggcagagccctgctggcatcagcctgggcagtgatgtgtctggcaacagcgctgagaccggcctgaaggagaccaacagcctgaagctggagggcatcaagaagctgtggggcaaggagggctacctgcccaagaaggagagcaagacaggagatgaaagtggggccctgcctgtgccccaggagagcatcatggagaatgtggaccaggccatcaccaagaaggaccagagccaggtgctgacccagagcaaggaggagaaggagaagcagctgctggccagcagcctgtttgtgggcctgggcagcgagagcaccatcaacctgctgggcaaggctgacacagtgagccacaagttccggaggaagagcaaggtgaaggaggccaagagcggggagaccaccagcacccacaacatgacctgcagcagcttcagcagcctgagcaatgtggcctatgaagatgactactacagcaacaccctgcatgacaccggggacaaggagctgaagaagttcagcctgaccagcgagctgctggacagcgagagcctgacagagctgcccctggtggagaagttctcctactgcagcctgagcacccccagcctgtttgccaacaacaacatggagatcttccaccccccccagagcacagctgcctctgtggccaaggagagcagcctggccagcagcttcctggaggagaccacagagtacatccacagcaatgccatggaggtgtgcaacaatgagaccatctctgtgtcctcctacaagatctggaaggatgactgcctgctgatggtgtggagcgtgaccaacaagagcggcctggagctgaagtctgctgacctggagatcttccctgctgagaacttcaaggtgacagagcagcccggctgctgcctgcctgtgatggaggccgagagcaccaagagcttccagtacagcgtgcagatcgagaagcccttcacagagggcaacctgaccggcttcatctcctaccacatgatggacacccacagcgcccagctggagttctctgtgaacctgagcctgctggacttcatccggcccctgaagatcagcagtgatgactttgggaagctgtggctgagctttgccaatgatgtgaagcagaatgtgaagatgtctgagagccaggccgccctgcccagcgccctgaagaccctgcagcagaagctgcggctgcacatcatcgagatcattggaaatgaaggcctgctggcctgccagctgctgcccagcatcccctgcctgctgcactgccgggtgcatgctgatgtgctggccctgtggttccgcagcagctgcagcaccctgcctgactacctgctgtaccagtgccagaaggtgatggagggcagctag

SEQ ID NO: 142754 - DNA, 1362 bp, Artificial Sequence
  Description of Artificial Sequence: Synthetic coding sequence
atgatcagccagttcttcatcctgagcagcaaaggagaccccctcatctacaaggacttccggggggacagcggcggcagagatgtggccgagctgttctacaggaagctgaccggcctgcctggagatgagagccctgtggtgatgcaccaccacggccgccacttcatccacatccgccacagcggcctgtacctggtggtgaccaccagtgaaaatgtgagccccttcagcctgctggagctgctgagccggctggccaccctgctgggggactactgcggcagcctgggggagggcaccatcagcagaaatgtggccctggtgtatgagctgctggatgaggtgctggactatggctacgtgcagaccaccagcacagagatgctgaggaacttcatccagacagaggccgtggtgtccaagcccttcagcctgtttgacctgagctctgtgggcctgtttggagctgagacccagcagagcaaggtggcccccagcagcgctgccagcaggcctgtgctgagcagcagaagtgaccagagccagaagaatgaggtgttcctggatgtggtggagcggctgtctgtgctgattgccagcaatggcagcctgctgaaggtggatgtgcagggcgagatccggctgaagagcttcctgcccagcggcagcgagatgagaattggcctgacagaggagttctgtgtgggcaagtctgagctgcggggctacggccctggcatccgggtggatgaggtgtccttccacagctctgtgaacctggatgaatttgagagccaccgcatcctgcggctgcagcccccccagggcgagctgactgtgatgagataccagctgagtgatgacctgcccagccccctgcccttccgcctcttccccagcgtgcagtgggaccggggcagcggccgcctgcaggtgtacctgaagctgcgctgtgacctgctgagcaagagccaggccctgaatgtgcggctgcacctgcccctgccccggggcgtggtgtccctgagccaggagctgagcagccctgagcagaaggccgagctggccgagggcgccctgcgctgggacctgccccgggtgcagggcggcagccagctgagcggcctcttccagatggatgtgcccggccccccaggcccccccagccacggcctgagcaccagcgccagccccctgggcctgggccctgccagcctgagctttgagctgcccaggcacacctgcagcggcctgcaggtgcgcttcctgcggctggccttccggccctgtggaaatgccaacccccacaagtgggtgcgccacctgagccacagtgatgcctacgtgatccgcatctag

SEQ ID NO: 142755 - DNA, 1362 bp, Artificial Sequence; identical to SEQ ID NO: 142754
  Description of Artificial Sequence: Synthetic coding sequence

SEQ ID NO: 142756 - DNA, 1653 bp, Artificial Sequence
  Description of Artificial Sequence: Synthetic coding sequence
atgtctgctgcctggatcccagccctgggcctgggcgtgtgcctgctgctgctgcccggccctgctggcagcgagggcgccgcccccatcgccatcacctgcttcacccggggcctggacatcaggaaggagaaggcagatgtgctgtgccctgggggctgccccctggaggagttctctgtgtatggcaacatcgtgtatgcctctgtgagcagcatctgtggggctgctgtgcacagaggagtcatcagcaacagcggcggccctgtgcgggtgtacagcctgcccggccgggagaactacagctctgtggatgccaacggcatccagagccagatgctgagccgctggagcgccagcttcaccgtgaccaagggcaagagcagcacccaggaggccaccggccaggccgtgtccacagcccaccccccaacaggcaagaggctgaagaagaccccagagaagaagacaggcaacaaggactgcaaggctgacatcgccttcctgattgatggcagcttcaacatcggccagaggcgcttcaacctgcagaagaactttgtgggcaaggtggccctgatgctgggcattggaacagagggcccccacgtgggcctggtgcaggccagcgagcaccccaagattgagttctacctgaagaacttcaccagcgccaaggatgtgctgtttgccatcaaggaggtgggcttccggggcggcaacagcaacacaggcaaggccctgaagcacacagcccagaagttcttcaccgtggatgctggggtgaggaagggcatccccaaggtggtggtggtgttcattgatggctggcccagtgatgacatcgaggaggccggcatcgtggcccgggagtttggagtgaatgtgttcatcgtgtctgtggccaagcccatccctgaggagctgggcatggtgcaggatgtgacctttgtggacaaggctgtgtgcaggaacaacggcttcttctcctaccacatgcccaactggtttggcaccaccaagtatgtgaagcccctggtgcagaagctgtgcacccatgagcagatgatgtgcagcaagacctgctacaacagcgtgaacatcgccttcctgattgatggcagcagctctgtgggggacagcaacttccggctgatgctggagtttgtgagcaacatcgccaagacctttgagatcagtgacatcggggccaagattgctgctgtgcagttcacctatgaccagaggacagagttctccttcacagactacagcaccaaggaaaatgtgctggccgtcatccggaacatccgctacatgtctgggggcacagccactggagatgccatctccttcaccgtgagaaatgtgtttggccccatccgggagagccccaacaagaacttcctggtgattgtgacagatggccagagctatgatgatgtgcagggccctgctgctgctgcccatgatgctggcatcaccatcttctctgtgggcgtggcctgggcccccctggatgacctgaaggacatggccagcaagcccaaggagagccacgccttcttcacccgggagttcaccggcctggagcccatcgtgtctgatgtgatccggggcatctgccgggacttcctggagagccagcagtag

SEQ ID NO: 142757 - DNA, 435 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtggtgaagggccacatcatgttcaacctggacaaggtgcacatcatcctggatgagatggtgctgaatggctgcatcgtggagaccaacagagcccgcatcctggcccccctgctgatcctggacaagatgtctgagagctag

SEQ ID NO: 142758 - DNA, 435 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtgtctgagctggacatcatgttcaacctggacaaggtgcacatcatcctggatgagatggtgctgaatggctgcatcgtggagaccaacagagcccgcatcctggcccccctgctgatcctggacaagatgtctgagagctag

SEQ ID NO: 142759 - DNA, 27 bp, Artificial Sequence
  Description of Artificial Sequence: Synthetic coding sequence
atgatcaagttcttcctgatggtgtag

SEQ ID NO: 142760 - DNA, 297 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtgtag

SEQ ID NO: 142761 - DNA, 402 bp, Artificial Sequence
  Description of Artificial Sequence: Synthetic coding sequence
atgatcaagttcttcctgatggtgaacaagcagggccagacccggctgagcaagtactatgagcacgtggacatcaacaagaggaccctgctggagacagaggtgatcaagagctgcctgagccgcagcaatgagcagtgcagcttcatcgagtacaaggacttcaagctgatctaccggcagtatgctgccctcttcatcgtggtgggcgtgaatgacacagaaaatgagatggccatctatgagttcatccacaactttgtggaggtgctggatgagtacttcagccgggtgtctgagctggacatcatgttcaacctggacaaggtgcacatcatcctggatgagatggtgctgaatggctgcatcgtggagaccaacagagcccgcatcctggcctag

SEQ ID NO: 142762 - DNA, 4611 bp, Artificial Sequence
  Description of Artificial Sequence: Synthetic coding sequence
atgggcgtggtgaactttgtgttccgggccagcgaggacctgcaggtgctggagaactacagtgatgcccccatgacccccaagcagatcctgcaggtgattgaggccgagggcctgaaggagatgagcggcaccagccccctggcctgcctgaatgccatgctgcacagcaacagcagaggaggagagggcctcttctacaagctgcccggccgcatcagcctcttcaccctgaagaaggatgccctgcagtggagccgccacccagccaccgtggagggggaggagcctgaggacacagcagatgtggagagctgtggcagcaatgaggccagcacagtgtctggagaaaatgatgtgtccctggatgagaccagcagcaatgccagctgcagcacagagagccagagccggcccctgagcaacccccgggacagctaccgggccagcagccaggccaacaagcagaagaagaagacaggagtgatgctgccccgggtggtgctgacccccctgaaggtgaatggagcccacgtggagagcgccagcggcttcagcggctgccacgcagatggagagagcggcagccccagcagcagcagcagcggcagcctggccctgggcagcgctgccatccggggccaggccgaggtgacccaggaccctgcccccctgctgcggggcttcaggaagccagccaccggccagatgaagaggaacagaggagaggagattgactttgagaccccaggcagcatcctggtgaacaccaacctgcgggccctgatcaacagcaggaccttccacgccctgcccagccacttccagcagcagctgctcttcctgctgcctgaggtggaccggcaggtgggcacagatggcctgctgcggctgagcagcagcgccctgaacaatgagttcttcacccatgctgcccagagctggagggagcggctggctgatggagagttcacccatgagatgcaggtgcgcatccggcaggagatggagaaggagaagaaggtggagcagtggaaggagaagttctttgaggactactacggccagaagctgggcctgaccaaggaggagagcctgcagcagaatgtgggccaggaggaggccgagatcaagagcggcctgtgtgtgcctggagagagcgtgcgcatccagaggggccctgccacccggcagagagatggccacttcaagaagaggagcaggccagacctgcggacccgggcccggaggaacctgtacaagaagcaggagagcgagcaggccggcgtggccaaggatgccaagtctgtggccagtgatgtgcccctgtacaaggatggagaggccaagacagatcctgctggcctgagcagcccccacctgcccggcaccagcagcgctgccccagacctggagggccctgagttccctgtggagagcgtggccagccgcatccaggccgagccagacaacctggcccgggccagcgccagcccagaccgcatccccagcctgccccaggagaccgtggaccaggagcccaaggaccagaagaggaagagctttgagcaggccgccagcgccagcttccctgagaagaagccccggctggaggaccggcagagcttcaggaacaccattgaatctgtgcacacagagaagccccagcccaccaaggaggagcccaaggtgccccccatccgcatccagctgagccgcatcaagccaccctgggtggtgaagggccagcccacctaccagatctgcccccgcatcatccccaccacagagagcagctgccggggctggacaggagcccggaccctggccgacatcaaggcccgggccctgcaggtgcggggggcccggggccaccactgccaccgggaggccgccaccacagccatcggcggcggcggcggccctgggggcggcggcggcggggccacagatgaaggaggcggccggggcagcagcagtggagatggaggagaggcctgtggccaccctgagccccggggcggccccagcaccccaggcaagtgcaccagtgacctgcagaggacccagctgctgcccccctaccccctgaatggagagcacacccaggccggcacagccatgagccgggcccggcgggaggacctgcccagcctgaggaaggaggagagctgcctgctgcagagggccaccgtgggcctgacagatggcctgggagatgccagccagctgcctgtggcccccactggagaccagccctgccaggccctgcccctgctgagcagccagacctctgtggccgagcggctggtggagcagccccagctgcacccagatgtgaggacagaatgtgagagcggcaccacctcctgggagagtgatgatgaggagcagggccccaccgtgcctgctgacaatggccccatcctgagcctggtgggagatgacaccctggagaagggcaccggccaggccctggacagccaccccaccatgaaggaccctgtgaatgtgacccccagcagcaccccagagagcagccccacagactgcctgcagaacagagcctttgatgatgagctgggcctgggcggcagctgcccccccatgagggagagtgacacccggcaggagaacctgaagaccaaggccctggtgagcaacagcagcctgcactggatccccatccccagcaatgatgaggtggtgaagcagcccaagccagagagccgggagcacatccccagcgtggagccccaggtgggggaggagtgggagaaggccgcccccaccccaccagccctgcccggggacctgacagctgaggagggcctggaccccctggacagcctgaccagcctgtggacagtgcccagcagaggaggcagtgacagcaatggcagctactgccagcaggtggacatcgagaagctgaagatcaatggagacagcgaggccctgagcccccacggggagagcacagacacagccagtgactttgagggccacctgacagaggacagcagcgaggccgacacccgggaggccgctgtgaccaagggcagctctgtggacaaggatgagaagcccaactggaaccagagcgcccccctgagcaaggtgaatggagacatgaggctggtgaccaggacagatggcatggtggccccccagagctgggtgtcccgggtgtgtgctgtgcggcagaagatcccagacagcctgctgctggccagcacagagtaccagcccagggctgtgtgcctgtccatgcctggcagctctgtggaggccaccaaccccctggtgatgcagctgctgcagggcagcctgcccctggagaaggtgctgcccccagcccatgatgacagcatgtctgagagcccccaggtgcccctgaccaaggaccagagccacggcagcctgaggatgggcagcctgcacggcctgggcaagaacagcggcatggtggatggcagcagccccagcagcctgcgggccctgaaggagcccctgctgcctgacagctgtgaaacaggaacaggcctggcccgcatcgaggccacccaggcccctggggccccccagaagaactgcaaggctgtgcccagctttgacagcctgcaccctgtgaccaaccccatcaccagcagcaggaagctggaggagatggacagcaaggagcagttcagcagcttcagctgtgaggaccagaaggaggtgcgggccatgagccaggacagcaacagcaatgctgcccctgggaagagccctggggacctgaccaccagcaggaccccccgcttcagcagccccaacgtcatcagctttggacctgagcagacaggccgggccctgggggaccagagcaatgtgacaggccagggcaagaagctgtttggcagcggaaatgtggccgccaccctgcagaggcccaggcctgctgaccccatgcccctgcctgctgagatcccccctgtgttccccagcggcaagctgggccccagcaccaacagcatgtctggaggagtgcagaccccccgggaggactgggcccccaagccccacgcctttgtgggctctgtgaagaatgagaagacctttgtgggcggccccctgaaggccaatgctgagaacaggaaggccaccggccacagccccctggagctggtgggccacctggagggcatgccctttgtgatggacctgcccttctggaagctgccccgggagcccgggaagggcctgtctgagcccctggagcccagcagcctgcccagccagctgagcatcaagcaggccttctacggcaagctgagcaagctgcagctgagcagcaccagcttcaactacagcagcagcagccccaccttccccaagggcctggccggctctgtggtgcagctgagccacaaggccaactttggagccagccacagcgccagcctgagcctgcagatgttcacagacagcagcacagtggagagcatcagcctgcagtgtgcctgcagcctgaaggccatgatcatgtgccagggctgtggggccttctgccatgatgactgcatcggccccagcaagctgtgtgtgctgtgcctggtggtgaggtag

SEQ ID NO: 142763 - DNA, 4626 bp, Artificial Sequence
  Description of Artificial Sequence: Synthetic coding sequence
atgaaggacaagcagaagaagaagaaggagaggacctgggccgaggccgcccggctggtgctggagaactacagtgatgcccccatgacccccaagcagatcctgcaggtgattgaggccgagggcctgaaggagatgaggagcggcaccagccccctggcctgcctgaatgccatgctgcacagcaacagccggggcggggagggcctcttctacaagctgcccggccgcatcagcctcttcaccctgaagaaggatgccctgcagtggagccgccacccagccaccgtggagggggaggagcctgaggacacagcagatgtggagagctgtggcagcaatgaggccagcacagtgtctggagaaaatgatgtgtccctggatgagaccagcagcaatgccagctgcagcacagagagccagagccggcccctgagcaacccccgggacagctaccgggccagcagccaggccaacaagcagaagaagaagacaggagtgatgctgccccgggtggtgctgacccccctgaaggtgaatggagcccacgtggagagcgccagcggcttcagcggctgccacgcagatggagagagcggcagccccagcagcagcagcagcggcagcctggccctgggcagcgctgccatccggggccaggccgaggtgacccaggaccctgcccccctgctgcggggcttcaggaagccagccaccggccagatgaagaggaacagaggagaggagattgactttgagaccccaggcagcatcctggtgaacaccaacctgcgggccctgatcaacagcaggaccttccacgccctgcccagccacttccagcagcagctgctcttcctgctgcctgaggtggaccggcaggtgggcacagatggcctgctgcggctgagcagcagcgccctgaacaatgagttcttcacccacgccgcccagagctggagggagcggctggctgatggagagttcacccatgagatgcaggtgcgcatccggcaggagatggagaaggagaagaaggtggagcagtggaaggagaagttctttgaggactactacggccagaagctgggcctgaccaaggaggagagcctgcagcagaatgtgggccaggaggaggccgagatcaagagcggcctgtgtgtgcctggagagagcgtgcgcatccagaggggccctgccacccggcagagagatggccacttcaagaagaggagcaggccagacctgcggacccgggcccggaggaacctgtacaagaagcaggagagcgagcaggccggcgtggccaaggatgccaagtctgtggccagtgatgtgcccctgtacaaggatggagaggccaagacagatcctgctggcctgagcagcccccacctgcccggcaccagcagcgctgccccagacctggagggccctgagttccctgtggagagcgtggccagccgcatccaggccgagccagacaacctggcccgggccagcgccagcccagaccgcatccccagcctgccccaggagaccgtggaccaggagcccaaggaccagaagaggaagagctttgagcaggccgccagcgccagcttccctgagaagaagccccggctggaggaccggcagagcttcaggaacaccatcgagagcgtgcacacagagaagccccagcccaccaaggaggagcccaaggtgccccccatccgcatccagctgagccgcatcaagccaccctgggtggtgaagggccagcccacctaccagatctgcccccgcatcatccccaccacagagagcagctgccggggctggacaggagcccggaccctggccgacatcaaggcccgggccctgcaggtgcggggggcccggggccaccactgccaccgggaggccgccaccacagccatcggcggcggcggcggccctgggggcggcggcggcggggccacagatgagggcggcggccggggcagcagcagtggagatggaggagaggcctgtggccaccctgagccccggggcggccccagcacccctgggaagtgcaccagtgacctgcagaggacccagctgctgcccccctaccccctgaatggagagcacacccaggccggcacagccatgagccgggcccggcgggaggacctgcccagcctgaggaaggaggagagctgcctgctgcagagggccaccgtgggcctgacagatggcctgggagatgccagccagctgcctgtggcccccaccggggaccagccctgccaggccctgcccctgctgagcagccagacctctgtggccgagcggctggtggagcagccccagctgcacccagatgtgaggacagaatgtgagagcggcaccacctcctgggagagtgatgatgaggagcagggccccaccgtgcctgctgacaatggccccatcctgagcctggtgggagatgacaccctggagaagggcaccggccaggccctggacagccaccccaccatgaaggaccctgtgaatgtgacccccagcagcaccccagagagcagccccacagactgcctgcagaacagagcctttgatgatgagctgggcctgggcggcagctgcccccccatgagggagagtgacacccggcaggagaacctgaagaccaaggccctggtgagcaacagcagcctgcactggatccccatccccagcaatgatgaggtggtgaagcagcccaagccagagagccgggagcacatccccagcgtggagccccaggtgggggaggagtgggagaaggccgcccccaccccaccagccctgcccggggacctgacagctgaggagggcctggaccccctggacagcctgaccagcctgtggacagtgcccagccggggcggcagtgacagcaatggcagctactgccagcaggtggacatcgagaagctgaagatcaacggggacagcgaggccctgagcccccatggagagagcacagacacagccagtgactttgagggccacctgacagaggacagcagcgaggccgacacccgggaggccgctgtgaccaagggcagctctgtggacaaggatgagaagcccaactggaaccagagcgcccccctgagcaaggtgaatggagacatgaggctggtgaccaggacagatggcatggtggccccccagagctgggtgtcccgggtgtgtgctgtgcggcagaagatcccagacagcctgctgctggccagcacagagtaccagcccagggctgtgtgcctgtccatgcctggcagctctgtggaggccaccaaccccctggtgatgcagctgctgcagggcagcctgcccctggagaaggtgctgcccccagcccatgatgacagcatgtctgagagcccccaggtgcccctgaccaaggaccagagccacggcagcctgaggatgggcagcctgcacggcctgggcaagaacagcggcatggtggatggcagcagccccagcagcctgcgggccctgaaggagcccctgctgcctgacagctgtgagaccggcaccggcctggccagaattgaggccacccaggcccctggggccccccagaagaactgcaaggctgtgcccagctttgacagcctgcaccctgtgaccaaccccatcaccagcagcaggaagctggaggagatggacagcaaggagcagttcagcagcttcagctgtgaggaccagaaggaggtgcgggccatgagccaggacagcaacagcaatgctgcccctgggaagagccctggggacctgaccaccagcaggaccccccgcttcagcagccccaacgtcatcagctttggacctgagcagacaggccgggccctgggggaccagagcaatgtgacaggccagggcaagaagctgtttggaagtggaaatgtggccgccaccctgcagaggcccaggcctgctgaccccatgcccctgcctgctgagatcccccctgtgttccccagcggcaagctgggccccagcaccaacagcatgtctgggggcgtgcagaccccccgggaggactgggcccccaagccccacgcctttgtgggctctgtgaagaatgagaagacctttgtgggcggccccctgaaggccaatgcagaaaataggaaggccaccggccacagccccctggagctggtgggccacctggagggcatgccctttgtgatggacctgcccttctggaagctgccccgggagcccgggaagggcctgtctgagcccctggagcccagcagcctgcccagccagctgagcatcaagcaggccttctacggcaagctgagcaagctgcagctgagcagcaccagcttcaactacagcagcagcagccccaccttccccaagggcctggccggctctgtggtgcagctgagccacaaggccaactttggagccagccacagcgccagcctgagcctgcagatgttcacagacagcagcacagtggagagcatcagcctgcagtgtgcctgcagcctgaaggccatgatcatgtgccagggctgtggggccttctgccatgatgactgcatcggccccagcaagctgtgtgtgctgtgcctggtggtgaggtag

SEQ ID NO: 142764 - DNA, 4626 bp, Artificial Sequence; identical to SEQ ID NO: 142763
  Description of Artificial Sequence: Synthetic coding sequence

SEQ ID NO: 142765 - DNA, 4389 bp, Artificial Sequence
  Description of Artificial Sequence: Synthetic coding sequence
atgctgtccttccccaacctgaaccaggtgctggagaactacagtgatgcccccatgacccccaagcagatcctgcaggtgattgaggccgagggcctgaaggagatgagcagcggcaccagccccctggcctgcctgaatgccatgctgcacagcaacagccggggcggggagggcctcttctacaagctgcccggccgcatcagcctcttcaccctgaagaaggatgccctgcagtggagccgccacccagccaccgtggagggggaggagcctgaggacacagcagatgtggagagctgtggcagcaatgaggccagcacagtgtctggagaaaatgatgtgtccctggatgagaccagcagcaatgccagctgcagcacagagagccagagccggcccctgagcaacccccgggacagctaccgggccagcagccaggccaacaagcagaagaagaagacaggagtgatgctgccccgggtggtgctgacccccctgaaggtgaatggagcccacgtggagagcgccagcggccagatgaagaggaacagaggagaggagattgactttgagaccccaggcagcatcctggtgaacaccaacctgcgggccctgatcaacagcaggaccttccacgccctgcccagccacttccagcagcagctgctcttcctgctgcctgaggtggaccggcaggtgggcacagatggcctgctgcggctgagcagcagcgccctgaacaatgagttcttcacccatgctgcccagagctggagggagcggctggctgatggagagttcacccatgagatgcaggtgcgcatccggcaggagatggagaaggagaagaaggtggagcagtggaaggagaagttctttgaggactactacggccagaagctgggcctgaccaaggaggagagcctgcagcagaatgtgggccaggaggaggccgagatcaagagcggcctgtgtgtgcctggagagagcgtgcgcatccagaggggccctgccacccggcagagagatggccacttcaagaagaggagcaggccagacctgcggacccgggcccggaggaacctgtacaagaagcaggagagcgagcaggccggcgtggccaaggatgccaagtctgtggccagtgatgtgcccctgtacaaggatggagaggccaagacagatcctgctggcctgagcagcccccacctgcccggcaccagcagcgctgccccagacctggagggccctgagttccctgtggagagcgtggccagccgcatccaggccgagccagacaacctggcccgggccagcgccagcccagaccgcatccccagcctgccccaggagaccgtggaccaggagcccaaggaccagaagaggaagagctttgagcaggccgccagcgccagcttccctgagaagaagccccggctggaggaccggcagagcttcaggaacaccattgaatctgtgcacacagagaagccccagcccaccaaggaggagcccaaggtgccccccatccgcatccagctgagccgcatcaagccaccctgggtggtgaagggccagcccacctaccagatctgcccccgcatcatccccaccacagagagcagctgccggggctggacaggagcccggaccctggccgacatcaaggcccgggccctgcaggtgcggggggcccggggccaccactgccaccgggaggccacagatgaaggaggcggccggggcagcagcagtggagatggaggagaggcctgtggccaccctgagccccggggcggccccagcaccccaggcaagtgcaccagtgacctgcagaggacccagctgctgcccccctaccccctgaatggagagcacacccaggccggcacagccatgagccgggcccggcgggaggacctgcccagcctgaggaaggaggagagctgcctgctgcagagggccaccgtgggcctgacagatggcctgggagatgccagccagctgcctgtggcccccactggagaccagccctgccaggccctgcccctgctgagcagccagacctctgtggccgagcggctggtggagcagccccagctgcacccagatgtgaggacagaatgtgagagcggcaccacctcctgggagagtgatgatgaggagcagggccccaccgtgcctgctgacaatggccccatcctgagcctggtgggagatgacaccctggagaagggcaccggccaggccctggacagccaccccaccatgaaggaccctgtgaatgtgacccccagcagcaccccagagagcagccccacagactgcctgcagaacagagcctttgatgatgagctgggcctgggcggcagctgcccccccatgagggagagtgacacccggcaggagaacctgaagaccaaggccctggtgagcaacagcagcctgcactggatccccatccccagcaatgatgaggtggtgaagcagcccaagccagagagccgggagcacatccccagcgtggagccccaggtgggggaggagtgggagaaggccgcccccaccccaccagccctgcccggggacctgacagctgaggagggcctggaccccctggacagcctgaccagcctgtggacagtgcccagcagaggaggcagtgacagcaatggcagctactgccagcaggtggacatcgagaagctgaagatcaatggagacagcgaggccctgagcccccacggggagagcacagacacagccagtgactttgagggccacctgacagaggacagcagcgaggccgacacccgggaggccgctgtgaccaagggcagctctgtggacaaggatgagaagcccaactggaaccagagcgcccccctgagcaaggtgaatggagacatgaggctggtgaccaggacagatggcatggtggccccccagagctgggtgtcccgggtgtgtgctgtgcggcagaagatcccagacagcctgctgctggccagcacagagtaccagcccagggctgtgtgcctgtccatgcctggcagctctgtggaggccaccaaccccctggtgatgcagctgctgcagggcagcctgcccctggagaaggtgctgcccccagcccatgatgacagcatgtctgagagcccccaggtgcccctgaccaaggaccagagccacggcagcctgaggatgggcagcctgcacggcctgggcaagaacagcggcatggtggatggcagcagccccagcagcctgcgggccctgaaggagcccctgctgcctgacagctgtgaaacaggaacaggcctggcccgcatcgaggccacccaggcccctggggccccccagaagaactgcaaggctgtgcccagctttgacagcctgcaccctgtgaccaaccccatcaccagcagcaggaagctggaggagatggacagcaaggagcagttcagcagcttcagctgtgaggaccagaaggaggtgcgggccatgagccaggacagcaacagcaatgctgcccctgggaagagccctggggacctgaccaccagcaggaccccccgcttcagcagccccaacgtcatcagctttggacctgagcagacaggccgggccctgggggaccagagcaatgtgacaggccagggcaagaagctgtttggcagcggaaatgtggccgccaccctgcagaggcccaggcctgctgaccccatgcccctgcctgctgagatcccccctgtgttccccagcggcaagctgggccccagcaccaacagcatgtctggaggagtgcagaccccccgggaggactgggcccccaagccccacgcctttgtgggctctgtgaagaatgagaagacctttgtgggcggccccctgaaggccaatgctgagaacaggaaggccaccggccacagccccctggagctggtgggccacctggagggcatgccctttgtgatggacctgcccttctggaagctgccccgggagcccgggaagggcctgtctgagcccctggagcccagcagcctgcccagccagctgagcatcaagcaggccttctacggcaagctgagcaagctgcagctgagcagcaccagcttcaactacagcagcagcagccccaccttccccaagggcctggccggctctgtggtgcagctgagccacaaggccaactttggagccagccacagcgccagcctgagcctgcagatgttcacagacagcagcacagtggagagcatcagcctgcagtgtgcctgcagcctgaaggccatgatcatgtgccagggctgtggggccttctgccatgatgactgcatcggccccagcaagctgtgtgtgctgtgcctggtggtgaggtag

SEQ ID NO: 142766 - DNA, 4626 bp, Artificial Sequence; identical to SEQ ID NO: 142763
  Description of Artificial Sequence: Synthetic coding sequence

SEQ ID NO: 142767 - DNA, 225 bp, Artificial Sequence
  Description of Artificial Sequence: Synthetic coding sequence
tgatgggccgaggccgcccggctggtgctggagaactacagtgatgcccccatgacccccaagcagatcctgcaggtgattgaagctgagggcctgaaggagatgaggagcggcaccagccccctggcctgcctgaatgccatgctgcacagcaacagcagaggaggagagggcctcttctacaagctgcccggccgcatcagcctcttcaccctgaaggtgtag

SEQ ID NO: 142768 - DNA, 258 bp, Artificial Sequence
  Description of Artificial Sequence: Synthetic coding sequence
atgaaggacaagcagaagaagaagaaggagaggacctgggccgaggccgcccggctggtgctggagaactacagtgatgcccccatgacccccaagcagatcctgcaggtgattgaggccgagggcctgaaggagatgaggagcggcaccagccccctggcctgcctgaatgccatgctgcacagcaacagccggggcggggagggcctcttctacaagctgcccggccgcatcagcctcttcaccctgaaggtgtag

SEQ ID NO: 142769 - DNA, 255 bp, Artificial Sequence
  Description of Artificial Sequence: Synthetic coding sequence
atgaaggacaagcagaagaagaagaaggagaggacctgggccgaggccgcccggctggtgctggagaactacagtgatgcccccatgacccccaagcagatcctgcaggtgattgaggccgagggcctgaaggagatgagcggcaccagccccctggcctgcctgaatgccatgctgcacagcaacagcagaggaggagagggcctcttctacaagctgcccggccgcatcagcctcttcaccctgaagaggtag

SEQ ID NO: 142770 - DNA, 2757 bp, Artificial Sequence
  Description of Artificial Sequence: Synthetic coding sequence
atgaagaggaccaagtgtgccgacattgatgtggagaccccagacagcatcctggtgaacaccaacctgcgggccctgatcaacaagcacaccttctctgtgctgcccggggactgccagcagaggctgctgctgctgctgcctgaggtggaccggcaggtgggcccagatggcctgatgaagctgaatggaagtgccctgaacaatgagttcttcaccagcgctgcccagggctggaaggagcggctgtctgagggggagttcaccccagagatgcaggtgcgcatccggcaggagattgagaaggagaagaaggtggagccctggaaggagcagttctttgagagctactacggccagagcagcggcctgagcctggaggacagcaagaagctgacagccagccccagcgaccccaaggtgaagaagaccccagctgagcagcccaagtccatgcctgtgtctgaggccagcctcatccgcatcgtgcctgtggtgtcccagagcgagtgcaaggaggaggccctgcagatgagcagccctggcaggaaggaggagtgtgagagccagggcgaggtgcagcccaacttcagcaccagcagcgagcccctgctgagcagcgccctgaacacccatgagctgagcagcatcctgcccatcaagtgccccaaggatgaggacctgctggagcagaagcctgtgaccagcgctgagcaggagagcgagaagaaccacctgaccacagccagcaactacaacaagtctgagagccaggagagcctggtgaccagccccagcaagcccaagagccctggggtggagaagcccatcgtgaagcccacagctggggccggcccccaggagaccaacatgaaggagcccctggccaccctggtggaccagagccctgagagcctgaagaggaagagcagcctgacccaggaggaggcccctgtgtcctgggagaagaggccccgggtgacagaaaatcggcagcaccagcagcccttccaggtgagcccccagcccttcctgaacagaggagaccgcatccaggtgaggaaggtgccccccctgaagatccctgtgagccgcatcagccccatgcccttccaccccagccaggtgagcccccgggcccgcttccctgtgtccatcaccagccccaacagaactggagcccggaccctggccgacatcaaggccaaggcccagctggtgaaggcccagagagctgctgctgctgctgctgctgctgctgctgctgctgcctctgtgggcggcaccatccctggccctggccctgggggcggccagggccctggagagggcggggagggccagacagcccggggcggcagccctggcagtgacagagtgtctgaaacaggcaagggccccaccctggagctggccggcaccggcagccggggcggcacccgggagctgctgccctgtggccctgagacccagccccagagcgagaccaagaccacccccagccaggcccagccccacagcgtgtctggggcccagctgcagcagaccccacctgtgccccccaccccagctgtgtctggggcctgcacctctgtgcccagccctgcccacatcgagaagctggacaatgagaagctgaaccccacccgggccacagccaccgtggcctctgtgagccacccccagggccccagcagctgccggcaggagaaggcccccagccccaccggcttccagctggaggacatcagcaccagccagcgcttcatgctgggctttgctggccgccgcaccagcaagccagccatggccggccactacctgctgaacatcagcacctacggccggggcagcgagagcttccggaggacccacagcgtgaaccctgaggaccgcttctgcctgagcagccccacagaggccctgaagatgggctacacagactgcaagaatgccactggagagagcagcagcagcaaagaagatgacacagatgaggagagcactggagatgagcaggagagcgtgacagtgaaggaggagccccaggtgtcccagagcgctgggaagggggacaccagcagcggcccccacagccgggagaccctgagcaccagtgactgcctggccagcaagaatgtgaaggccgagatccccctgaatgagcagaccaccctgagcaaagaaaactacctgttcacccggggccagacctttgatgagaagaccctggcccgggacctgatccaggccgcccagaagcagatggcccatgctgtgcggggcaaggccatccgcagcagccctgagctgttcagcagcacagtgctgcccctgcctgctgacagccccacccaccagcccctgctgctgccccccctgcagacccccaagctgtatggcagccccacccagatcggccccagctaccggggcatgatcaacgtgtccaccagcagtgacatggaccacaacagcgctgtgcccggcagccaggtgagcagcaatgtgggagatgtgatgtccttctctgtgacagtgaccaccatcccagccagccaggccatgaaccccagcagccacggccagaccatccctgtgcaggccttctctgaagaaaattccattgagggcacccccagcaagtgctactgccgcctgaaggccatgatcatgtgcaagggctgtggggccttctgccatgatgactgcatcggccccagcaagctgtgtgtgtcctgcctggtggtgaggtag

SEQ ID NO: 142771 - DNA, 4224 bp, Artificial Sequence
  Description of Artificial Sequence: Synthetic coding sequence
atgagccacaaggagatcctgcaggtgatccagcgggagggcctgaaggagatcagcagcggcaccagccccctggcctgcctgaatgccatgctgcacaccaacagcagaggagaggagggcatcttctacaaggtgcccggccgcatgggcgtgtacaccctgaagaaggatgtgcctgatggagtgaaggagctgtctgagggcagcgaggagagcagtgatggccagagcgacagccagagcagcgagaacagcagcagcagcagtgatggcggcagcaacaaggagggcaagaagagccgctggaagaggaaggtgagcagcagcagcccccagagcggctgccccagccccaccatcccagctgggaaggtgatcagccccagccagaagcacagcaagaaggccctgaagcaggccctgaagcagcagcagcagaagaagcagcagcagcagtgccggcccagcatcagcatcagcagcaaccagcacctgagcctgaagacagtgaaggccgccagtgacagcgtgcctgccaagccagccacctgggagggcaagcagagtgatggccagacaggcagcccccagaacagcaacagcagcttcagcagctctgtgaaggtggagaacaccctgctgggcctgggcaagaagagcttccagaggtctgagcggctgcacacccggcagatgaagaggaccaagtgtgccgacattgatgtggagaccccagacagcatcctggtgaacaccaacctgcgggccctgatcaacaagcacaccttctctgtgctgcccggggactgccagcagaggctgctgctgctgctgcctgaggtggaccggcaggtgggcccagatggcctgatgaagctgaatggaagtgccctgaacaatgagttcttcaccagcgctgcccagggctggaaggagcggctgtctgagggggagttcaccccagagatgcaggtgcgcatccggcaggagattgagaaggagaagaaggtggagccctggaaggagcagttctttgagagctactacggccagagcagcggcctgagcctggaggacagcaagaagctgacagccagccccagcgaccccaaggtgaagaagaccccagctgagcagcccaagtccatgcctgtgtctgaggccagcctcatccgcatcgtgcctgtggtgtcccagagcgagtgcaaggaggaggccctgcagatgagcagccctggcaggaaggaggagtgtgagagccagggcgaggtgcagcccaacttcagcaccagcagcgagcccctgctgagcagcgccctgaacacccatgagctgagcagcatcctgcccatcaagtgccccaaggatgaggacctgctggagcagaagcctgtgaccagcgctgagcaggagagcgagaagaaccacctgaccacagccagcaactacaacaagtctgagagccaggagagcctggtgaccagccccagcaagcccaagagccctggggtggagaagcccatcgtgaagcccacagctggggccggcccccaggagaccaacatgaaggagcccctggccaccctggtggaccagagccctgagagcctgaagaggaagagcagcctgacccaggaggaggcccctgtgtcctgggagaagaggccccgggtgacagaaaatcggcagcaccagcagcccttccaggtgagcccccagcccttcctgaacagaggagaccgcatccaggtgaggaaggtgccccccctgaagatccctgtgagccgcatcagccccatgcccttccaccccagccaggtgagcccccgggcccgcttccctgtgtccatcaccagccccaacagaactggagcccggaccctggccgacatcaaggccaaggcccagctggtgaaggcccagagagctgctgctgctgctgctgctgctgctgctgctgctgcctctgtgggcggcaccatccctggccctggccctgggggcggccagggccctggagagggcggggagggccagacagcccggggcggcagccctggcagtgacagagtgtctgaaacaggcaagggccccaccctggagctggccggcaccggcagccggggcggcacccgggagctgctgccctgtggccctgagacccagccccagagcgagaccaagaccacccccagccaggcccagccccacagcgtgtctggggcccagctgcagcagaccccacctgtgccccccaccccagctgtgtctggggcctgcacctctgtgcccagccctgcccacatcgagaagctggacaatgagaagctgaaccccacccgggccacagccaccgtggcctctgtgagccacccccagggccccagcagctgccggcaggagaaggcccccagccccaccggccctgccctgatcagcggggccagccctgtgcactgtgccgcagatggcaccgtggagctgaaggccggccccagcaagaacatccccaaccccagcgccagcagcaagacagatgcctctgtgcctgtggccgtgacccccagccccctgaccagcctgctgaccacagccaccctggagaagctgcctgtgccccaggtgtctgccaccacagccccagctggcagcgccccacccagcagcaccctgcctgctgccagcagcctgaagaccccaggcaccagcctgaacatgaatggccccaccctgcggcccaccagcagcatcccagccaacaaccccctggtgacccagctgctgcagggcaaggatgtgcccatggagcagatcctgcccaagcccctgaccaaggtggagatgaagacagtgcccctgacagccaaggaggagcggggcatgggcgccctgattgccaccaacaccacagagaacagcacccgggaggaggtgaatgaaaggcagagccacccagccacccagcagcagctgggcaagaccctgcagagcaagcagctgccccaggtgccccggcccctgcagctgttcagcgccaaggagctgcgggacagcagcattgacacccaccagtaccacgagggcctgagcaaggccacccaggaccagatcctgcagaccctcatccagagggtgcggcggcagaacctgctgtctgtggtgccccccagccagttcaactttgcccacagcggcttccagctggaggacatcagcaccagccagcgcttcatgctgggctttgctggaagaaggaccagcaagccagccatggccggccactacctgctgaacatcagcacctacggccggggcagcgagagcttccggaggacccacagcgtgaacccagaagatcgcttctgcctgagcagccccacagaggccctgaagatgggctacacagactgcaagaatgccaccggggagagcagcagcagcaaggaggatgacacagatgaggagagcactggagatgagcaggagagcgtgacagtgaaggaggagccccaggtgtcccagagcgctggaaaaggagacaccagcagcggcccccacagccgggagaccctgagcaccagtgactgcctggccagcaagaatgtgaaggccgagatccccctgaatgagcagaccaccctgagcaaggagaactacctgttcacccggggccagacctttgatgagaagaccctggcccgggacctgatccaggccgcccagaagcagatggcccatgctgtgcggggcaaggccatccgcagcagccctgagctgttcagcagcacagtgctgcccctgcctgctgacagccccacccaccagcccctgctgctgccccccctgcagacccccaagctgtatggcagccccacccagatcggccccagctaccggggcatgatcaacgtgtccaccagcagtgacatggaccacaacagcgctgtgcccggcagccaggtgagcagcaatgtgggagatgtgatgtccttctctgtgacagtgaccaccatcccagccagccaggccatgaaccccagcagccacggccagaccatccctgtgcaggccttcagcgaggagaacagcattgagggcacccccagcaagtgctactgccgcctgaaggccatgatcatgtgcaagggctgtggggccttctgccatgatgactgcatcggccccagcaagctgtgtgtgtcctgcctggtggtgaggtag

SEQ ID NO: 142772 - DNA, 2757 bp, Artificial Sequence; identical to SEQ ID NO: 142770
  Description of Artificial Sequence: Synthetic coding sequence

SEQ ID NO: 142773 - DNA, 4308 bp, Artificial Sequence
  Description of Artificial Sequence: Synthetic coding sequence
atgagggagaagggccgcaggaagaagggccgcacctgggccgaggccgccaagacagtgctggagaagtaccccaacacccccatgagccacaaggagatcctgcaggtgatccagcgggagggcctgaaggagatccgcagcggcaccagccccctggcctgcctgaatgccatgctgcacaccaacagcagaggagaggagggcatcttctacaaggtgcccggccgcatgggcgtgtacaccctgaagaaggatgtgcctgatggagtgaaggagctgtctgagggcagcgaggagagcagtgatggccagagcgacagccagagcagcgagaacagcagcagcagcagtgatggcggcagcaacaaggagggcaagaagagccgctggaagaggaaggtgagcagcagcagcccccagagcggctgccccagccccaccatcccagctgggaaggtgatcagccccagccagaagcacagcaagaaggccctgaagcaggccctgaagcagcagcagcagaagaagcagcagcagcagtgccggcccagcatcagcatcagcagcaaccagcacctgagcctgaagacagtgaaggccgccagtgacagcgtgcctgccaagccagccacctgggagggcaagcagagtgatggccagacaggcagcccccagaacagcaacagcagcttcagcagctctgtgaaggtggagaacaccctgctgggcctgggcaagaagagcttccagaggtctgagcggctgcacacccggcagatgaagaggaccaagtgtgccgacattgatgtggagaccccagacagcatcctggtgaacaccaacctgcgggccctgatcaacaagcacaccttctctgtgctgcccggggactgccagcagaggctgctgctgctgctgcctgaggtggaccggcaggtgggcccagatggcctgatgaagctgaatggaagtgccctgaacaatgagttcttcaccagcgctgcccagggctggaaggagcggctgtctgagggggagttcaccccagagatgcaggtgcgcatccggcaggagattgagaaggagaagaaggtggagccctggaaggagcagttctttgagagctactacggccagagcagcggcctgagcctggaggacagcaagaagctgacagccagccccagcgaccccaaggtgaagaagaccccagctgagcagcccaagtccatgcctgtgtctgaggccagcctcatccgcatcgtgcctgtggtgtcccagagcgagtgcaaggaggaggccctgcagatgagcagccctggcaggaaggaggagtgtgagagccagggcgaggtgcagcccaacttcagcaccagcagcgagcccctgctgagcagcgccctgaacacccatgagctgagcagcatcctgcccatcaagtgccccaaggatgaggacctgctggagcagaagcctgtgaccagcgctgagcaggagagcgagaagaaccacctgaccacagccagcaactacaacaagtctgagagccaggagagcctggtgaccagccccagcaagcccaagagccctggggtggagaagcccatcgtgaagcccacagctggggccggcccccaggagaccaacatgaaggagcccctggccaccctggtggaccagagccctgagagcctgaagaggaagagcagcctgacccaggaggaggcccctgtgtcctgggagaagaggccccgggtgacagaaaatcggcagcaccagcagcccttccaggtgagcccccagcccttcctgaacagaggagaccgcatccaggtgaggaaggtgccccccctgaagatccctgtgagccgcatcagccccatgcccttccaccccagccaggtgagcccccgggcccgcttccctgtgtccatcaccagccccaacagaactggagcccggaccctggccgacatcaaggccaaggcccagctggtgaaggcccagagagctgctgctgctgctgctgctgctgctgctgctgctgcctctgtgggcggcaccatccctggccctggccctgggggcggccagggccctggagagggcggggagggccagacagcccggggcggcagccctggcagtgacagagtgtctgaaacaggcaagggccccaccctggagctggccggcaccggcagccggggcggcacccgggagctgctgccctgtggccctgagacccagccccagagcgagaccaagaccacccccagccaggcccagccccacagcgtgtctggggcccagctgcagcagaccccacctgtgccccccaccccagctgtgtctggggcctgcacctctgtgcccagccctgcccacatcgagaagctggacaatgagaagctgaaccccacccgggccacagccaccgtggcctctgtgagccacccccagggccccagcagctgccggcaggagaaggcccccagccccaccggccctgccctgatcagcggggccagccctgtgcactgtgccgcagatggcaccgtggagctgaaggccggccccagcaagaacatccccaaccccagcgccagcagcaagacagatgcctctgtgcctgtggccgtgacccccagccccctgaccagcctgctgaccacagccaccctggagaagctgcctgtgccccaggtgtctgccaccacagccccagctggcagcgccccacccagcagcaccctgcctgctgccagcagcctgaagaccccaggcaccagcctgaacatgaatggccccaccctgcggcccaccagcagcatcccagccaacaaccccctggtgacccagctgctgcagggcaaggatgtgcccatggagcagatcctgcccaagcccctgaccaaggtggagatgaagacagtgcccctgacagccaaggaggagcggggcatgggcgccctgattgccaccaacaccacagagaacagcacccgggaggaggtgaatgaaaggcagagccacccagccacccagcagcagctgggcaagaccctgcagagcaagcagctgccccaggtgccccggcccctgcagctgttcagcgccaaggagctgcgggacagcagcattgacacccaccagtaccacgagggcctgagcaaggccacccaggaccagatcctgcagaccctcatccagagggtgcggcggcagaacctgctgtctgtggtgccccccagccagttcaactttgcccacagcggcttccagctggaggacatcagcaccagccagcgcttcatgctgggctttgctggaagaaggaccagcaagccagccatggccggccactacctgctgaacatcagcacctacggccggggcagcgagagcttccggaggacccacagcgtgaacccagaagatcgcttctgcctgagcagccccacagaggccctgaagatgggctacacagactgcaagaatgccaccggggagagcagcagcagcaaggaggatgacacagatgaggagagcactggagatgagcaggagagcgtgacagtgaaggaggagccccaggtgtcccagagcgctggaaaaggagacaccagcagcggcccccacagccgggagaccctgagcaccagtgactgcctggccagcaagaatgtgaaggccgagatccccctgaatgagcagaccaccctgagcaaggagaactacctgttcacccggggccagacctttgatgagaagaccctggcccgggacctgatccaggccgcccagaagcagatggcccatgctgtgcggggcaaggccatccgcagcagccctgagctgttcagcagcacagtgctgcccctgcctgctgacagccccacccaccagcccctgctgctgccccccctgcagacccccaagctgtatggcagccccacccagatcggccccagctaccggggcatgatcaacgtgtccaccagcagtgacatggaccacaacagcgctgtgcccggcagccaggtgagcagcaatgtgggagatgtgatgtccttctctgtgacagtgaccaccatcccagccagccaggccatgaaccccagcagccacggccagaccatccctgtgcaggccttcagcgaggagaacagcattgagggcacccccagcaagtgctactgccgcctgaaggccatgatcatgtgcaagggctgtggggccttctgccatgatgactgcatcggccccagcaagctgtgtgtgtcctgcctggtggtgaggtag

SEQ ID NO: 142774 - DNA, 6747 bp, Artificial Sequence
  Description of Artificial Sequence: Synthetic coding sequence
atgaaggacaagaggaagaagaaggacaggacctgggccgaggccgcccggctggccctggagaagcaccccaacagccccatgacagccaagcagatcctggaggtgatccagaaggagggcctgaaggagaccagcggcaccagccccctggcctgcctgaatgccatgctgcacaccaacaccagaattggagatggcaccttcttcaagatccctgggaagagcggcctgtatgccctgaagaaggaggagagcagctgcccagcagatggcaccctggacctggtgtgtgagagcgagctggatggaacagacatggccgaggccaatgcccatggagaggagaatggagtgtgcagcaagcaggtgacagatgaggccagcagcacccgggacagcagcctgaccaacacagctgtgcagagcaagctggtgagcagcttccagcagcacaccaagaaggccctgaagcaggccctgcggcagcagcagaagagaagaaatggagtgtccatgatggtgaacaagacagtgccccgggtggtgctgacccccctgaaggtgtctgatgagcagagcgacagccccagcggcagcgagagcaagaatggagaggccgacagcagtgacaaggagatgaagcacggccagaagagccccaccgggaagcagaccagccagcacctgaagaggctgaagaagagcggcctgggccacctgaagtggaccaaggcagaagatattgatattgagaccccaggcagcatcctggtgaacaccaacctgcgggccctgatcaacaagcacacctttgccagcctgccccagcacttccagcagtacctgctgctgctgctgcctgaggtggaccggcagatgggcagtgatggcatcctgcggctgagcaccagcgccctgaacaatgagttctttgcctatgctgcccagggctggaagcagaggctggccgagggggagttcaccccagagatgcagctgcgcatccggcaggagattgagaaggagaagaagacagagccctggaaggagaagttctttgagcgcttctacggggagaagctgggcatgagccgggaggagagcgtgaagctgaccaccggccccaacaatgctggggcccagagcagcagcagctgtggcaccagcggcctgcctgtgtctgcccagacagccctggccgagcagcagcccaagtccatgaagagccctgccagccctgagcccggcttctgtgccaccctgtgccccatggtggagatcccccccaaggacatcatggccgagctggagagcgaggacatcctgatccctgaggagagcgtcatccaggaggagattgctgaggaggtggagaccagcatctgtgagtgccaggatgagaaccacaagaccatccctgagttcagcgaggaggccgagagcctgaccaacagccatgaggagccccagatcgcccctcctgaggacaacctggagagctgtgtgatgatgaatgatgtgctggagaccctgccccacatcgaggtgaagattgagggcaagtctgagagcccccaggaggagatgacagtggtgattgaccagctggaggtgtgtgacagcctcatccccagcaccagctccatgacccacgtgtctgacacagagcacaaggagagcgagacagctgtggagaccagcacccccaagatcaagacaggcagcagcagcctggagggccagttccccaatgaaggcatcgccatcgacatggagctgcagagcgaccctgaggagcagctgtctgaaaatgcctgcatcagcgagaccagcttcagcagcgagagccctgagggcgcctgcaccagcctgcccagccctggaggagagacccagagcaccagcgaggagagctgcaccccagccagcctggagaccaccttctgcagcgaggtgagcagcacagaaaatacagacaagtacaaccagaggaacagcacagatgagaacttccacgccagcctgatgtctgagatcagccccatcagcaccagccctgagatcagcgaggccagcctgatgagcaacctgcccctgaccagcgaggccagccctgtgagcaacctgcccctgaccagcgagaccagccccatgtctgacctgcccctgaccagcgagaccagctctgtgtcctccatgctgctgaccagcgagaccacctttgtgagcagcctgcccctgcccagcgagaccagccccatcagcaacagcagcatcaatgaaagaatggcccaccagcagaggaagagccccagcgtgtctgaggagcccctgagcccccagaaggatgagagcagcgccacagccaagcccctgggggagaacctgaccagccagcagaagaacctgagcaacaccccagagcccatcatcatgagcagcagcagcatcgcccctgaggccttccccagcgaggacctgcacaacaagaccctgagccagcagacctgcaagagccacgtggacacagagaagccctacccagccagcatccctgagctggccagcacagagatgatcaaggtgaagaaccacagcgtgctgcagaggacagagaagaaggtgctgcccagccccctggagctgagcgtcttcagcgagggcacagacaacaagggaaatgagctgcccagcgccaagctgcaggacaagcagtacatcagctctgtggacaaggcccccttcagcgagggcagcaggaacaagacccacaagcagggcagcacccagagccggctggagaccagccacaccagcaagagcagcgagcccagcaagagcccagatggcatcagaaatgaaagccgggacagcgagatcagcaagaggaagacagctgagcagcacagctttggcatctgcaaggagaagagggccagaattgaagatgaccagagcaccaggaacatcagcagcagcagccccccagagaaggagcagcccccccgggaggagccccgggtgccccccctgaagatccagctgagcaagattggcccccccttcatcatcaagagccagcctgtgtccaagccagagagccgggccagcaccagcacctctgtgtctgggggcagaaatactggagcccggaccctggccgacatcaaggcccgggcccagcaggcccgggcccagcgggaggccgctgctgctgctgctgtggccgctgctgccagcatcgtgtctggggccatgggcagccctggagagggcggcaagaccaggaccctggcccacatcaaggagcagaccaaggccaagctgtttgccaagcaccaggcccgggcccacctgttccagaccagcaaggagacccggctgcccccacccctgagcagcaaggagggcccccccaacctggaggtgagcagcaccccagagaccaagatggagggcagcactggagtcatcatcgtgaaccccaactgccgcagccccagcaacaagagcgcccacctgcgggagaccaccaccgtgctgcagcagagcctgaaccccagcaagctgcctgagacagccacagacctgtctgtgcacagcagtgatgagaacatccctgtgagccacctgtctgagaagatcgtgagcagcaccagcagcgagaacagctctgtgcccatgctgttcaacaagaacagcgtgcctgtgtctgtgtgcagcacagccatcagcggggccatcaaggagcacccctttgtgtcctctgtggacaagagctctgtgctgatgtctgtggacagcgccaacaccaccatcagcgcctgcaacatctccatgctgaagaccatccagggcacagacaccccctgcatcgccatcatccccaagtgcatcgagagcacccccatcagcgccaccacagagggcagcagcatcagcagctccatggatgacaagcagctgctgatcagcagcagcagcgccagcaacctggtgtccacccagtacacctctgtgcccacccccagcatcggcaacaacctgcccaacctgagcaccagctctgtgctgatcccccccatgggcatcaacaaccgcttccccagcgagaagatcgccatccctggcagcgaggagcaggccaccgtgtccatgggcaccaccgtgcgggccgccctgagctgcagcgacagcgtggccgtgacagacagcctggtggcccaccccaccgtggccatgttcaccggcaacatgctgaccatcaacagctatgacagcccccccaagctgtctgctgagagcctggacaagaacagcggccccaggaacagagctgacaacagcggcaagccccagcagcccccaggcggctttgccccagctgccatcaacagaagcatcccctgcaaggtgattgtggaccacagcaccaccctgaccagcagcctgagcctgactgtgtctgtggagagcagcgaggccagcctggacctgcagggccggcctgtgaggacagaggcctctgtgcagcctgtggcctgcccccaggtgtctgtcatcagcaggcctgagcctgtggccaatgaaggaattgaccacagcagcaccttcatcgccgccagcgctgccaagcaggacagcaagaccctgcctgccacctgcaccagcctgcgggagctgcccctggtgcctgacaagctgaatgagcccacagcccccagccacaactttgctgagcaggcccggggccctgcccccttcaagtctgaggccgacaccacctgcagcaaccagtacaaccccagcaaccgcatctgctggaatgatgatggcatgaggagcacaggccagcccctggtgacccacagcggcagcagcaagcagaaggagtacctggagcagagctgccccaaggccatcaagacagagcacgccaactacctgaatgtgtctgagctgcaccccaggaacctggtgaccaacgtggccctgcctgtgaagtctgagctgcatgaagctgacaagggcttcaggatggacacagaggacttccctggccctgagctgcccccacctgctgctgagggcgccagctctgtgcagcagacccagaacatgaaggccagcaccagcagccccatggaggaggccatcagcctggccacagatgccctgaagagggtgcctggagctggcagcagcggctgccgcctgagctctgtggaggccaacaaccccctggtgacccagctgctgcagggcaacctgcccctggagaaggtgctgccccagccccggctgggcgccaagctggagatcaaccggctgcccctgcccctgcagaccacctctgtgggcaagacagcccctgagagaaatgtggagatcccccccagcagccccaacccagatggcaagggctacctggccggcaccctggcccccctgcagatgaggaagcgggagaaccaccccaagaagagggtggccaggacagtgggggagcacacccaggtgaagtgtgagcccgggaagctgctggtggagccagatgtgaagggcgtgccctgtgtgatcagcagcggcatcagccagctgggccacagccagcccttcaagcaggagtggctgaacaagcacagcatgcagaaccgcatcgtgcacagccctgaggtgaagcagcagaagaggctgctgcccagctgcagcttccagcagaacctcttccacgtggacaagaatggaggcttccacacagatgctggcaccagccaccggcagcagttctaccagatgcctgtggccgcccggggccccatccccacagctgccctgctgcaggccagcagcaagacccctgtgggctgcaatgcctttgccttcaacagacacctggagcagaagggcctgggggaggtgtccctgagcagcgccccccaccagctgcggctggccaacatgctgagccccaacatgcccatgaaggagggagatgaggtgggcggcacagcccacaccatgcccaacaaggccctggtgcaccccccacctcctcctcctcctcctcctcctccacccctggccctgcccccacctcctcctcctcctccacccctgcccccacccctgcccaatgctgaggtgcccagcgaccagaagcagccccctgtgaccatggagaccaccaagaggctgtcctggccccagagcacaggcatctgcagcaacatcaagtctgagcccctgagctttgaggagggcctgagcagcagctgtgagctgggcatgaagcaggtgtcctatgaccagaatgagatgaaggagcagctgaaggcctttgccctgaagtctgctgacttcagcagctacctgctgtctgagccccagaagcccttcacccagctggccgcccagaagatgcaggtgcagcagcagcagcagctgtgtggcaactaccccaccatccacttcggcagcaccagcttcaagagagctgccagcgccatcgagaagagcatcggcatcctgggcagcggcagcaacccagccaccggcctgagcggccagaatgcccagatgcctgtgcagaactttgctgacagcagcaatgctgatgagctggagctgaagtgcagctgccgcctgaaggccatgattgtgtgcaagggctgtggggccttctgccatgatgactgcatcggccccagcaagctgtgtgtggcctgcctggtggtgaggtag

SEQ ID NO: 142775 - DNA, 2307 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaaggtgtggaccaacatcacccatgaccacgtgaagcccctgctgcagagcctgagcagcggcgtgtgtgtgcccagctgcatcaccaactgcctgtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcagggcgagctggtgacagccagcaaggccatcatcgagaaggagtaccagccccacgtgattgtgtccaccaccggccccaaccccttcaccaccctgacagaccgggagctggaggagtacagaagagaggtggagaggaagcagaagggcagcgaggagaacctggatgaggcccgggagcagaaggagaagagccccccagaccagcctgctgtgccccaccccccacccagcacccccatcaagctggaggaggacctggtgcctgagcccaccactggagatgacagtgatgctgccaccttcaagcccaccctgcctgacctgagcccagatgagcccagcgaggccctgggcttccccatgctggagaaggaggaggaggcccaccggccccccagccccacagaggcccccacagaggccagccctgagcccgccccagaccctgcccctgtggccgaggaggccgcccccagcgctgtggaggagggcgctgctgctgaccccggcagtgatggcagccctgggaagagccccagcaagaagaagaagaagttccgcacccccagcttcctgaagaagagcaagaagaagagtgacagctag

SEQ ID NO: 142776 - DNA, 1989 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaagtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcaggatgcccccctgagtgactgcacagagaccatcgagggcctggagctgacagagcagaccttcagccctgccaagagcctgtccttcaggaagggggagctggtgacagccagcaaggccatcatcgagaaggagtaccagccccacgtgattgtgtccaccaccggccccaaccccttcaccaccctgacagaccgggagctggaggagtacagaagagaggtggagaggaagcagaagggcagcgaggagaacctggatgaggcccgggagcagaaggagaagagccccccagaccagcctgctgtgccccaccccccacccagcacccccatcaagctggaggagggagatggctgtgcccgggagtacctgctgccctag

SEQ ID NO: 142777 - DNA, 1989 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaaggtgtggaccaacatcacccatgaccacgtgaagcccctgctgcagagcctgagcagcggcgtgtgtgtgcccagctgcatcaccaactgcctgtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcagggcgagctggtgacagccagcaaggccatcatcgagaaggagtaccagccccacgtgattgtgtccaccaccggccccaaccccttcaccaccctgacagaccgggagctggaggagtacagaagagaggtggagaggaagcagaagggcagcgaggagaacctggatgaggcccgggagcagaaggagaagagccccccagaccagcctgctgtgccccaccccccacccagcacccccatcaagctggaggagggagatggctgtgcccgggagtacctgctgccctag

SEQ ID NO: 142778 - DNA, 1203 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctaccgcaccagcagcagcggccggcggcaggatggatag

SEQ ID NO: 142779 - DNA, 1989 bp, Artificial Sequence; identical to SEQ ID NO: 142777
  Description of Artificial Sequence: Synthetic coding sequence

SEQ ID NO: 142780 - DNA, 2214 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaagtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcagggcgagctggtgacagccagcaaggccatcatcgagaaggagtaccagccccacgtgattgtgtccaccaccggccccaaccccttcaccaccctgacagaccgggagctggaggagtaccgccgggaggtggagaggaagcagaagggcagcgaggagaacctggatgaggcccgggagcagaaggagaagagccccccagaccagcctgctgtgccccaccccccacccagcacccccatcaagctggaggaggacctggtgcctgagcccaccactggagatgacagtgatgctgccaccttcaagcccaccctgcctgacctgagcccagatgagcccagcgaggccctgggcttccccatgctggagaaggaggaggaggcccacaggcctcccagccccacagaggcccccacagaggccagccctgagcccgccccagaccctgcccctgtggccgaggaggccgcccccagcgctgtggaggagggcgctgctgctgaccccggcagtgatggcagccctgggaagagccccagcaagaagaagaagaagttccgcacccccagcttcctgaagaagagcaagaagaagagtgacagctag

SEQ ID NO: 142781 - DNA, 2214 bp, Artificial Sequence; identical to SEQ ID NO: 142780
  Description of Artificial Sequence: Synthetic coding sequence

SEQ ID NO: 142782 - DNA, 414 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctag

SEQ ID NO: 142783 - DNA, 1899 bp, Artificial Sequence
  Description of Artificial Sequence: Synthetic coding sequence
atgaatggagacagcagagctgctgtggtgaccagccccccacccaccacagccccccacaaggagcgctactttgacagagtggatgagaacaaccctgagtacctgcgggagaggaacatggccccagacctgcggcaggacttcaacatgatggagcagaagaagagggtgtccatgatcctgcagagccctgccttctgtgaggagctggagagcatgatccaggagcagttcaagaagggcaagaaccccaccggcctgctggccctgcagcagattgctgacttcatgaccaccaacgtgcccaacgtgtacccagctgccccccagggcggcatggccgccctgaacatgagcctgggcatggtgacccctgtgaatgacctgcggggcagtgacagcatcgcctatgacaagggggagaagctgctgcgctgcaagctggccgccttctaccgcctggccgacctgtttggctggagccagctgatctacaaccacatcaccaccagggtgaacagcgagcaggagcacttcctgattgtgcccttcggcctgctgtacagcgaggtgacagccagcagcctggtgaagatcaacctgcagggcgacatcgtggaccggggcagcaccaacctgggcgtgaaccaggccggcttcaccctgcacagcgccatctatgctgcccggccagatgtgaagtgtgtggtgcacatccacaccccagctggagctgctgtgtctgccatgaagtgtggcctgctgcccatcagccctgaggccctgagcctgggggaggtggcctaccatgactaccacggcatcctggtggatgaggaggagaaggtgctgatccagaagaacctgggccccaagagcaaggtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaagtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcagggcgagctggtgacagccagcaaggccatcatcgagaaggagtaccagccccacgtgattgtgtccaccaccggccccaaccccttcaccaccctgacagaccgggagctggaggagtaccgccgggaggtggagaggaagcagaagggcagcgaggagaacctggatgaggcccgggagcagaaggagaagagccccccagaccagcctgctgtgccccaccccccacccagcacccccatcaagctggaggaggccggagatggctgtgcccgggagtacctgctgccctag

SEQ ID NO: 142784 - DNA, 1335 bp, Artificial Sequence
  Description of Artificial Sequence: Synthetic coding sequence
tgagtgctgatcctgaggaaccacggcctggtgtctgtgggggagagcgtggaggaggccttctactacatccacaacctggtggtggcctgtgagatccaggtgaggaccctggccagcgctgggggccctgacaacctggtgctgctgaaccctgagaagtacaaggccaagagccgcagccctggcagccctgtgggggagggcaccggcagcccccccaagtggcagatcggggagcaggagtttgaggccctgatgaggatgctggacaacctgggctacagaacaggctacccctaccgctacccagccctgcgggagaagagcaagaagtacagtgatgtggaggtgcctgcctctgtgacaggctacagctttgccagtgatggagacagcggcacctgcagccccctgcggcacagcttccagaagcagcagcgggagaagacccgctggctgaacagcggcagaggagatgaggccagcgaggagggccagaatggcagcagccccaagagcaagaccaaggtgtggaccaacatcacccatgaccacgtgaagcccctgctgcagagcctgagcagcggcgtgtgtgtgcccagctgcatcaccaactgcctgtggaccaaggaggatggccacaggaccagcaccagcgctgtgcccaacctgtttgtgcccctgaacaccaaccccaaggaggtgcaggagatgaggaacaagatccgggagcagaacctgcaggacatcaagacagctggcccccagagccaggtgctgtgtggggtggtgatggacaggagcctggtgcagggcgagctggtgacagccagcaaggccatcatcgagaaggagtaccagccccacgtgattgtgtccaccaccggccccaaccccttcaccaccctgacagaccgggagctggaggagtacagaagagaggtggagaggaagcagaagggcagcgaggagaacctggatgaggcccgggagcagaaggagaagagccccccagaccagcctgctgtgccccaccccccacccagcacccccatcaagctggaggaggacctggtgcctgagcccaccactggagatgacagtgatgctgccaccttcaagcccaccctgcctgacctgagcccagatgagcccagcgaggccctgggcttccccatgctggagaaggaggaggaggcccaccggccccccagccccacagaggcccccacagaggccagccctgagcccgccccagaccctgcccctgtggccgaggaggccgcccccagcgctgtggaggagggcgctgctgctgaccccggcagctag

SEQ ID NO: 142785 - DNA, 2181 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatccacctgcacaccccagccacagctgctgtgtctgccatgaagtggggcctgctgcctgtgagccacaatgccctgctggtgggggacatggcctactatgacttcaacggggagatggagcaggaggccgaccgcatcaacctgcagaagtgcctgggccccacctgcaagatcctggtgctgaggaaccacggcgtggtggccctgggggacacagtggaggaggccttctacaagatcttccacctgcaggccgcctgtgagatccaggtgtctgccctgagcagcgctggaggagtggagaacctgatcctgctggagcaggagaagcaccggccccatgaggtgggctctgtgcagtgggccggcagcaccttcggccccatgcagaagagccggctgggggagcatgaatttgaggccctgatgaggatgctggacaacctgggctacagaacaggctacacctaccgccacccctttgtgcaggagaagaccaagcacaagtctgaggtggagatcccagccaccgtgacagcctttgtgtttgaagaagatggagcccctgtgcctgccctgcggcagcacgcccagaagcagcagaaggagaagacccgctggctgaacacccccaacacctacctgcgggtgaatgtggctgatgaggtgcagaggtccatgggcagcccccggcccaagaccacctggatgaaggcagatgaggtggagaagagcagcagcggcatgcccatcagaattgagaaccccaaccagtttgtgcccctgtacacagacccccaggaggtgctggagatgaggaacaagatccgggagcagaaccggcaggatgtgaagtctgctggcccccagagccagctgctggcctctgtgattgctgagaagagccgcagccccagcacagagagccagctgatgagcaaaggagatgaggacaccaaggatgattctgaggagaccgtgcccaaccccttcagccagctgacagaccaggagctggaggagtacaagaaggaggtggagaggaagaagctggagctggatggagagaaggagacagcccctgaggagcccggcagccctgccaagagcgccccagccagccctgtgcagagccctgccaaggaggccgagaccaagagccccctggtgagccccagcaagagcctggaggagggcaccaagaagacagagaccagcaaggccgccaccacagagcctgagaccacccagcctgagggcgtggtggtgaatggccgggaggaggagcagacagctgaggagatcctgagcaagggcctgagccagatgaccaccagcgctgacacagatgtggacaccagcaaggacaagacagagagcgtgaccagcggccccatgagccctgagggcagccccagcaagagccccagcaagaagaagaagaagttccgcacccccagcttcctgaagaagagcaagaagaaggagaaggtggagagctag

SEQ ID NO: 142786 - DNA, 297 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaaggagtacaagaaggaggtggagaggaagaagctggagctggatgcccctggctggttcagcagctag

SEQ ID NO: 142787 - DNA, 1764 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatccacctgcacaccccagccacagctgctgtgtctgccatgaagtggggcctgctgcctgtgagccacaatgccctgctggtgggggacatggcctactatgacttcaacggggagatggagcaggaggccgaccgcatcaacctgcagaagtgcctgggccccacctgcaagatcctggtgctgaggaaccacggcgtggtggccctgggggacacagtggaggaggccttctacaagatcttccacctgcaggccgcctgtgagatccaggtgtctgccctgagcagcgctggaggagtggagaacctgatcctgctggagcaggagaagcaccggccccatgaggtgggctctgtgcagtgggccggcagcaccttcggccccatgcagaagagccggctgggggagcatgaatttgaggccctgatgaggatgctggacaacctgggctacagaacaggctacacctaccgccacccctttgtgcaggagaagaccaagcacaagtctgaggtggagatcccagccaccgtgacagcctttgtgtttgaagaagatggagcccctgtgcctgccctgcggcagcacgcccagaagcagcagaaggagaagacccgctggctgaacacccccaacacctacctgcgggtgaatgtggctgatgaggtgcagaggtccatgggcagcccccggcccaagaccacctggatgaaggcagatgaggtggagaagagcagcagcggcatgcccatcagaattgagaaccccaaccagtttgtgcccctgtacacagacccccaggaggtgctggagatgaggaacaagatccgggagcagaaccggcaggatgtgaagtctgctggcccccagagccagctgctggcctctgtgattgctgagaagagccgcagccccagcacagagagccagctgatgagcaaaggagatgaggacaccaaggatgattctgaggagaccgtgcccaaccccttcagccagctgacagaccaggagctggaggagtacaagaaggaggtggagaggaagaagctggagctggatgcccctggctggttcagcagctag

SEQ ID NO: 142788 - DNA, 2181 bp, Artificial Sequence; identical to SEQ ID NO: 142785
  Description of Artificial Sequence: Synthetic coding sequence

SEQ ID NO: 142789 - DNA, 2181 bp, Artificial Sequence; identical to SEQ ID NO: 142785
  Description of Artificial Sequence: Synthetic coding sequence

SEQ ID NO: 142790 - DNA, 1680 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatccacctgcacaccccagccacagctgctgtgtctgccatgaagtggggcctgctgcctgtgagccacaatgccctgctggtgggggacatggcctactatgacttcaacggggagatggagcaggaggccgaccgcatcaacctgcagaagtgcctgggccccacctgcaagatcctggtgctgaggaaccacggcgtggtggccctgggggacacagtggaggaggccttctacaagatcttccacctgcaggccgcctgtgagatccaggtgtctgccctgagcagcgctggaggagtggagaacctgatcctgctggagcaggagaagcaccggccccatgaggtgggctctgtgcagtgggccggcagcaccttcggccccatgcagaagagccggctgggggagcatgaatttgaggccctgatgaggatgctggacaacctgggctacagaacaggctacacctaccgccacccctttgtgcaggagaagaccaagcacaagtctgaggtggagatcccagccaccgtgacagcctttgtgtttgaagaagatggagcccctgtgcctgccctgcggcagcacgcccagaagcagcagaaggagaagacccgctggctgaacacccccaacacctacctgcgggtgaatgtggctgatgaggtgcagaggtccatgggcagcccccggcccaagaccacctggatgaaggcagatgaggtggagaagagcagcagcggcatgcccatcagaattgagaaccccaaccagtttgtgcccctgtacacagacccccaggaggtgctggagatgaggaacaagatccgggagcagaaccggcaggatgtgaagtctgctggcccccagagccagctgctggcctctgtgattgctgagaagagccgcagccctgtggagcagaggctgcccctgactggaggagagacctgcctgcccagcggcagctctgtgcctggggccggcctgcaggacccctag

SEQ ID NO: 142791 - DNA, 681 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatctag

SEQ ID NO: 142792 - DNA, 432 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgtag

SEQ ID NO: 142793 - DNA, 1728 bp, Artificial Sequence
  Description of Artificial Sequence: Synthetic coding sequence
atgccccggcggcgggtgcctggggccaactgcaagcccaccgggaagatgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatccacctgcacaccccagccacagctgctgtgtctgccatgaagtggggcctgctgcctgtgagccacaatgccctgctggtgggggacatggcctactatgacttcaacggggagatggagcaggaggccgaccgcatcaacctgcagaagtgcctgggccccacctgcaagatcctggtgctgaggaaccacggcgtggtggccctgggggacacagtggaggaggccttctacaagatcttccacctgcaggccgcctgtgagatccaggtgtctgccctgagcagcgctggaggagtggagaacctgatcctgctggagcaggagaagcaccggccccatgaggtgggctctgtgcagtgggccggcagcaccttcggccccatgcagaagagccggctgggggagcatgaatttgaggccctgatgaggatgctggacaacctgggctacagaacaggctacacctaccgccacccctttgtgcaggagaagaccaagcacaagtctgaggtggagatcccagccaccgtgacagcctttgtgtttgaagaagatggagcccctgtgcctgccctgcggcagcacgcccagaagcagcagaaggagaagacccgctggctgaacacccccaacacctacctgcgggtgaatgtggctgatgaggtgcagaggtccatgggcagcccccggcccaagaccacctggatgaaggcagatgaggtggagaagagcagcagcggcatgcccatcagaattgagaaccccaaccagtttgtgcccctgtacacagacccccaggaggtgctggagatgaggaacaagatccgggagcagaaccggcaggatgtgaagtctgctggcccccagagccagctgctggcctctgtgattgctgagaagagccgcagccctgtggagcagaggctgcccctgactggaggagagacctgcctgcccagcggcagctctgtgcctggggccggcctgcaggacccctag

SEQ ID NO: 142794 - DNA, 54 bp, Artificial Sequence
  Description of Artificial Sequence: Synthetic coding sequence
atgtctgaggagaccgtgcctgaggccgccagccccccaccaccccagggctag

SEQ ID NO: 142795 - DNA, 846 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctggtgtctgaggtgctggagatgaggaacaagatccgggagcagaaccggcaggatgtgaagtctgctggcccccagagccagctgctggcctctgtgattgctgagaagagccgcagccccagcacagagagccagctgatgagcaaaggagatgaggacaccaaggatgattctgaggagaccgtgcccaaccccttcagccagctgacagaccaggagctggaggagtacaagaaggaggtggagaggaagaagctggagctggatgcccctggctggttcagcagctag

SEQ ID NO: 142796 - DNA, 1932 bp, Artificial Sequence
  Description of Artificial Sequence: Synthetic coding sequence
atgtctgaggagaccgtgcctgaggccgccagccccccaccaccccagggccagccctactttgaccgcttctctgaagatgatcctgagtacatgaggctgaggaacagagctgctgacctgcggcaggacttcaacctgatggagcagaagaagagggtgaccatgatcctgcagagccccagcttccgggaggagctggagggcctcatccaggagcagatgaagaagggcaacaacagcagcaacatctgggccctgcggcagattgctgacttcatggccagcaccagccatgctgtgttccccaccagctccatgaatgtgtccatgatgacccccatcaatgacctgcacacagctgacagcctgaacctggccaagggggagcggctgatgcgctgcaagatcagctctgtgtaccgcctgctggacctgtatggctgggcccagctgagtgacacctacgtgaccctgcgggtgtccaaggagcaggaccacttcctgatcagccccaagggcgtgtcctgcagcgaggtgacagccagcagcctcatcaaggtgaacatcctgggggaggtggtggagaagggcagcagctgcttccctgtggacaccaccggcttctgcctgcacagcgccatctatgctgcccggccagatgtgcgctgcatcatccacctgcacaccccagccacagctgctgtgtctgccatgaagtggggcctgctgcctgtgagccacaatgccctgctggtgggggacatggcctactatgacttcaacggggagatggagcaggaggccgaccgcatcaacctgcagaagtgcctgggccccacctgcaagatcctggtgctgaggaaccacggcgtggtggccctgggggacacagtggaggaggccttctacaagatcttccacctgcaggccgcctgtgagatccaggtgtctgccctgagcagcgctggaggagtggagaacctgatcctgctggagcaggagaagcaccggccccatgaggtgggctctgtgcagtgggccggcagcaccttcggccccatgcagaagagccggctgggggagcatgaatttgaggccctgatgaggatgctggacaacctgggctacagaacaggctacacctaccgccacccctttgtgcaggagaagaccaagcacaagtctgaggtggagatcccagccaccgtgacagcctttgtgtttgaagaagatggagcccctgtgcctgccctgcggcagcacgcccagaagcagcagaaggagaagacccgctggctgaacacccccaacacctacctgcgggtgaatgtggctgatgaggtgcagaggtccatgggcagcccccggcccaagaccacctggatgaaggcagatgaggtggagaagagcagcagcggcatgcccatcagaattgagaaccccaaccagtttgtgcccctgtacacagacccccaggaggtgctggagatgaggaacaagatccgggagcagaaccggcaggatgtgaagtctgctggcccccagagccagctgctggcctctgtgattgctgagaagagccgcagccccagcacagagagccagctgatgagcaaaggagatgaggacaccaaggatgattctgaggagaccgtgcccaaccccttcagccagctgacagaccaggagctggaggagtacaagaaggaggtggagaggaagaagctggagctggatgagaccggccaggagcgggagcccggcagcggccctgctgtgtgtgagttcttctctgtggccctgcacatctggagcaacatcctggagaggaagaagctgccccagaagagcctggcccacctgcagagcctgcacctgctgctgcagtgccgggcccagaggcggcggcagaggcagagggccctgtag

SEQ ID NO: 142797 - DNA, 2025 bp, Artificial Sequence
  Description of Artificial Sequence: Synthetic coding sequence
atgagcagtgatgccagccagggcgtcatcaccaccccacctcctccttccatgccccacaaggagcgctactttgaccgcatcaatgaaaatgaccctgagtacatccgggagaggaacatgagcccagacctgcggcaggacttcaacatgatggagcagaggaagagggtgacccagatcctgcagagccctgccttccgggaggacctggagtgcctgatccaggagcagatgaagaagggccacaaccccaccggcctgctggccctgcagcagattgctgactacatcatggccaacagcttcagcggcttcagcagcccccccctgagcctgggcatggtgacccccatcaatgacctgcctggagctgacaccagcagctatgtgaagggggagaagctgacccgctgcaagctggccagcctgtaccgcctggtggacctgtttggctgggcccacctggccaacacctacatctctgtgcgcatcagcaaggagcaggaccacatcatcatcatcccccggggcctgtccttcagcgaggccacagccagcaacctggtgaaggtgaacatcattggagaggtggtggaccagggcagcaccaacctgaagattgaccacacaggcttcagcccccatgctgccatctacagcaccaggccagatgtgaagtgtgtgatccacatccacaccctggccacagctgctgtgtcctccatgaagtgtggcatcctgcccatcagccaggagagcctgctgctgggagatgtggcctactatgactaccagggcagcctggaggagcaggaggagcgcatccagctgcagaaggtgctgggccccagctgcaaggtgctggtgctgaggaaccacggcgtggtggccctgggggagaccctggaggaggccttccactacatcttcaacgtgcagctggcctgtgagatccaggtgcaggccctggccggggccggcggcgtggacaacctgcacgtgctggacttccagaagtacaaggccttcacctacacagtggccgccagcggcggcggcggcgtgaacatgggcagccaccagaagtggaaggtgggggagattgaatttgagggcctgatgaggaccctggacaacctgggctacagaacaggctacgcctaccgccaccccctcatccgggagaagcccaggcacaagagtgatgtggagatcccagccaccgtgacagccttctcctttgaagatgacacagtgcccctgagccccctgaagtacatggcccagaggcagcagcgggagaagacccgctggctgaacagccccaacacctacatgaaggtgaatgtgcctgaggagagcagaaatggagagaccagccccaggaccaagatcacctggatgaaggccgaggacagcagcaaggtgtctgggggcacccccatcaagattgaggaccccaaccagtttgtgcccctgaacaccaaccccaatgaggtgctggagaagaggaacaagatccgggagcagaacagatatgacctgaagacagctggcccccagagccagctgctggccggcatcgtggtggacaagccacccagcaccatgcagtttgaagatgatgaccacggccccccagccccacccaaccccttcagccacctgacagaaggagagctggaggagtacaagaggaccattgaaaggaagcagcagggcctggaggagaaccacgagctgttcagcaagagcttcatctccatggaggtgcctgtgatggtggtgaatggcaaggatgacatgcatgatgtggaggatgagctggccaagagggtgtcccggctgagcaccagcaccaccatcgagaacatcgagatcaccatcaagagccctgagaagattgaggaggtgctgagccctgagggcagccccagcaagagccccagcaagaagaagaagaagttccgcacccccagcttcctgaagaagaacaagaagaaggagaaggtggaggcctag

SEQ ID NO: 142798 - DNA, 2121 bp, Artificial Sequence
  Description of Artificial Sequence: Synthetic coding sequence
atgagcagtgatgccagccagggcgtcatcaccaccccacctcctccttccatgccccacaaggagcgctactttgaccgcatcaatgaaaatgaccctgagtacatccgggagaggaacatgagcccagacctgcggcaggacttcaacatgatggagcagaggaagagggtgacccagatcctgcagagccctgccttccgggaggacctggagtgcctgatccaggagcagatgaagaagggccacaaccccaccggcctgctggccctgcagcagattgctgactacatcatggccaacagcttcagcggcttcagcagcccccccctgagcctgggcatggtgacccccatcaatgacctgcctggagctgacaccagcagctatgtgaagggggagaagctgacccgctgcaagctggccagcctgtaccgcctggtggacctgtttggctgggcccacctggccaacacctacatctctgtgcgcatcagcaaggagcaggaccacatcatcatcatcccccggggcctgtccttcagcgaggccacagccagcaacctggtgaaggtgaacatcattggagaggtggtggaccagggcagcaccaacctgaagattgaccacacaggcttcagcccccatgctgccatctacagcaccaggccagatgtgaagtgtgtgatccacatccacaccctggccacagctgctgtgtcctccatgaagtgtggcatcctgcccatcagccaggagagcctgctgctgggagatgtggcctactatgactaccagggcagcctggaggagcaggaggagcgcatccagctgcagaaggtgctgggccccagctgcaaggtgctggtgctgaggaaccacggcgtggtggccctgggggagaccctggaggaggccttccactacatcttcaacgtgcagctggcctgtgagatccaggtgcaggccctggccggggccggcggcgtggacaacctgcacgtgctggacttccagaagtacaaggccttcacctacacagtggccgccagcggcggcggcggcgtgaacatgggcagccaccagaagtggaaggtgggggagattgaatttgagggcctgatgaggaccctggacaacctgggctacagaacaggctacgcctaccgccaccccctcatccgggagaagcccaggcacaagagtgatgtggagatcccagccaccgtgacagccttctcctttgaagatgacacagtgcccctgagccccctgaagtacatggcccagaggcagcagcgggagaagacccgctggctgaacagccccaacacctacatgaaggtgaatgtgcctgaggagagcagaaatggagagaccagccccaggaccaagatcacctggatgaaggccgaggacagcagcaaggtgtctgggggcacccccatcaagattgaggaccccaaccagtttgtgcccctgaacaccaaccccaatgaggtgctggagaagaggaacaagatccgggagcagaacagatatgacctgaagacagctggcccccagagccagctgctggccggcatcgtggtggacaagccacccagcaccatgcagtttgaagatgatgaccacggccccccagccccacccaaccccttcagccacctgacagaaggagagctggaggagtacaagaggaccattgaaaggaagcagcagggcctggaggatgctgagcaggagctgctgagtgatgatgccagctctgtgtcccagatccagagccagacccagagcccccagaatgtgcctgagaagctggaggagaaccacgagctgttcagcaagagcttcatctccatggaggtgcctgtgatggtggtgaatggcaaggatgacatgcatgatgtggaggatgagctggccaagagggtgtcccggctgagcaccagcaccaccatcgagaacatcgagatcaccatcaagagccctgagaagattgaggaggtgctgagccctgagggcagccccagcaagagccccagcaagaagaagaagaagttccgcacccccagcttcctgaagaagaacaagaagaaggagaaggtggaggcctag

SEQ ID NO: 142799 - DNA, 2025 bp, Artificial Sequence; identical to SEQ ID NO: 142797
  Description of Artificial Sequence: Synthetic coding sequence

SEQ ID NO: 142800 - DNA, 543 bp, Artificial Sequence
  Description of Artificial Sequence: Synthetic coding sequence
atggctgacagcgagctgcagctggtggagcagaggatccgctccttcccagacttccccaccccaggagtggtgttccgggacatcagccctgtgctgaaggaccctgccagcttccgggccgccatcggcctgctggcccggcacctgaaggccacccacggcggcagaattgactacatcgccggcctggacagccggggcttcctgtttggccccagcctggcccaggagctgggcctgggctgtgtgctgatcaggaagaggggcaagctgcccggccccaccctgtgggccagctacagcctggagtatggcaaggccgagctggagatccagaaggatgccctggagcccggccagagggtggtggtggtggatgacctgctggccaccggcggcaccatgaatgctgcctgtgagctgctgggccgcctgcaggccgaggtgctggagtgtgtgtccctggtggagctgaccagcctgaagggccgggagaagctggcccctgtgcccttcttcagcctgctgcagtatgaatag

SEQ ID NO: 142801 - DNA, 405 bp, Artificial Sequence
  Description of Artificial Sequence: Synthetic coding sequence
atggctgacagcgagctgcagctggtggagcagaggatccgctccttcccagacttccccaccccaggagtggtgttccgggacatcagccctgtgctgaaggaccctgccagcttccgggccgccatcggcctgctggcccggcacctgaaggccacccacggcggcagaattgactacatcgccggcctggacagccggggcttcctgtttggccccagcctggcccaggagctgggcctgggctgtgtgctgatcaggaagaggggcaagctgcccggccccaccctgtgggccagctacagcctggagtatggcaaggccgagctggagatccagaaggatgccctggagcccggccagagggtggtggtggtggatgacctgctggccaccggggtgtag

SEQ ID NO: 142802 - DNA, 555 bp, Artificial Sequence
  Description of Artificial Sequence: Synthetic coding sequence
atggatggcctgcggcagagggtggagcacttcctggagcagaggaacctggtgacagaggtgctgggcgccctggaggccaagacaggagtggagaagcgctacctggccgccggggctgtgaccctgctgagcctgtacctgctgtttggctacggggccagcctgctgtgcaacctgattggatttgtgtacccagcctatgccagcatcaaggccatcgagagccccagcaaggatgatgacacagtgtggctgacctactgggtggtgtatgccctgtttggcctggccgagttcttcagtgacctgctgctgtcctggttccccttctactacgtgggcaaatgtgccttcctgctcttctgcatggccccccggccctggaatggagccctgatgctgtaccagagggtggtgcggcccctcttcctgcggcaccacggggctgtggaccgcatcatgaatgacctgagcggccgggccctggatgctgctgctggcatcaccagaaatgtgaagcccagccagaccccccagcccaaggacaagtag

SEQ ID NO: 142803 - DNA, 6090 bp, Artificial Sequence
  Description of Artificial Sequence: Synthetic coding sequence
atggccagctctgtggccccctatgagcagctggtgcggcaggtggaggccctgaaggccgagaacagccacctgcggcaggagctgcgggacaacagcagccacctgagcaagctggagacagagaccagcggcatgaaggaggtgctgaagcacctgcagggcaagctggagcaggaggcccgggtgctggtgagcagcggccagacagaggtgctggagcagctgaaggccctgcagatggacatcaccagcctgtacaacctgaagttccagccccccaccctgggccctgagcctgctgcccggaccccagagggcagccctgtgcacggcagcggccccagcaaggacagctttggagagctgagccgggccaccatccggctgctggaggagctggaccgggagcgctgcttcctgctgaatgaaattgagaaggaggagaaggagaagctgtggtactacagccagctgcagggcctgagcaagaggctggatgagctgccccacgtggactatgagatgcacaagatgacccgggaccccctgaacctggccctgcggcgctatgccggcatgaccctgaccaacctgacctttggagatgtggccaacaaggccaccctgtgtgcccggcggggctgcatggaggccatcgtggcccagctggccagtgacagcgaggagctgcaccaggtggtgagcagcatcctgaggaacctgtcctggagggctgacatcaacagcaagaaggtgctgcgggaggccggctctgtgacagccctggtgcagtgtgtgctgcgggccaccaaggagagcaccctgaagtctgtgctgagcgccctgtggaacctgagcgcccacagcacagagaacaaggccgccatctgccaggtggatggagccctgggcttcctggtgtccaccctgacctacaagtgccagagcaacagcctggccatcattgaaagtggcggcggcatcctgagaaatgtgagcagcctggtggccacccgggaggactaccggcaggtgctgcgggaccacaactgcctgcagaccctgctgcagcacctgaccagccacagcctgaccatcgtgtccaatgcctgtggcaccctgtggaacctgagcgcccggagcgcccgggaccaggagctgctgtgggacctgggcgctgtgggcatgctgaggaacctggtgcacagcaagcacaagatgattgccatgggcagcgctgctgccctgaggaacctgctggcccacaggcctgccaagcaccaggccgccgccacagctgtgtccccaggcagctgtgtgcccagcctgtatgtgaggaagcagagggccctggaggccgagctggatgcccggcacctggcccaggccctggagcacctggagaagcagggccccccagctgctgaggccgccaccaagaagcccctgccccccctgcggcacctggatggcctggcccaggactatgccagtgacagcggctgctttgatgatgatgatgcccccagcagcctggccgctgctgctgccactggagagcccgccagccctgctgccctgagcctcttcctgggcagccccttcctgcagggccaggccctggcccggaccccacccaccaggagaggaggcaaggaggccgagaaggacaccagcggggaggccgctgtggccgccaaggccaaggccaagctggccctggccgtggccagaattgaccagctggtggaggacatcagcgccctgcacaccagcagtgatgacagcttcagcctgagcagcggggaccccggccaggaggccccccgggagggccgggcccagagctgcagcccctgccggggccctgagggcggccggcgggaggccggcagccgggcccaccccctgctgcggctgaaggccgcccacgccagcctgagcaatgacagcctgaacagcggcagcgccagtgatggctactgcccccgggagcacatgctgccctgccccctggccgccctggccagcagaagagaggacccccgctgtggccagccccggcccagccggctggacctggacctgcccggctgccaggccgagcccccagcccgggaggccaccagcgcagatgcccgggtgaggaccatcaagctgagccccacctaccagcacgtgcccctgctggagggcgccagcagagctggagctgagcccctggccggccctggcatcagccctggggccaggaagcaggcctggctgcctgctgaccacctgagcaaggtgcctgagaagctggccgccgcccccctgtctgtggccagcaaggccctgcagaagctggccgcccaggagggccccctgagcctgagccgctgcagcagcctgagcagcctgagcagcgctggccggcccggccccagcgagggcggggacctggatgacagcgacagcagcctggagggcctggaggaggccggccccagcgaggccgagctggacagcacctggagggcccctggggccaccagcctgcctgtggccatcccagcccccaggaggaacagaggccggggcctgggcgtggaggatgccacccccagcagcagcagtgaaaattatgtgcaggagacccccctggtgctgagccgctgcagctctgtgagcagcctgggcagctttgagagccccagcatcgccagcagcatccccagcgagccctgcagcggccagggcagcggcaccatcagccccagcgagctgcctgacagccctggccagaccatgccacccagccgcagcaagaccccacccctggccccagccccccagggccccccagaggccacccagttcagcctgcagtgggagagctatgtgaagcgcttcctggacattgctgactgccgggagcgctgccgcctgcccagcgagctggatgctggctctgtgcgcttcaccgtggagaagccagatgagaacttcagctgtgccagcagcctgagcgccctggccctgcacgagcactacgtgcagcaggatgtggagctgcggctgctgcccagcgcctgcccagagcggggcggcggggccggcggggccggcctgcactttgctggccacagaagaagagaggagggccctgcccccaccggcagccggcccagaggagctgctgaccaggagctggagctgctgagagaatgtctgggcgctgctgtgcctgcccggctgaggaaggtggccagcgccctggtgcccggccggcgggccctgcctgtgcctgtgtacatgctggtgcctgccccagccccagcccaggaggatgacagctgcacagacagcgctgagggcacccctgtgaacttcagcagcgctgccagcctgagtgatgagaccctgcagggccccccccgggaccagcccggcggccctgctggccggcagaggcccaccggccggcccaccagcgcccggcaggccatgggccaccgccacaaggccggcggggccggccgctctgctgagcagagcagaggagctgggaagaacagagctggcctggagctgcccctgggccggccccccagcgccccagctgacaaggatggcagcaagccaggccgcaccagaggagatggagccctgcagagcctgtgcctgaccacccccacagaggaggccgtgtactgcttctatggaaatgacagtgatgaggagcccccagctgctgcccccacccccacccacaggaggaccagcgccatcccccgggccttcacccgggagcggccccagggcaggaaggaggccccagcccccagcaaggccgccccagctgcccctcctccagcccggacccagcccagcctgattgctgatgagaccccaccctgctacagcctgagcagcagcgccagcagcctgtctgagcctgagcccagcgagcccccagctgtgcacccccggggccgggagcctgctgtgaccaaggaccccggccctgggggcggccgggacagcagccccagccccagggctgctgaggagctgctgcagcgctgcatcagcagcgccctgccccggcggcggccccctgtgtctggcctgcggcggaggaagccccgggccacccggctggatgagaggcctgctgagggcagccgggagcggggggaggaggccgccggcagtgaccgggccagtgacctggacagcgtggagtggagggccatccaggagggcgccaacagcatcgtgacctggctgcaccaggccgctgctgccacccgggaggccagcagcgagagtgacagcatcctgagctttgtgtctggcctgtctgtgggcagcaccctgcagccccccaagcacaggaagggccggcaggccgagggggagatgggcagcgcccggcggcctgagaagagaggagctgcctctgtgaagaccagcggcagccccaggagccctgctggccctgagaagccccggggcacccagaagaccaccccaggagtgcctgctgtgctgcggggccgcaccgtcatctacgtgcccagccctgccccccgggcccagcccaagggcaccccaggcccccgggccacccccaggaaggtggccccaccctgcctggcccagcctgctgccccagccaaggtgcccagccctggccagcagaggagccgcagcctgcacaggcctgccaagaccagcgagctggccaccctgagccagccccccaggtctgccaccccaccagcccggctggccaagacccccagcagcagcagcagccagaccagccctgccagccagcccctgcccaggaagaggcctcctgtgacccaggccgccggggccctgcccggccctggggccagccctgtgcccaagaccccagcccggaccctgctggccaagcagcacaagacccagaggagccctgtgcgcatccccttcatgcagaggcctgcccggcggggccccccacccctggcccgggctgtgcctgagcccggcccccggggccgggccggcacagaagctggccctggggcccggggcggccgcctgggcctggtgcgggtggccagcgccctgagcagcggcagcgagagcagtgacagaagtggcttccggcggcagctgaccttcatcaaggagagccctggcctgcggaggagaagaagtgagctgagcagcgctgagagcgctgccagcgccccccagggcgccagcccccggcggggccgcccagccctgcctgctgtgttcctgtgcagcagccgctgtgaggagctgcgggccgccccccggcagggccctgccccagcccggcagaggcctcctgctgcccggcccagccctggagagaggcctgcccggaggaccaccagcgagagccccagccggctgcctgtgcgggccccagctgcccggcctgagaccgtgaagagatatgccagcctgccccacatctctgtggcccggcggccagatggagctgtgcctgctgccccagccagcgcagatgctgcccggcgcagcagtgatggagagccccggcccctgccccgggtggccgcccctggcaccacctggaggcgcatcagagatgaagatgtgccccacatcctgcggagcaccctgcctgccacagccctgcccctgcggggcagcaccccagaagatgccccagctggccccccacccaggaagaccagtgatgctgtggtgcagacagaggaggtggccgcccccaagaccaacagcagcaccagccccagcctggagacccgggagcccccaggggccccagctgggggccagctgagcctgctgggcagtgatgtggatggccccagcctggccaaggcccccatcagcgccccctttgtgcatgagggcctgggcgtggccgtgggcggcttccctgccagcagacatggcagccccagccgcagcgcccgggtgccccccttcaactacgtgcccagccccatggtggtggccgccaccacagacagcgctgctgagaaggccccagccacagccagcgccaccctgctggagtag

SEQ ID NO: 142804 - DNA, 6912 bp, Artificial Sequence
  Description of Artificial Sequence: Synthetic coding sequence
atggccagctctgtggccccctatgagcagctggtgcggcaggtggaggccctgaaggccgagaacagccacctgcggcaggagctgcgggacaacagcagccacctgagcaagctggagacagagaccagcggcatgaaggaggtgctgaagcacctgcagggcaagctggagcaggaggcccgggtgctggtgagcagcggccagacagaggtgctggagcagctgaaggccctgcagatggacatcaccagcctgtacaacctgaagttccagccccccaccctgggccctgagcctgctgcccggaccccagagggcagccctgtgcacggcagcggccccagcaaggacagctttggagagctgagccgggccaccatccggctgctggaggagctggaccgggagcgctgcttcctgctgaatgaaattgagaaggaggagaaggagaagctgtggtactacagccagctgcagggcctgagcaagaggctggatgagctgccccacgtggagacccagttctccatgcagatggacctgatccggcagcagctggagtttgaggcccagcacatccgcagcctgatggaggagcgcttcggcaccagtgatgagatggtgcagagggcccagatccgggccagccggctggagcagattgacaaggagctgctggaggcccaggacagagtgcagcagacagagccccaggccctgctggccgtgaagtctgtgcctgtggatgaagatcctgagacagaggtgcccacccacccagaagatggcaccccccagcccggcaacagcaaggtggaggtggtgttctggctgctgtccatgctggccacccgggaccaggaggacacagcccggaccctgctggccatgagcagcagccctgagagctgtgtggccatgagaagaagtggctgcctgcccctgctgctgcagatcctgcacggcacagaggccgccgccggcggccgggccggggcccctggggcccctggggccaaggatgccaggatgagggccaatgctgccctgcacaacatcgtgttcagccagcctgaccagggcctggccaggaaggagatgagggtgctgcacgtgctggagcagatccgggcctactgtgagacctgctgggactggctgcaggccagagatggcggccctgagggcggcggggccggcagcgcccccatccccatcgagccccagatctgccaggccacctgtgctgtgatgaagctgagctttgatgaggagtaccgccgggccatgaatgagctgggcggcctgcaggccgtggccgagctgctgcaggtggactatgagatgcacaagatgacccgggaccccctgaacctggccctgcggcgctatgccggcatgaccctgaccaacctgacctttggagatgtggccaacaaggccaccctgtgtgcccggcggggctgcatggaggccatcgtggcccagctggccagtgacagcgaggagctgcaccaggtggtgagcagcatcctgaggaacctgtcctggagggctgacatcaacagcaagaaggtgctgcgggaggccggctctgtgacagccctggtgcagtgtgtgctgcgggccaccaaggagagcaccctgaagtctgtgctgagcgccctgtggaacctgagcgcccacagcacagagaacaaggccgccatctgccaggtggatggagccctgggcttcctggtgtccaccctgacctacaagtgccagagcaacagcctggccatcattgaaagtggcggcggcatcctgagaaatgtgagcagcctggtggccacccgggaggactaccggcaggtgctgcgggaccacaactgcctgcagaccctgctgcagcacctgaccagccacagcctgaccatcgtgtccaatgcctgtggcaccctgtggaacctgagcgcccggagcgcccgggaccaggagctgctgtgggacctgggcgctgtgggcatgctgaggaacctggtgcacagcaagcacaagatgattgccatgggcagcgctgctgccctgaggaacctgctggcccacaggcctgccaagcaccaggccgccgccacagctgtgtccccaggcagctgtgtgcccagcctgtatgtgaggaagcagagggccctggaggccgagctggatgcccggcacctggcccaggccctggagcacctggagaagcagggccccccagctgctgaggccgccaccaagaagcccctgccccccctgcggcacctggatggcctggcccaggactatgccagtgacagcggctgctttgatgatgatgatgcccccagcagcctggccgctgctgctgccactggagagcccgccagccctgctgccctgagcctcttcctgggcagccccttcctgcagggccaggccctggcccggaccccacccaccaggagaggaggcaaggaggccgagaaggacaccagcggggaggccgctgtggccgccaaggccaaggccaagctggccctggccgtggccagaattgaccagctggtggaggacatcagcgccctgcacaccagcagtgatgacagcttcagcctgagcagcggggaccccggccaggaggccccccgggagggccgggcccagagctgcagcccctgccggggccctgagggcggccggcgggaggccggcagccgggcccaccccctgctgcggctgaaggccgcccacgccagcctgagcaatgacagcctgaacagcggcagcgccagtgatggctactgcccccgggagcacatgctgccctgccccctggccgccctggccagcagaagagaggacccccgctgtggccagccccggcccagccggctggacctggacctgcccggctgccaggccgagcccccagcccgggaggccaccagcgcagatgcccgggtgaggaccatcaagctgagccccacctaccagcacgtgcccctgctggagggcgccagcagagctggagctgagcccctggccggccctggcatcagccctggggccaggaagcaggcctggctgcctgctgaccacctgagcaaggtgcctgagaagctggccgccgcccccctgtctgtggccagcaaggccctgcagaagctggccgcccaggagggccccctgagcctgagccgctgcagcagcctgagcagcctgagcagcgctggccggcccggccccagcgagggcggggacctggatgacagcgacagcagcctggagggcctggaggaggccggccccagcgaggccgagctggacagcacctggagggcccctggggccaccagcctgcctgtggccatcccagcccccaggaggaacagaggccggggcctgggcgtggaggatgccacccccagcagcagcagtgaaaattatgtgcaggagacccccctggtgctgagccgctgcagctctgtgagcagcctgggcagctttgagagccccagcatcgccagcagcatccccagcgagccctgcagcggccagggcagcggcaccatcagccccagcgagctgcctgacagccctggccagaccatgccacccagccgcagcaagaccccacccctggccccagccccccagggccccccagaggccacccagttcagcctgcagtgggagagctatgtgaagcgcttcctggacattgctgactgccgggagcgctgccgcctgcccagcgagctggatgctggctctgtgcgcttcaccgtggagaagccagatgagaacttcagctgtgccagcagcctgagcgccctggccctgcacgagcactacgtgcagcaggatgtggagctgcggctgctgcccagcgcctgcccagagcggggcggcggggccggcggggccggcctgcactttgctggccacagaagaagagaggagggccctgcccccaccggcagccggcccagaggagctgctgaccaggagctggagctgctgagagaatgtctgggcgctgctgtgcctgcccggctgaggaaggtggccagcgccctggtgcccggccggcgggccctgcctgtgcctgtgtacatgctggtgcctgccccagccccagcccaggaggatgacagctgcacagacagcgctgagggcacccctgtgaacttcagcagcgctgccagcctgagtgatgagaccctgcagggccccccccgggaccagcccggcggccctgctggccggcagaggcccaccggccggcccaccagcgcccggcaggccatgggccaccgccacaaggccggcggggccggccgctctgctgagcagagcagaggagctgggaagaacagagctggcctggagctgcccctgggccggccccccagcgccccagctgacaaggatggcagcaagccaggccgcaccagaggagatggagccctgcagagcctgtgcctgaccacccccacagaggaggccgtgtactgcttctatggaaatgacagtgatgaggagcccccagctgctgcccccacccccacccacaggaggaccagcgccatcccccgggccttcacccgggagcggccccagggcaggaaggaggccccagcccccagcaaggccgccccagctgcccctcctccagcccggacccagcccagcctgattgctgatgagaccccaccctgctacagcctgagcagcagcgccagcagcctgtctgagcctgagcccagcgagcccccagctgtgcacccccggggccgggagcctgctgtgaccaaggaccccggccctgggggcggccgggacagcagccccagccccagggctgctgaggagctgctgcagcgctgcatcagcagcgccctgccccggcggcggccccctgtgtctggcctgcggcggaggaagccccgggccacccggctggatgagaggcctgctgagggcagccgggagcggggggaggaggccgccggcagtgaccgggccagtgacctggacagcgtggagtggagggccatccaggagggcgccaacagcatcgtgacctggctgcaccaggccgctgctgccacccgggaggccagcagcgagagtgacagcatcctgagctttgtgtctggcctgtctgtgggcagcaccctgcagccccccaagcacaggaagggccggcaggccgagggggagatgggcagcgcccggcggcctgagaagagaggagctgcctctgtgaagaccagcggcagccccaggagccctgctggccctgagaagccccggggcacccagaagaccaccccaggagtgcctgctgtgctgcggggccgcaccgtcatctacgtgcccagccctgccccccgggcccagcccaagggcaccccaggcccccgggccacccccaggaaggtggccccaccctgcctggcccagcctgctgccccagccaaggtgcccagccctggccagcagaggagccgcagcctgcacaggcctgccaagaccagcgagctggccaccctgagccagccccccaggtctgccaccccaccagcccggctggccaagacccccagcagcagcagcagccagaccagccctgccagccagcccctgcccaggaagaggcctcctgtgacccaggccgccggggccctgcccggccctggggccagccctgtgcccaagaccccagcccggaccctgctggccaagcagcacaagacccagaggagccctgtgcgcatccccttcatgcagaggcctgcccggcggggccccccacccctggcccgggctgtgcctgagcccggcccccggggccgggccggcacagaagctggccctggggcccggggcggccgcctgggcctggtgcgggtggccagcgccctgagcagcggcagcgagagcagtgacagaagtggcttccggcggcagctgaccttcatcaaggagagccctggcctgcggaggagaagaagtgagctgagcagcgctgagagcgctgccagcgccccccagggcgccagcccccggcggggccgcccagccctgcctgctgtgttcctgtgcagcagccgctgtgaggagctgcgggccgccccccggcagggccctgccccagcccggcagaggcctcctgctgcccggcccagccctggagagaggcctgcccggaggaccaccagcgagagccccagccggctgcctgtgcgggccccagctgcccggcctgagaccgtgaagagatatgccagcctgccccacatctctgtggcccggcggccagatggagctgtgcctgctgccccagccagcgcagatgctgcccggcgcagcagtgatggagagccccggcccctgccccgggtggccgcccctggcaccacctggaggcgcatcagagatgaagatgtgccccacatcctgcggagcaccctgcctgccacagccctgcccctgcggggcagcaccccagaagatgccccagctggccccccacccaggaagaccagtgatgctgtggtgcagacagaggaggtggccgcccccaagaccaacagcagcaccagccccagcctggagacccgggagcccccaggggccccagctgggggccagctgagcctgctgggcagtgatgtggatggccccagcctggccaaggcccccatcagcgccccctttgtgcatgagggcctgggcgtggccgtgggcggcttccctgccagcagacatggcagccccagccgcagcgcccgggtgccccccttcaactacgtgcccagccccatggtggtggccgccaccacagacagcgctgctgagaaggccccagccacagccagcgccaccctgctggagtag

SEQ ID NO: 142805 - DNA, 1545 bp, Artificial Sequence
  Description of Artificial Sequence: Synthetic coding sequence
atgtcctggccccggcggctgctgctgcgctacctgtttcctgccctgctgctgcacggcctgggggagggcagcgccctgctgcacccagacagccgcagccaccccaggagcctggagaagagcgcctggagggccttcaaggagagccagtgccaccacatgctgaagcacctgcacaatggagcccgcatcaccgtgcagatgccacccaccatcgagggccactgggtgtccacaggctgtgaggtgcgcagcggccctgagttcatcaccaggagctaccgcttctaccacaacaacaccttcaaggcctaccagttctactacggcagcaaccgctgcaccaaccccacctacaccctcatcatccggggcaagatccggctgcggcaggcctcctggatcatccggggcggcacagaagctgactaccagctgcacaacgtgcaggtgatctgccacacagaggccgtggccgagaagctgggccagcaggtgaacagaacctgccccggcttcctggctgatggcggcccctgggtgcaggatgtggcctatgacctgtggagagaagaaaatggctgtgaatgtaccaaggctgtgaactttgccatgcatgagctgcagctgatccgggtggagaagcagtacctgcaccacaacctggaccacctggtggaggagctgttcctgggggacatccacacagatgccacccagaggatgttctaccggcccagcagctaccagccccccctgcagaatgccaagaaccacgaccacgcctgcatcgcctgccgcatcatctacagaagtgatgagcaccacccccccatcctgccccccaaggctgacctgaccatcggcctgcacggggagtgggtgtcccagagatgtgaggtgcggcctgaggtgctcttcctgaccaggcacttcatcttccatgacaacaacaacacctgggagggccactactaccactacagcgaccctgtgtgcaagcaccccaccttcagcatctatgcccggggccgctacagccggggcgtgctgagcagccgggtgatgggcggcacagaatttgtgttcaaggtgaaccacatgaaggtgacccccatggatgctgccacagccagcctgctgaatgtgttcaatggaaatgaatgtggggctgagggctcctggcaggtgggcatccagcaggatgtgacccacaccaacggctgtgtggccctgggcatcaagctgccccacacagaatatgagatcttcaagatggagcaggatgcccggggccgctacctgctcttcaacggccagaggcccagtgatggcagcagcccagacaggcctgagaagagggccaccagctaccagatgcccctggtgcagtgtgccagcagcagccccagggctgaggacctggccgaggacagcggcagcagcctgtatggccgggcccctggccgccacacctggagcctgctgctggccgccctggcctgcctggtgcccctgctgcactggaacatcagaagatag

SEQ ID NO: 142806 - DNA, 1698 bp, Artificial Sequence
  Description of Artificial Sequence: Synthetic coding sequence
atgaagaggcgctgcagctgtggcggcggcggcggccactgcagcagcgagaggaggaggaccaggcctgaggccgagggccgggcccgggcccagctgcccggccaccagatcggggccaggagagctgggggcccccgggccggcctggagatgtcctggccccggcggctgctgctgcgctacctgtttcctgccctgctgctgcacggcctgggggagggcagcgccctgctgcacccagacagccgcagccaccccaggagcctggagaagagcgcctggagggccttcaaggagagccagtgccaccacatgctgaagcacctgcacaacggggcccgcatcaccgtgcagatgccacccaccatcgagggccactgggtgtccacaggctgtgaggtgcgcagcggccctgagttcatcaccaggagctaccgcttctaccacaacaacaccttcaaggcctaccagttctactacggcagcaaccgctgcaccaaccccacctacaccctcatcatccggggcaagatccggctgcggcaggcctcctggatcatccggggcggcacagaggccgactaccagctgcacaacgtgcaggtgatctgccacacagaagctgtggccgagaagctgggccagcaggtgaacagaacctgccccggcttcctggctgatggcggcccctgggtgcaggatgtggcctatgacctgtggagggaggagaatggctgtgagtgcaccaaggctgtgaactttgccatgcatgagctgcagctgatccgggtggagaagcagtacctgcaccacaacctggaccacctggtggaggagctgttcctgggggacatccacacagatgccacccagaggatgttctaccggcccagcagctaccagccccccctgcagaatgccaagaaccacgaccacgcctgcatcgcctgccgcatcatctacagaagtgatgagcaccacccccccatcctgccccccaaggctgacctgaccatcggcctgcatggagagtgggtgtcccagagatgtgaggtgcggcctgaggtgctcttcctgaccaggcacttcatcttccatgacaacaacaacacctgggagggccactactaccactacagcgaccctgtgtgcaagcaccccaccttcagcatctatgcccggggccgctacagcagaggagtgctgagcagccgggtgatgggcggcacagaatttgtgttcaaggtgaaccacatgaaggtgacccccatggatgctgccacagccagcctgctgaatgtgttcaatggaaatgaatgtggggctgagggctcctggcaggtgggcatccagcaggatgtgacccacaccaacggctgtgtggccctgggcatcaagctgccccacacagaatatgagatcttcaagatggagcaggatgcccggggccgctacctgctcttcaacggccagaggcccagtgatggcagcagcccagacaggcctgagaagagggccaccagctaccagatgcccctggtgcagtgtgccagcagcagccccagggctgaggacctggctgaagattctggcagcagcctgtatggccgggcccctggccgccacacctggagcctgctgctggccgccctggcctgcctggtgcccctgctgcactggaacatcagaagatag

SEQ ID NO: 142807 - DNA, 981 bp, Artificial Sequence
  Description of Artificial Sequence: Synthetic coding sequence
atgccacccagcatcagcgccttccaggccgcctacatcggcatcgaggtgctgattgccctggtgtctgtgcctggaaatgtgctggtgatctgggccgtgaaggtgaaccaggccctgagagatgccaccttctgcttcatcgtgtccctggccgtggctgatgtggccgtgggcgccctggtgatccccctggccatcctgatcaacatcggcccccagacctacttccacacctgcctgatggtggcctgccctgtgctgatcctgacccagagcagcatcctggccctgctggccatcgctgtggaccgctacctgcgggtgaagatccccctgcgctacaagatggtggtgaccccccggcgggctgctgtggccatcgccggctgctggatcctgagctttgtggtgggcctgacccccatgtttggctggaacaacctgtctgctgtggagcgggcctgggccgccaacggctccatgggagagcctgtgatcaagtgtgaatttgagaaggtgatctccatggagtacatggtgtacttcaacttctttgtgtgggtgctgccccccctgctgctgatggtgctgatctacctggaggtgttctacctgatcaggaagcagctgaacaagaaggtgtctgccagcagcggggacccccagaagtactacggcaaggagctgaagatcgccaagagcctggccctgatcctcttcctgtttgccctgtcctggctgcccctgcacatcctgaactgcatcaccctcttctgccccagctgccacaagcccagcatcctgacctacatcgccatcttcctgacccacggcaacagcgccatgaaccccatcgtgtatgccttccgcatccagaagttccgggtgaccttcctgaagatctggaatgaccacttccgctgccagcctgccccacccattgatgaggacctgcctgaggagaggccagatgactag

SEQ ID NO: 142808 - DNA, 981 bp, Artificial Sequence; identical to SEQ ID NO: 142807
  Description of Artificial Sequence: Synthetic coding sequence

SEQ ID NO: 142809 - DNA, 378 bp, Artificial Sequence
  Description of Artificial Sequence: Synthetic coding sequence
atgccacccagcatcagcgccttccaggccgcctacatcggcatcgaggtgctgattgccctggtgtctgtgcctggaaatgtgctggtgatctgggccgtgaaggtgaaccaggccctgagagatgccaccttctgcttcatcgtgtccctggccgtggctgatgtggccgtgggcgccctggtgatccccctggccatcctgatcaacatcggcccccagacctacttccacacctgcctgatggtggcctgccctgtgctgatcctgacccagagcagcatcctggccctgctggccatcgctgtggaccgctacctgcgggtgaagatccccctgcggcgcatcagccagtgcatggccagcaccaagagctag

SEQ ID NO: 142810 - DNA, 981 bp, Artificial Sequence; identical to SEQ ID NO: 142807
  Description of Artificial Sequence: Synthetic coding sequence

SEQ ID NO: 142811 - DNA, 1239 bp, Artificial Sequence
  Description of Artificial Sequence: Synthetic coding sequence
atgcccatcatgggcagctctgtgtacatcaccgtggagctggccatcgctgtgctggccatcctgggcaatgtgctggtgtgctgggccgtgtggctgaacagcaacctgcagaatgtgaccaactactttgtggtgtccctggccgctgctgacattgctgtgggcgtgctggccatcccctttgccatcaccatcagcacaggcttctgtgccgcctgccacggctgcctcttcatcgcctgctttgtgctggtgctgacccagagcagcatcttcagcctgctggccatcgccatcgaccgctacatcgccatccgcatccccctgcgctacaacggcctggtgacaggcacccgggccaagggcatcatcgccatctgctgggtgctgagctttgccatcggcctgacccccatgctgggctggaacaactgtggccagcccaaggagggcaagaaccacagccagggctgtggggagggccaggtggcctgcctgtttgaagatgtggtgcccatgaactacatggtgtacttcaacttctttgcctgtgtgctggtgcccctgctgctgatgctgggcgtgtacctgcgcatcttcctggccgcccggcggcagctgaagcagatggagagccagcccctgcctggagagcgggcccggagcaccctgcagaaggaggtgcatgctgccaagagcctggccatcatcgtgggcctgtttgccctgtgctggctgcccctgcacatcatcaactgcttcaccttcttctgcccagactgcagccacgcccccctgtggctgatgtacctggccatcgtgctgagccacaccaacagcgtggtgaaccccttcatctatgcctaccgcatccgggagttccggcagaccttcaggaagatcatccgcagccacgtgctgcggcagcaggagcccttcaaggctgctggcaccagcgcccgggtgctggccgcccacggcagtgatggagagcaggtgtccctgcggctgaatggccaccccccaggagtgtgggccaacggcagcgccccccaccctgagcggcggcccaacggctacgccctgggcctggtgtctgggggcagcgcccaggagagccagggcaacacaggcctgcctgatgtggagctgctgagccatgagctgaagggcgtgtgcccagagcccccaggcctggatgaccccctggcccaggatggagctggggtgtcctag

SEQ ID NO: 142812 - DNA, 1239 bp, Artificial Sequence; identical to SEQ ID NO: 142811
  Description of Artificial Sequence: Synthetic coding sequence

SEQ ID NO: 142813 - DNA, 267 bp, Artificial Sequence
  Description of Artificial Sequence: Synthetic coding sequence
atgcccatcatgggcagctctgtgtacatcaccgtggagctggccatcgctgtgctggccatcctgggcaatgtgctggtgtgctgggccgtgtggctgaacagcaacctgcagaatgtgaccaactactttgtggtgtccctggccgctgctgacattgctgtgggcgtgctggccatcccctttgccatcaccatcagcacaggcttctgtgccgcctgccacggctgcctcttcatcgcctgctttgtgctggtgctgacctag

SEQ ID NO: 142814 - DNA, 195 bp, Artificial Sequence
  Description of Artificial Sequence: Synthetic coding sequence
atgcccatcatgggcagctctgtgtacatcaccgtggagctggccatcgctgtgctggccatcctgggcaatgtgctggtgtgctgggccgtgtggctgaacagcaacctgcagaatgtgaccaactactttgtggtgtccctggccgctgctgacattgctgtgggcgtgctggccatcccctttgccatctag

SEQ ID NO: 142815 - DNA, 231 bp, Artificial Sequence
  Description of Artificial Sequence: Synthetic coding sequence
atgcccatcatgggcagctctgtgtacatcaccgtggagctggccatcgctgtgctggccatcctgggcaatgtgctggtgtgctgggccgtgtggctgaacagcaacctgcagaatgtgaccaactactttgtggtgtccctggccgctgctgacattgctgtgggcgtgctggccatcccctttgccatcaccatcagcacaggcttctgtgccgcctgccacggctag

SEQ ID NO: 142816 - DNA, 1098 bp, Artificial Sequence
  Description of Artificial Sequence: Synthetic coding sequence
atgcccatcatgggcagctctgtgtacatcaccgtggagctggccatcgctgtgctggccatcctgggcaatgtgctggtgtgctgggccgtgtggctgaacagcaacctgcagaatgtgaccaactactttgtggtgtccctggccgctgctgacattgctgtgggcgtgctggccatcccctttgccatcaccatcagcacaggcttctgtgccgcctgccacggctgcctcttcatcgcctgctttgtgctggtgctgacccagagcagcatcttcagcctgctggccatcgccatcgaccgctacatcgccatccgcatccccctgcgctacaacggcctggtgacaggcacccgggccaagggcatcatcgccatctgctgggtgctgagctttgccatcggcctgacccccatgctgggctggaacaactgtggccagcccaaggagggcaagaaccacagccagggctgtggggagggccaggtggcctgcctgtttgaagatgtggtgcccatgaactacatggtgtacttcaacttctttgcctgtgtgctggtgcccctgctgctgatgctgggcgtgtacctgcgcatcttcctggccgcccggcggcagctgaagcagatggagagccagcccctgcctggagagcgggcccggagcaccctgcagaaggaggtgcatgctgccaagagcctggccatcatcgtgggcctgtttgccctgtgctggctgcccctgcacatcatcaactgcttcaccttcttctgcccagactgcagccacgcccccctgtggctgatgtacctggccatcgtgctgagccacaccaacagcgtggtgaaccccttcatctatgcctaccgcatccgggagttccggcagaccttcaggaagatcatccgcagccacgtgctgcggcagcaggagcccttcaaggctgctggcaccagcgcccgggtgctggccgcccacggcagtgatggagagcaggtgtccctgcggctgaatggccaccccccaggagtgtgggccaacggcagcgccccccaccctgagcggcggcccaacggctacgccctgggcctgtag

SEQ ID NO: 142817 - DNA, 1239 bp, Artificial Sequence; identical to SEQ ID NO: 142811
  Description of Artificial Sequence: Synthetic coding sequence

SEQ ID NO: 142818 - DNA, 999 bp, Artificial Sequence
  Description of Artificial Sequence: Synthetic coding sequence
atgctgctggagacccaggatgccctgtatgtggccctggagctggtgattgctgccctgtctgtggccggaaatgtgctggtgtgtgccgctgtgggcacagccaacaccctgcagacccccaccaactacttcctggtgtccctggccgctgctgatgtggccgtgggcctgtttgccatcccctttgccatcaccatcagcctgggcttctgcacagacttctacggctgcctcttcctggcctgctttgtgctggtgctgacccagagcagcatcttcagcctgctggccgtggccgtggaccgctacctggccatctgtgtgcccctgcgctacaagagcctggtgacaggcacccgggcccggggcgtgattgctgtgctgtgggtgctggccttcggcatcggcctgacccccttcctgggctggaacagcaaggacagcgccaccaacaactgcacagagccctgggatggcaccaccaatgaaagctgctgcctggtgaagtgcctgtttgaaaatgtggtgcccatgagctacatggtgtacttcaacttcttcggctgtgtgctgccccccctgctgatcatgctggtgatctacatcaagatcttcctggtggcctgccggcagctgcagaggacagagctgatggaccacagcaggaccaccctgcagcgggagatccacgccgccaagagcctggccatgattgtgggcatctttgccctgtgctggctgcctgtgcatgctgtgaactgtgtgaccctcttccagcctgcccagggcaagaacaagcccaagtgggccatgaacatggccatcctgctgagccacgccaacagcgtggtgaaccccatcgtgtatgcctacagaaacagagacttccgctacaccttccacaagatcatcagccgctacctgctgtgccaggctgatgtgaagtctggaaatggccaggccggcgtgcagcctgccctgggcgtgggcctgtag

SEQ ID NO: 142819 - DNA, 957 bp, Artificial Sequence
  Description of Artificial Sequence: Synthetic coding sequence
atgcccaacaacagcacagccctgagcctggccaacgtgacctacatcaccatggagatcttcatcggcctgtgtgccatcgtgggcaatgtgctggtgatctgtgtggtgaagctgaaccccagcctgcagaccaccaccttctacttcatcgtgtccctggccctggccgacattgctgtgggcgtgctggtgatgcccctggccatcgtggtgtccctgggcatcaccatccacttctacagctgcctcttcatgacctgcctgctgctgatcttcacccacgccagcatcatgagcctgctggccatcgctgtggaccgctacctgcgggtgaagctgactgtgcgctacaagagggtgaccacccaccggcgcatctggctggccctgggcctgtgctggctggtgtccttcctggtgggcctgacccccatgtttggctggaacatgaagctgaccagcgagtaccacagaaatgtgaccttcctgagctgccagtttgtgtctgtgatgaggatggactacatggtgtacttctccttcctgacctggatcttcatccccctggtggtgatgtgtgccatctacctggacatcttctacatcatccggaacaagctgagcctgaacctgagcaacagcaaggagaccggggccttctacggccgggagttcaagacagccaagagcctcttcctggtgctcttcctgtttgccctgtcctggctgcccctgagcatcatcaactgcatcatctacttcaacggggaggtgccccagctggtgctgtacatgggcatcctgctgagccacgccaacagcatgatgaaccccatcgtgtatgcctacaagatcaagaagttcaaggagacctacctgctgatcctgaaggcctgtgtggtgtgccaccccagcgacagcctggacaccagcattgagaagaacagcgagtag

SEQ ID NO: 142820 - DNA, 537 bp, Artificial Sequence
  Description of Artificial Sequence: Synthetic coding sequence
atggagggcagccctgctggccccatcgagcagaaggaggcccgctgggagagctcctgggaggagcagcctgactggaccctgggctgcctgagccctgagagccacaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcaccggcctgggcatcatcagcgtcatcagccacctgaccaagagaagaagaagccagaggaacagaagagtgggcaacaccctgaagcccttcagccgggtgctgacccccaaggagatggcccccacagagcagatgtag

SEQ ID NO: 142821 - DNA, 1044 bp, Artificial Sequence
  Description of Artificial Sequence: Synthetic coding sequence
atgcccaacaacagcacagccctgagcctggccaacgtgacctacatcaccatggagatcttcatcggcctgtgtgccatcgtgggcaatgtgctggtgatctgtgtggtgaagctgaaccccagcctgcagaccaccaccttctacttcatcgtgtccctggccctggccgacattgctgtgggcgtgctggtgatgcccctggccatcgtggtgtccctgggcatcaccatccacttctacagctgcctcttcatgacctgcctgctgctgatcttcacccacgccagcatcatgagcctgctggccatcgctgtggaccgctacctgcgggtgaagctgactgtgcgcttccgcatccctggcctgcccggctgcatcctgtccttccagctgaaggtgtgcttcctgcctgtgatgtggctgttcatcctgctgagcctggccctgatcagtgatgccatggtgatggatgagaaggtgaagaggagctttgtgctggacacagccagcgccatctgcaactacaatgcccactacaagaaccaccccaagtactggtgccggggctacttccgggactactgcaacatcatcgccttcagccccaacagcaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcaccggcctgggcatcatcagcgtcatcagccacctgaccaagagaagaagaagccagaggaacagaagagtgggcaacaccctgaagcccttcagccgggtgctgacccccaaggagatggcccccacagagcagatgtag

SEQ ID NO: 142822 - DNA, 801 bp, Artificial Sequence
  Description of Artificial Sequence: Synthetic coding sequence
atggagggcagccctgctggccccatcgagcagaaggaggcccgctgggagagctcctgggaggagcagcctgactggaccctgggctgcctgagccctgagagccagttccgcatccctggcctgcccggctgcatcctgtccttccagctgaaggtgtgcttcctgcctgtgatgtggctgttcatcctgctgagcctggccctgatcagtgatgccatggtgatggatgagaaggtgaagaggagctttgtgctggacacagccagcgccatctgcaactacaatgcccactacaagaaccaccccaagtactggtgccggggctacttccgggactactgcaacatcatcgccttcagccccaacagcaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcaccggcctgggcatcatcagcgtcatcagccacctgaccaagagaagaagaagccagaggaacagaagagtgggcaacaccctgaagcccttcagccgggtgctgacccccaaggagatggcccccacagagcagatgtag

SEQ ID NO: 142823 - DNA, 624 bp, Artificial Sequence
  Description of Artificial Sequence: Synthetic coding sequence
tgaccccaggccctgcagggcccccccagcagcaatgatgccatggtgatggatgagaaggtgaagaggagctttgtgctggacacagccagcgccatctgcaactacaatgcccactacaagaaccaccccaagtactggtgccggggctacttccgggactactgcaacatcatcgccttcagccccaacagcaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcaccggcctgggcatcatcagcgtcatcagccacctgaccaagagaagaagaagccagaggaacagaagagtgggcaacaccctgaagcccttcagccgggtgctgacccccaaggagatggcccccacagagcagatgtag

SEQ ID NO: 142824 - DNA, 348 bp, Artificial Sequence
  Description of Artificial Sequence: Synthetic coding sequence
tgacccagcagccacgtggccctgcacagcaccctgctgggcagccacttcagcaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcacctag

SEQ ID NO: 142825 - DNA, 519 bp, Artificial Sequence
  Description of Artificial Sequence: Synthetic coding sequence
ggccccatcgagcagaaggaggcccgctgggagagctcctgggaggagcagcctgactggaccctgggctgcctgagccctgagagccacaccaaccacgtggccctgcgggacaccggcaaccagctgattgtgaccatgagctgcctgaccaaggaggacaccggctggtactggtgtggcatccagagggactttgccagagatgacatggacttcacagagctgattgtgacagatgacaagggcaccctggccaatgacttctggagcggcaaggacctgagcggcaacaagaccaggagctgcaaggcccccaaggtggtgaggaaggctgacaggagcaggaccagcatcctgatcatctgcatcctgatcaccggcctgggcatcatcagcgtcatcagccacctgaccaagagaagaagaagccagaggaacagaagagtgggcaacaccctgaagcccttcagccgggtgctgacccccaaggagatggcccccacagagcagatgtag

SEQ ID NO: 142826 - DNA, 1092 bp, Artificial Sequence
  Description of Artificial Sequence: Synthetic coding sequence
atggcccagaccccagcctttgacaagcccaaggtggagctgcacgtgcacctggatggcagcatcaagccagagaccatcctgtactacggcagaagaagaggcatcgccctgcctgccaacacagctgagggcctgctgaatgtcatcggcatggacaagcccctgaccctgcctgacttcctggccaagtttgactactacatgcctgccatcgccggctgccgggaggccatcaagagaattgcctatgaatttgtggagatgaaggccaaggagggcgtggtgtatgtggaggtgcgctacagcccccacctgctggccaacagcaaggtggagcccatcccctggaaccaggccgagggggacctgaccccagatgaggtggtggccctggtgggccagggcctgcaggagggggagcgggactttggagtgaaggcccggagcatcctgtgctgcatgaggcaccagcccaactggagccccaaggtggtggagctgtgcaagaagtaccagcagcagacagtggtggccatcgacctggccggagatgagaccatccctggcagcagcctgctgcccggccacgtgcaggcctaccaggaggccgtgaagagcggcatccacaggacagtgcatgctggggaggtgggcagcgctgaggtggtgaaggaggccgtggacatcctgaagacagagcggctgggccacggctaccacaccctggaggaccaggccctgtacaaccggctgcggcaggagaacatgcactttgagatctgcccctggagcagctacctgactggagcctggaagccagacacagagcacgctgtgatccggctgaagaatgaccaggccaactacagcctgaacacagatgaccccctcatcttcaagagcaccctggacacagactaccagatgaccaagagggacatgggcttcacagaggaggagttcaagaggctgaacatcaatgctgccaagagcagcttcctgcctgaagatgagaagcgggagctgctggacctgctgtacaaggcctacggcatgccacccagcgccagcgctggccagaacctgtag

SEQ ID NO: 142827 - DNA, 1731 bp, Artificial Sequence
  Description of Artificial Sequence: Synthetic coding sequence
atggccagcaacaaccactggttccagagcagccaggtgcccagctttgcccagatgctgaagaagaacctgcctgtgcagcctgccaccaagaccatcaccacccccaccggctggagcagcgagagctatggcctgagcaagatggccagcaaggtgacccaggtgactggaaacttccctgagcccctgctgagcaagaacctgagcagcatcagcaaccctgtgctgccccccaagaagatccccaaggagttcatcatgaagtacaagagaggagagatcaaccctgtgtctgccctgcaccagtttgcccagatgcagagggtgcagctggacctgaaggagaccgtgaccactggaaatgtgatgggcccctactttgccttctgtgctgtggtggatggcatccagtacaagacaggcctgggccagaacaagaaggagagccgcagcaatgctgccaagctggccctggatgagctgctgcagctggatgagcctgagccccgcatcctggagaccagcggccccccacccttccctgctgagcctgtggtgctgtctgagctggcctacgtgtccaaggtgcactatgagggccgccacatccagtatgccaagatcagccagatcgtgaaggagcgcttcaaccagctgatcagcaacagaagtgagtacctgaagtacagcagcagcctggccgccttcatcatcgagcgggccggccagcacgaggtggtggccatcggcaccggggagtacaactacagccaggacatcaagccagatggccgggtgctgcatgacacccatgctgtggtgacagcccggcgcagcctgctgcgctacttctaccggcagctgctgctcttctacagcaagaacccagccatgatggagaagagcatcttctgcacagagcccaccagcaacctgctgaccctgaagcagaacatcaacatctgcctgtacatgaaccagctgcccaagggcagcgcccagatcaagagccagctgcggctgaacccccacagcatcagcgcctttgaggccaatgaggagctgtgcctgcacgtggccgtggagggcaagatctacctgactgtgtactgccccaaggatggagtgaaccgcatcagctccatgagcagcagtgacaagctgacccgctgggaggtgctgggcgtgcagggcgccctgctgagccacttcatccagcctgtgtacatcagcagcatcctgattggagatggcaactgcagcgacacccggggcctggagatcgccatcaagcagagggtggatgatgccctgaccagcaagctgcccatgttctacctggtgaaccggccccacatcagcctggtgcccagcgcctaccccctgcagatgaacctggagtacaagttcctgagcctgaactgggcccagggagatgtgtccctggagatcgtggatggcctgagcggcaagatcacagagagcagccccttcaagagcggcatgtccatggccagccggctgtgcaaggccgccatgctgagccgcttcaacctgctggccaaggaggccaagaaggagctgctggaggccggcacctaccacgccgccaagtgcatgtctgccagctaccaggaggccaagtgcaagctgaagagctacctgcagcagcacggctacggctcctggatcgtgaagagcccctgcatcgagcagttcaacatgtag

SEQ ID NO: 142828 - DNA, 1698 bp, Artificial Sequence
  Description of Artificial Sequence: Synthetic coding sequence
atggccagcaacaaccactggttccagagcagccaggtgcccagctttgcccagatgctgaagaagaacctgcctgtgcagcctgccaccaagaccatcaccacccccaccggctggagcagcgagagctatggcctgagcaagatggccagcaaggtgacccaggtgactggaaacttccctgagcccctgctgagcaagaacctgagcagcatcagcaaccctgtgctgccccccaagaagatccccaaggagttcatcatgaagtacaagagaggagagatcaaccctgtgtctgccctgcaccagtttgcccagatgcagagggtgcagctggacctgaaggagaccgtgaccactggaaatgtgatgggcccctactttgccttctgtgctgtggtggatggcatccagtacaagacaggcctgggccagaacaagaaggagagccgcagcaatgctgccaagctggccctggatgagctgctgcagctggatgagcctgagccccgcatcctggagaccagcggccccccacccttccctgctgagcctgtggtgctgtctgagctggcctacgtgtccaaggtgcactatgagggccgccacatccagtatgccaagatcagccagatcgtgaaggagcgcttcaaccagctgatcagcaacagaagtgagtacctgaagtacagcagcagcctggccgccttcatcatcgagcgggccggccagcacgaggtggtggccatcggcaccggggagtacaactacagccaggacatcaagccagatggccgggtgctgcatgacacccatgctgtggtgacagcccggcgcagcctgctgagcaagaacccagccatgatggagaagagcatcttctgcacagagcccaccagcaacctgctgaccctgaagcagaacatcaacatctgcctgtacatgaaccagctgcccaagggcagcgcccagatcaagagccagctgcggctgaacccccacagcatcagcgcctttgaggccaatgaggagctgtgcctgcacgtggccgtggagggcaagatctacctgactgtgtactgccccaaggatggagtgaaccgcatcagctccatgagcagcagtgacaagctgacccgctgggaggtgctgggcgtgcagggcgccctgctgagccacttcatccagcctgtgtacatcagcagcatcctgattggagatggcaactgcagcgacacccggggcctggagatcgccatcaagcagagggtggatgatgccctgaccagcaagctgcccatgttctacctggtgaaccggccccacatcagcctggtgcccagcgcctaccccctgcagatgaacctggagtacaagttcctgagcctgaactgggcccagggagatgtgtccctggagatcgtggatggcctgagcggcaagatcacagagagcagccccttcaagagcggcatgtccatggccagccggctgtgcaaggccgccatgctgagccgcttcaacctgctggccaaggaggccaagaaggagctgctggaggccggcacctaccacgccgccaagtgcatgtctgccagctaccaggaggccaagtgcaagctgaagagctacctgcagcagcacggctacggctcctggatcgtgaagagcccctgcatcgagcagttcaacatgtag

SEQ ID NO: 142829 - DNA, 726 bp, Artificial Sequence
  Description of Artificial Sequence: Synthetic coding sequence
atggccagcaacaaccactggttccagagcagccaggtgcccagctttgcccagatgctgaagaagaacctgcctgtgcagcctgccaccaagaccatcaccacccccaccggctggagcagcgagagctatggcctgagcaagatggccagcaaggtgacccaggtgactggaaacttccctgagcccctgctgagcaagaacctgagcagcatcagcaaccctgtgctgccccccaagaagatccccaaggagttcatcatgaagtacaagagaggagagatcaaccctgtgtctgccctgcaccagtttgcccagatgcagagggtgcagctggacctgaaggagaccgtgaccactggaaatgtgatgggcccctactttgccttctgtgctgtggtggatggcatccagtacaagacaggcctgggccagaacaagaaggagagccgcagcaatgctgccaagctggccctggatgagctgctgcagctggatgagcctgagccccgcatcctggagaccagcggccccccacccttccctgctgagcctgtggtgctgtctgagctggcctacgtgtccaaggtgcactatgagggccgccacatccagtatgccaagatcagccagatcgtgaaggagcgcttcaaccagctgatcagcaacagaagtgagtacctgaagtacagcagcagcctggccgccttcatcattgaaagatag

SEQ ID NO: 142830 - DNA, 471 bp, Artificial Sequence
  Description of Artificial Sequence: Synthetic coding sequence
atggccagcaacaaccactggttccagagcagccaggtgcccagctttgcccagatgctgaagaagaacctgcctgtgcagcctgccaccaagaccatcaccacccccaccggctggagcagcgagagctatggcctgagcaagatggccagcaaggtgacccaggtgactggaaacttccctgagcccctgctgagcaagaacctgagcagcatcagcaaccctgtgctgccccccaagaagatccccaaggagttcatcatgaagtacaagagaggagagatcaaccctgtgtctgccctgcaccagtttgcccagatgcagagggtgcagctggacctgaaggagaccgtgaccactggaaatgtgatgggcccctactttgccttctgtgctgtggtggatggcatccagtacaagacaggcctgggccagaacaagaaggagagccgcagcaatgctgccaagtag

SEQ ID NO: 142831 - DNA, 1677 bp, Artificial Sequence
  Description of Artificial Sequence: Synthetic coding sequence
atgctgaagaagaacctgcctgtgcagcctgccaccaagaccatcaccacccccaccggctggagcagcgagagctatggcctgagcaagatggccagcaaggtgacccaggtgactggaaacttccctgagcccctgctgagcaagaacctgagcagcatcagcaaccctgtgctgccccccaagaagatccccaaggagttcatcatgaagtacaagagaggagagatcaaccctgtgtctgccctgcaccagtttgcccagatgcagagggtgcagctggacctgaaggagaccgtgaccactggaaatgtgatgggcccctactttgccttctgtgctgtggtggatggcatccagtacaagacaggcctgggccagaacaagaaggagagccgcagcaatgctgccaagctggccctggatgagctgctgcagctggatgagcctgagccccgcatcctggagaccagcggccccccacccttccctgctgagcctgtggtgctgtctgagctggcctacgtgtccaaggtgcactatgagggccgccacatccagtatgccaagatcagccagatcgtgaaggagcgcttcaaccagctgatcagcaacagaagtgagtacctgaagtacagcagcagcctggccgccttcatcatcgagcgggccggccagcacgaggtggtggccatcggcaccggggagtacaactacagccaggacatcaagccagatggccgggtgctgcatgacacccatgctgtggtgacagcccggcgcagcctgctgcgctacttctaccggcagctgctgctcttctacagcaagaacccagccatgatggagaagagcatcttctgcacagagcccaccagcaacctgctgaccctgaagcagaacatcaacatctgcctgtacatgaaccagctgcccaagggcagcgcccagatcaagagccagctgcggctgaacccccacagcatcagcgcctttgaggccaatgaggagctgtgcctgcacgtggccgtggagggcaagatctacctgactgtgtactgccccaaggatggagtgaaccgcatcagctccatgagcagcagtgacaagctgacccgctgggaggtgctgggcgtgcagggcgccctgctgagccacttcatccagcctgtgtacatcagcagcatcctgattggagatggcaactgcagcgacacccggggcctggagatcgccatcaagcagagggtggatgatgccctgaccagcaagctgcccatgttctacctggtgaaccggccccacatcagcctggtgcccagcgcctaccccctgcagatgaacctggagtacaagttcctgagcctgaactgggcccagggagatgtgtccctggagatcgtggatggcctgagcggcaagatcacagagagcagccccttcaagagcggcatgtccatggccagccggctgtgcaaggccgccatgctgagccgcttcaacctgctggccaaggaggccaagaaggagctgctggaggccggcacctaccacgccgccaagtgcatgtctgccagctaccaggaggccaagtgcaagctgaagagctacctgcagcagcacggctacggctcctggatcgtgaagagcccctgcatcgagcagttcaacatgtag

SEQ ID NO: 142832 - DNA, 3810 bp, Artificial Sequence
  Description of Artificial Sequence: Synthetic coding sequence
atgatgagccccatctgtgaccagaccatcgacagccggctgaaggtggagaaggccacctggtggggccgggtgggcggcggcagccggccccactggcagagccctggggtgcggccctgcccagaggaggtgcaggaccccggctacagcctgagcggctactacacccaccccttccagggctatgagcaccggcagctgcgctaccagcagcccggccctggcagcagccccagcagcttcctgctgaagcagatcgagttcctgaagggccagctgcctgaggcccctgtgattggcaagcagacccccagcctgccccccagcctgcccggcctgcggccccgcttccctgtgctgctggccagcagcacccggggccggcaggtggacatccggggcgtgccccggggcgtgcacctgcggagccagggcctgcagaggggcttccagcaccccagcccccggggccgcagcctgccccagaggggcgtggactgcctgagcagccacttccaggagctgagcatctaccaggaccaggagcagaggatcctgaagttcctggaggagctgggggagggcaaggccaccacagcccatgacctgagcggcaagctgggcacccccaagaaggagatcaacagagtgctgtacagcctggccaagaagggcaagctgcagaaggaggccggcaccccacccctgtggaagattgctgtgtccacccaggcctggaaccagcacagcggcgtggtgcggccagatggccacagccagggcgcccccaacagcgaccccagcctggagccagaagatagaaacagcacctctgtgtctgaggacctgctggagcccttcatcgctgtgtctgcccaggcctggaaccagcacagcggcgtggtgcggccagacagccacagccagggcagccccaacagcgaccccggcctggagcctgaggacagcaacagcaccagcgccctggaggaccccctggagttcctggacatggccgagatcaaggagaagatctgtgactacctgttcaacgtgtctgacagcagcgccctgaacctggccaagaacatcggcctgaccaaggcccgggacatcaatgctgtgctgattgacatggagcggcagggagatgtgtaccggcagggcaccaccccacccatctggcacctgacagacaagaagcgggagaggatgcagatcaagaggaacaccaacagcgtgcctgagacagccccagctgccatccctgagaccaagagaaatgctgagttcctgacctgcaacatccccaccagcaatgccagcaacaacatggtgaccacagagaaggtggagaatggccaggagcccgtcatcaagctggagaaccggcaggaggcccggcctgagcccgcccggctgaagccccctgtgcactacaacggccccagcaaggccggctacgtggactttgaaaatggccagtgggccacagatgacatcccagatgacctgaacagcatccgggccgcccctggagagttccgggccatcatggagatgcccagcttctacagccacggcctgccccgctgcagcccctacaagaagctgacagagtgccagctgaagaaccccatcagcggcctgctggagtatgcccagtttgccagccagacctgtgagttcaacatgattgagcagagcggcccccctcatgagccccgcttcaagttccaggtggtgatcaatggccgggagttccccccagctgaggccggcagcaagaaggtggccaagcaggatgctgccatgaaggccatgaccatcctgctggaggaggccaaggccaaggacagcggcaagtctgaggagagcagccactacagcacagagaaggagagcgagaagacagctgagagccagacccccacccccagcgccaccagcttcttcagcggcaagagccctgtgaccaccctgctggagtgcatgcacaagctgggcaacagctgtgagttccggctgctgagcaaggagggccctgcccacgagcccaagttccagtactgtgtggccgtgggcgcccagaccttccccagcgtgtctgcccccagcaagaaggtggccaagcagatggctgctgaggaggccatgaaggccctgcacggggaggccaccaacagcatggccagtgacaaccagcctgagggcatgatcagcgagagcctggacaacctggagagcatgatgcccaacaaggtgaggaagattggagagctggtgcgctacctgaacaccaaccctgtgggcggcctgctggagtatgcccggagccacggctttgctgctgagttcaagctggtggaccagagcggcccccctcatgagcccaagtttgtgtaccaggccaaggtgggcggccgctggttccctgctgtgtgtgcccacagcaagaagcagggcaagcaggaggccgcagatgctgccctgcgggtgctgattggagaaaatgagaaggccgagaggatgggcttcacagaggtgacccctgtgactggagccagcctgcggaggaccatgctgctgctgagccgcagccctgaggcccagcccaagaccctgcccctgaccggcagcaccttccatgaccagatcgccatgctgagccaccgctgcttcaacaccctgaccaacagcttccagcccagcctgctgggcaggaagatcctggccgccatcatcatgaagaaggacagcgaggacatgggcgtggtggtgtccctgggcaccggcaacagatgtgtgaagggggacagcctgagcctgaagggggagaccgtgaatgactgccacgccgagatcatcagcagaagaggcttcatccgcttcctgtacagcgagctgatgaagtacaacagccagacagccaaggacagcatctttgagcccgccaagggcggggagaagctgcagatcaagaagacagtgtccttccacctgtacatcagcacagccccctgtggagatggagccctgtttgacaagagctgcagcgaccgggccatggagagcacagagagccgccactaccctgtgtttgagaaccccaagcagggcaagctgcggaccaaggtggagaatggagagggcaccatccctgtggagagcagtgacatcgtgcccacctgggatggcatccggctgggggagcggctgcggaccatgagctgcagcgacaagatcctgcgctggaatgtgctgggcctgcagggcgccctgctgacccacttcctgcagcccatctacctgaagtctgtgaccctgggctacctgttcagccagggccacctgacccgggccatctgctgccgggtgaccagagatggcagcgcctttgaagatggcctgcggcaccccttcatcgtgaaccaccccaaggtgggccgggtgtccatctatgacagcaagaggcagagcggcaagaccaaggagacctctgtgaactggtgcctggctgatggctatgacctggagatcctggatggcacccggggcaccgtggatggccccagaaatgagctgagccgggtgtccaagaagaacatcttcctgctcttcaagaagctgtgcagcttccgctacagaagagacctgctgcggctgtcctatggagaggccaagaaggccgcccgggactatgaaacagccaagaactacttcaagaagggcctgaaggacatgggctacggcaactggatcagcaagccccaggaggagaagaacttctacctgtgccctgtgtag

SEQ ID NO: 142833 - DNA, 159 bp, Artificial Sequence
  Description of Artificial Sequence: Synthetic coding sequence
atggccaatgagcacaccctcatccacccagccagcattgaggaccccctggaggcccggcccatgtctgatgaagatcctgaagatgaagatgccctgcctgcccgctggaagaaggagatgggcaggaagaggaagaggaccatcgccaccctgtag

SEQ ID NO: 142834 - DNA, 2106 bp, Artificial Sequence
  Description of Artificial Sequence: Synthetic coding sequence
atggacattgaagatgaggagaacatgagcagcagcagcacagatgtgaaggagaacagaaacctggacaacgtgagccccaaggatggcagcaccccaggccctggagagggcagccagctgagcaatggaggcggcggcggccctggcaggaagaggcccctggaggagggcagcaatggccacagcaagtaccgcctgaagaagaggaggaagaccccaggccctgtgctgcccaagaatgccctgatgcagctgaatgagatcaagccaggcctgcagtacaccctgctgagccagacaggccctgtgcacgcccccctgtttgtgatgtctgtggaggtgaatggccaggtgtttgagggcagcggccccaccaagaagaaggccaagctgcacgccgctgagaaggccctgcggagctttgtgcagttccccaatgccagcgaggcccacctggccatgggccgcaccctgtctgtgaacacagacttcaccagtgaccaggccgacttcccagacaccctcttcaacggctttgagaccccagacaaggccgagccccccttctacgtgggcagcaatggagatgacagcttcagcagcagcggggacctgagcctgagcgccagccctgtgcctgccagcctggcccagccccccctgcctgtgctgccccccttccccccacccagcggcaagaaccctgtgatgatcctgaatgagctgcggcccggcctgaagtatgacttcctgtctgagagcggggagagccacgccaagagctttgtgatgtctgtggtggtggatggccagttctttgagggcagcggcaggaacaagaagctggccaaggcccgggccgcccagagcgccctggccgccatcttcaacctgcacctggaccagacccccagccggcagcccatccccagcgagggcctgcagctgcacctgccccaggtgctggctgatgctgtgtcccggctggtgctgggcaagtttggagacctgacagacaacttcagcagcccccacgcccggaggaaggtgctggccggcgtggtgatgaccactggaacagatgtgaaggatgccaaggtgatctctgtgtccacaggcaccaagtgcatcaatggagagtacatgtctgaccggggcctggccctgaatgactgccacgccgagatcatcagccgccgcagcctgctgcgcttcctgtacacccagctggagctgtacctgaacaacaaggatgaccagaagaggagcatcttccagaagtctgagcggggcggcttccggctgaaggaaaatgtgcagttccacctgtacatcagcaccagcccctgtggagatgcccgcatcttcagcccccatgagcccatcctggaggagcctgctgacagacaccccaacaggaaggcccggggccagctgcggaccaagattgagagcggggagggcaccatccctgtgcgcagcaatgccagcatccagacctgggatggagtgctgcagggcgagcggctgctgaccatgagctgcagcgacaagatcgcccgctggaatgtggtgggcatccagggcagcctgctgagcatctttgtggagcccatctacttcagcagcatcatcctgggcagcctgtaccacggggaccacctgagccgggccatgtaccagaggatcagcaacatcgaggacctgccccccctgtacaccctgaacaagcccctgctgagcggcatcagcaatgctgaggcccggcagcccgggaaggcccccaacttctctgtgaactggacagtgggggacagcgccattgaagtcatcaatgccaccaccgggaaggatgagctgggccgggccagccggctgtgcaagcacgccctgtactgccgctggatgagggtgcacggcaaggtgcccagccacctgctgcggagcaagatcaccaagcccaacgtgtaccacgagagcaagctggccgccaaggagtaccaggccgccaaggcccggctcttcaccgccttcatcaaggccggcctgggcgcctgggtggagaagcccacagagcaggaccagttcagcctgaccccctag

SEQ ID NO: 142835 - DNA, 2226 bp, Artificial Sequence
  Description of Artificial Sequence: Synthetic coding sequence
atggacattgaagatgaggagaacatgagcagcagcagcacagatgtgaaggagaacagaaacctggacaacgtgagccccaaggatggcagcaccccaggccctggagagggcagccagctgagcaatggaggcggcggcggccctggcaggaagaggcccctggaggagggcagcaatggccacagcaagtaccgcctgaagaagaggaggaagaccccaggccctgtgctgcccaagaatgccctgatgcagctgaatgagatcaagccaggcctgcagtacaccctgctgagccagacaggccctgtgcacgcccccctgtttgtgatgtctgtggaggtgaatggccaggtgtttgagggcagcggccccaccaagaagaaggccaagctgcacgccgctgagaaggccctgcggagctttgtgcagttccccaatgccagcgaggcccacctggccatgggccgcaccctgtctgtgaacacagacttcaccagtgaccaggccgacttcccagacaccctcttcaacggctttgagaccccagacaaggccgagccccccttctacgtgggcagcaatggagatgacagcttcagcagcagcggggacctgagcctgagcgccagccctgtgcctgccagcctggcccagccccccctgcctgtgctgccccccttccccccacccagcggcaagaaccctgtgatgatcctgaatgagctgcggcccggcctgaagtatgacttcctgtctgagagcggggagagccacgccaagagctttgtgatgtctgtggtggtggatggccagttctttgagggcagcggcaggaacaagaagctggccaaggcccgggccgcccagagcgccctggccgccatcttcaacctgcacctggaccagacccccagccggcagcccatccccagcgagggcctgcagctgcacctgccccaggtgctggctgatgctgtgtcccggctggtgctgggcaagtttggagacctgacagacaacttcagcagcccccacgcccggaggaaggtgctggccggcgtggtgatgaccactggaacagatgtgaaggatgccaaggtgatctctgtgtccacaggcaccaagtgcatcaatggagagtacatgtctgaccggggcctggccctgaatgactgccacgccgagatcatcagccgccgcagcctgctgcgcttcctgtacacccagctggagctgtacctgaacaacaaggatgaccagaagaggagcatcttccagaagtctgagcggggcggcttccggctgaaggaaaatgtgcagttccacctgtacatcagcaccagcccctgtggagatgcccgcatcttcagcccccatgagcccatcctggagggcagccgcagctacacccaggccggcgtgcagtggtgcaaccacggcagcctgcagcccaggcctcctggcctgctgagtgaccccagcaccagcaccttccagggcgccggcaccacagagcctgctgacagacaccccaacaggaaggcccggggccagctgcggaccaagattgagagcggggagggcaccatccctgtgcgcagcaatgccagcatccagacctgggatggagtgctgcagggcgagcggctgctgaccatgagctgcagcgacaagatcgcccgctggaatgtggtgggcatccagggcagcctgctgagcatctttgtggagcccatctacttcagcagcatcatcctgggcagcctgtaccacggggaccacctgagccgggccatgtaccagaggatcagcaacatcgaggacctgccccccctgtacaccctgaacaagcccctgctgagcggcatcagcaatgctgaggcccggcagcccgggaaggcccccaacttctctgtgaactggacagtgggggacagcgccattgaagtcatcaatgccaccaccgggaaggatgagctgggccgggccagccggctgtgcaagcacgccctgtactgccgctggatgagggtgcacggcaaggtgcccagccacctgctgcggagcaagatcaccaagcccaacgtgtaccacgagagcaagctggccgccaaggagtaccaggccgccaaggcccggctcttcaccgccttcatcaaggccggcctgggcgcctgggtggagaagcccacagagcaggaccagttcagcctgaccccctag

SEQ ID NO: 142836 - DNA, 2145 bp, Artificial Sequence
  Description of Artificial Sequence: Synthetic coding sequence
atggacattgaagatgaggagaacatgagcagcagcagcacagatgtgaaggagaacagaaacctggacaacgtgagccccaaggatggcagcaccccaggccctggagagggcagccagctgagcaatggaggcggcggcggccctggcaggaagaggcccctggaggagggcagcaatggccacagcaagtaccgcctgaagaagaggaggaagaccccaggccctgtgctgcccaagaatgccctgatgcagctgaatgagatcaagccaggcctgcagtacaccctgctgagccagacaggccctgtgcacgcccccctgtttgtgatgtctgtggaggtgaatggccaggtgtttgagggcagcggccccaccaagaagaaggccaagctgcacgccgctgagaaggccctgcggagctttgtgcagttccccaatgccagcgaggcccacctggccatgggccgcaccctgtctgtgaacacagacttcaccagtgaccaggccgacttcccagacaccctcttcaacggctttgagaccccagacaaggccgagccccccttctacgtgggcagcaatggagatgacagcttcagcagcagcggggacctgagcctgagcgccagccctgtgcctgccagcctggcccagccccccctgcctgtgctgccccccttccccccacccagcggcaagaaccctgtgatgatcctgaatgagctgcggcccggcctgaagtatgacttcctgtctgagagcggggagagccacgccaagagctttgtgatgtctgtggtggtggatggccagttctttgagggcagcggcaggaacaagaagctggccaaggcccgggccgcccagagcgccctggccgccatcttcaacctgcacctggaccagacccccagccggcagcccatccccagcgagggcctgcagctgcacctgccccaggtgctggctgatgctgtgtcccggctggtgctgggcaagtttggagacctgacagacaacttcagcagcccccacgcccggaggaaggtgctggccggcgtggtgatgaccactggaacagatgtgaaggatgccaaggtgatctctgtgtccacaggcaccaagtgcatcaatggagagtacatgtctgaccggggcctggccctgaatgactgccacgccgagatcatcagccgccgcagcctgctgcgcttcctgtacacccagctggagctgtacctgaacaacaaggatgaccagaagaggagcatcttccagaagtctgagcggggcggcttccggctgaaggaaaatgtgcagttccacctgtacatcagcaccagcccctgtggagatgcccgcatcttcagcccccatgagcccatcctggagggcagccgcagctacacccaggccggcgtgcagtggtgcaaccacggcagcctgcagcccaggcctcctggcctgctgagtgaccccagcaccagcaccttccagggcgccggcaccacagagcctgctgacagacaccccaacaggaaggcccggggccagctgcggaccaagattgagagcggggagggcaccatccctgtgcgcagcaatgccagcatccagacctgggatggagtgctgcagggcgagcggctgctgaccatgagctgcagcgacaagatcgcccgctggaatgtggtgggcatccagggcagcctgctgagcatctttgtggagcccatctacttcagcagcatcatcctgggcagcctgtaccacggggaccacctgagccgggccatgtaccagaggatcagcaacatcgaggacctgccccccctgtacaccctgaacaagcccctgctgagcggcatcagcaatgctgaggcccggcagcccgggaaggcccccaacttctctgtgaactggacagtgggggacagcgccattgaagtcatcaatgccaccaccgggaaggatgagctgggccgggccagccggctgtgcaagcacgccctgtactgccgctggatgagggtgcacggcaaggtgcccagccacctgctgcggagcaagatcaccaagcccaacgtgtaccacgagagcaagctggccgccaaggagtaccaggccgccaaggtgcactag

SEQ ID NO: 142837 - DNA, 39 bp, Artificial Sequence
  Description of Artificial Sequence: Synthetic coding sequence
atggacattgaagatgaggagaacatgtccttctcctag

SEQ ID NO: 142838 - DNA, 426 bp, Artificial Sequence
  Description of Artificial Sequence: Synthetic coding sequence
atggacattgaagatgaggagaacatgagcagcagcagcacagatgtgaaggagaacagaaacctggacaacgtgagccccaaggatggcagcaccccaggccctggagagggcagccagctgagcaatggaggcggcggcggccctggcaggaagaggcccctggaggagggcagcaatggccacagcaagtaccgcctgaagaagaggaggaagaccccaggccctgtgctgcccaagaatgccctgatgcagctgaatgagatcaagccaggcctgcagtacaccctgctgagccagacaggccctgtgcacgcccccctgtttgtgatgtctgtggaggtgaatggccaggtgtttgagggcagcggccccaccaagaagaaggccaagctgcacgccgctgagaaggccctgcggagctag

SEQ ID NO: 142839 - DNA, 2226 bp, Artificial Sequence; identical to SEQ ID NO: 142835
  Description of Artificial Sequence: Synthetic coding sequence

SEQ ID NO: 142840 - DNA, 2226 bp, Artificial Sequence; identical to SEQ ID NO: 142835
  Description of Artificial Sequence: Synthetic coding sequence

SEQ ID NO: 142841 - DNA, 2097 bp, Artificial Sequence
  Description of Artificial Sequence: Synthetic coding sequence
atggacattgaagatgaggagaacatgagcagcagcagcacagatgtgaaggagaacagaaacctggacaacgtgagccccaaggatggcagcaccccaggccctggagagggcagccagctgagcaatggaggcggcggcggccctggcaggaagaggcccctggaggagggcagcaatggccacagcaagtaccgcctgaagaagaggaggaagaccccaggccctgtgctgcccaagaatgccctgatgcagctgaatgagatcaagccaggcctgcagtacaccctgctgagccagacaggccctgtgcacgcccccctgtttgtgatgtctgtggaggtgaatggccaggtgtttgagggcagcggccccaccaagaagaaggccaagctgcacgccgctgagaaggccctgcggagctttgtgcagttccccaatgccagcgaggcccacctggccatgggccgcaccctgtctgtgaacacagacttcaccagtgaccaggccgacttcccagacaccctcttcaacggctttgagaccccagacaaggccgagccccccttctacgtgggcagcaatggagatgacagcttcagcagcagcggggacctgagcctgagcgccagccctgtgcctgccagcctggcccagccccccctgcctgtgctgccccccttccccccacccagcggcaagaaccctgtgatgatcctgaatgagctgcggcccggcctgaagtatgacttcctgtctgagagcggggagagccacgccaagagctttgtgatgtctgtggtggtggatggccagttctttgagggcagcggcaggaacaagaagctggccaaggcccgggccgcccagagcgccctggccgccatcttcaacctgcacctggaccagacccccagccggcagcccatccccagcgagggcctgcagctgcacctgccccaggtgctggctgatgctgtgtcccggctggtgctgggcaagtttggagacctgacagacaacttcagcagcccccacgcccggaggaaggtgctggccggcgtggtgatgaccactggaacagatgtgaaggatgccaaggtgatctctgtgtccacaggcaccaagtgcatcaatggagagtacatgtctgaccggggcctggccctgaatgactgccacgccgagatcatcagccgccgcagcctgctgcgcttcctgtacacccagctggagctgtacctgaacaacaaggatgaccagaagaggagcatcttccagaagtctgagcggggcggcttccggctgaaggaaaatgtgcagttccacctgtacatcagcaccagcccctgtggagatgcccgcatcttcagcccccatgagcccatcctggagggcagccgcagctacacccaggccggcgtgcagtggtgcaaccacggcagcctgcagcccaggcctcctggcctgctgagtgaccccagcaccagcaccttccagggcgccggcaccacagagcctgctgacagacaccccaacaggaaggcccggggccagctgcggaccaagattgagagcggggagggcaccatccctgtgcgcagcaatgccagcatccagacctgggatggagtgctgcagggcgagcggctgctgaccatgagctgcagcgacaagatcgcccgctggaatgtggtgggcatccagggcagcctgctgagcatctttgtggagcccatctacttcagcagcatcatcctgggcagcctgtaccacggggaccacctgagccgggccatgtaccagaggatcagcaacatcgaggacctgccccccctgtacaccctgaacaagcccctgctgagcggcatcagcaatgctgaggcccggcagcccgggaaggcccccaacttctctgtgaactggacagtgggggacagcgccattgaagtcatcaatgccaccaccgggaaggatgagctgggccgggccagccggctgtgcaagcacgccctgtactgccgctgggcctgtgcccggcagggcagcctgcccctgaccaccctgcaggactaccaggcccagagggtgccctag

SEQ ID NO: 142842 - DNA, 426 bp, Artificial Sequence
  Description of Artificial Sequence: Synthetic coding sequence
atgagccacaggatggagggcgtgggccagctgcctgccagctaccgccacaaccggcccctgctgtctggagtgtctgatgctgaggcccggcagcccgggaagagcccccccttctccatgaactgggtggtgggcagcgctgacctggagatcatcaatgccaccactggaagaagaagctgtggcggccccagccggctgtgcaagcacgtgctgagcgcccgctgggcccggctgtatggccgcctgagcaccaggacccccagccctggggacacccccagcatgtactgtgaggccaagctgggcgcccacacctaccagagcgtgaagcagcagctgttcaaggccttccagaaggccggcctgggcacctgggtgaggaagcccccagagcagcagcagttcctgctgaccctgtag

SEQ ID NO: 142843 - DNA, 747 bp, Artificial Sequence
  Description of Artificial Sequence: Synthetic coding sequence
atgggcctgtggagccctgtgcccggcaacagcgtgccccgggcccctgtgatggccggcctgggcctgggccacagccagggcgccccccagggcccccatgatggcaagacagacaggagcagcggccctggaagaagaagaacagagaggacccggctgcccggcctgctgggcggggcccccctgacagctggcagcccccaccgctggaatgtgctgggcctgcagggcgccctgctgagccactttgtggagcctgtgtacctgcagagcatcgtggtgggcagcctgcaccacacaggccacctggcccgggtgatgagccacaggatggagggcgtgggccagctgcctgccagctaccgccacaaccggcccctgctgagcggcgtgtctgatgctgaggcccggcagcccgggaagagcccccccttctccatgaactgggtggtgggcagcgctgacctggagatcatcaatgccaccaccggccgccgcagctgtggcggccccagccggctgtgcaagcacgtgctgagcgcccgctgggcccggctgtatggccgcctgagcaccaggacccccagccctggggacacccccagcatgtactgtgaggccaagctgggcgcccacacctaccagagcgtgaagcagcagctgttcaaggccttccagaaggccggcctgggcacctgggtgaggaagcccccagagcagcagcagttcctgctgaccctgtag

SEQ ID NO: 142844 - DNA, 2220 bp, Artificial Sequence
  Description of Artificial Sequence: Synthetic coding sequence
atggcctctgtgctgggcagcggccggggcagcggcggcctgagcagccagctgaagtgcaagagcaagagaagaagaagaagaagaagcaagaggaaggacaaggtgtccatcctgagcaccttcctggcccccttcaagcacctgagccctggcatcaccaacacagaagatgatgacaccctgagcaccagcagcgctgaggtgaaggaaaatagaaatgtgggcaacctggccgcccggcccccaccttctggggaccgggcccggggcggggcccctggggccaagaggaagaggcccctggaggagggcaatggaggccacctgtgcaagctgcagctggtgtggaagaagctgtcctggagcgtggcccccaagaatgccctggtgcagctgcacgagctgcggcccggcctgcagtacagaacagtgtcccagacaggccctgtgcacgcccctgtgtttgctgtggccgtggaggtgaatggcctgacctttgagggcaccggccccaccaagaagaaggccaagatgagagctgctgagctggccctgcggagctttgtgcagttccccaatgcctgccaggcccacctggccatgggcggcggccctggccctggaacagacttcaccagtgaccaggccgacttcccagacaccctcttccaggagtttgagcccccagccccccggcccggcctggccggcggccggcctggagatgctgccctgctgtctgctgcctatggaagaagaaggctgctgtgccgggccctggacctggtgggccccaccccagccaccccagctgcccctggagagagaaatcctgtggtgctgctgaaccggctgcgggccggcctgcgctacgtgtgcctggccgagcctgctgagcggcgggcccggagctttgtgatggctgtgtctgtggatggccgcacctttgagggcagcggccgcagcaagaagctggcccggggccaggccgcccaggccgccctgcaggagctgtttgacatccagatgcctggccacgcccctggccgggcccggaggacccccatgccccaggagtttgctgacagcatcagccagctggtgacccagaagttccgggaggtgaccacagacctgacccccatgcacgcccggcacaaggccctggccggcatcgtgatgaccaagggcctggatgcccggcaggcccaggtggtggccctgagcagcggcaccaagtgcatctctggagagcacctgagtgaccagggcctggtggtgaatgactgccacgccgaggtggtggcccggcgggccttcctgcacttcctgtacacccagctggagctgcacctgagcaagaggcgggaggacagcgagaggagcatctttgtgcggctgaaggagggcggctaccgcctgcgggagaacatcctcttccacctgtatgtgtccaccagcccctgtggagatgcccggctgcacagcccctatgagatcaccacagacctgcacagcagcaagcacctggtgaggaagttccggggccacctgcggaccaagattgaaagtggagagggcaccgtgcctgtgcggggccccagcgctgtgcagacctgggatggagtgctgctgggggagcagctgatcaccatgagctgcacagacaagatcgcccgctggaatgtgctgggcctgcagggcgccctgctgagccactttgtggagcctgtgtacctgcagagcatcgtggtgggcagcctgcaccacacaggccacctggcccgggtgatgagccacaggatggagggcgtgggccagctgcctgccagctaccgccacaaccggcccctgctgtctggagtgtctgatgctgaggcccggcagcccgggaagagcccccccttctccatgaactgggtggtgggcagcgctgacctggagatcatcaatgccaccactggaagaagaagctgtggcggccccagccggctgtgcaagcacgtgctgagcgcccgctgggcccggctgtatggccgcctgagcaccaggacccccagccctggggacacccccagcatgtactgtgaggccaagctgggcgcccacacctaccagagcgtgaagcagcagctgttcaaggccttccagaaggccggcctgggcacctgggtgaggaagcccccagagcagcagcagttcctgctgaccctgtag

SEQ ID NO: 142845 - DNA, 1509 bp, Artificial Sequence
  Description of Artificial Sequence: Synthetic coding sequence
atgtggacagcagatgaaattgcccagctgtgctatgagcactacggcatccggctgcccaagaagggcaagccagagcccaaccacgagtggaccctgctggccgctgtggtgaagatccagagccctgctgacaaggcctgtgacaccccagacaagcctgtgcaggtgaccaaggaggtggtgtccatgggcaccggcaccaagtgcatcggccagagcaagatgaggaagaatggagacatcctgaatgacagccacgccgaggtgattgcccggcgctccttccagcgctacctgctgcaccagctgcagctggccgccaccctgaaggaggacagcatctttgtgcccggcacccagaagggcgtgtggaagctgcggcgggacctgatctttgtgttcttcagcagccacaccccctgtggagatgccagcatcatccccatgctggagtttgaggaccagccctgctgccctgtgttcaggaactgggcccacaacagctctgtggaggccagcagcaacctggaggcccctggaaatgaaagaaaatgtgaagatcctgacagccctgtgaccaagaagatgaggctggagcctggaacagctgcccgggaggtgaccaacggggccgcccaccaccagagctttgggaagcagaagagcggccccatcagccctggcatccacagctgtgacctgactgtggagggcctggccaccgtgacccgcatcgcccctggcagcgccaaggtgattgatgtgtacagaactggagccaagtgtgtgcctggagaggccggggacagcggcaagccaggggccgccttccaccaggtgggcctgctgcgggtgaagccaggccgcggggacaggaccaggtccatgagctgcagcgacaagatggcccgctggaatgtgctgggctgccagggcgccctgctgatgcacctgctggaggagcccatctacctgtctgctgtggtgattggaaaatgtccctacagccaggaggccatgcagagggccctgattggccgctgccagaatgtgtctgccctgcccaagggctttggagtgcaggagctgaagatcctgcagagcgacctgctgtttgagcagagccgctctgctgtgcaggccaagagagctgacagccctggccgcctggtgccctgtggggccgccatctcctggagcgctgtgcctgagcagcccctggatgtgacagccaacggcttcccccagggcaccaccaagaagaccatcggcagcctgcaggcccggagccagatcagcaaggtggagctgttccgctccttccagaagctgctgagcagaattgcccgggacaagtggccccacagcctgcgggtgcagaagctggacacctaccaggagtacaaggaggccgccagcagctaccaggaggcctggagcaccctgaggaagcaggtgtttggctcctggatcagaaatcctccagactaccaccagttcaagtag

SEQ ID NO: 142846 - DNA, 1422 bp, Artificial Sequence
  Description of Artificial Sequence: Synthetic coding sequence
atgtggaccctgctggccgctgtggtgaagatccagagccctgctgacaaggcctgtgacaccccagacaagcctgtgcaggtgaccaaggaggtggtgtccatgggcaccggcaccaagtgcatcggccagagcaagatgaggaagaatggagacatcctgaatgacagccatgctgaggtgattgcccggcgctccttccagcgctacctgctgcaccagctgcagctggccgccaccctgaaggaggacagcatctttgtgcccggcacccagaagggcgtgtggaagctgcggcgggacctgatctttgtgttcttcagcagccacaccccctgtggagatgccagcatcatccccatgctggagtttgaggaccagccctgctgccctgtgttcaggaactgggcccacaacagctctgtggaggccagcagcaacctggaggcccctggaaatgaaagaaaatgtgaggaccctgacagccctgtgaccaagaagatgaggctggagcccggcacagctgcccgggaggtgaccaatggagctgcccaccaccagagctttgggaagcagaagagcggccccatcagccctggcatccacagctgtgacctgactgtggagggcctggccaccgtgaccagaattgcccctggcagcgccaaggtgattgatgtgtacagaactggagccaagtgtgtgcctggagaggccggggacagcggcaagccaggagctgccttccaccaggtgggcctgctgcgggtgaagccaggccgcggggacaggaccaggtccatgagctgcagcgacaagatggcccgctggaatgtgctgggctgccagggcgccctgctgatgcacctgctggaggagcccatctacctgtctgctgtggtgattggcaagtgcccctacagccaggaggccatgcagagggccctgattggccgctgccagaatgtgtctgccctgcccaagggcttcggcgtgcaggagctgaagatcctgcagagcgacctgctgtttgagcagagccgctctgctgtgcaggccaagagagctgacagccctggccgcctggtgccctgtggggccgccatctcctggagcgctgtgcctgagcagcccctggatgtgacagccaacggcttcccccagggcaccaccaagaagaccatcggcagcctgcaggcccggagccagatcagcaaggtggagctgttccgctccttccagaagctgctgagccgcatcgcccgggacaagtggccccacagcctgcgggtgcagaagctggacacctaccaggagtacaaggaggccgccagcagctaccaggaggcctggagcaccctgaggaagcaggtgtttggctcctggatccggaaccccccagactaccaccagttcaagtag

SEQ ID NO: 142847 - DNA, 1089 bp, Artificial Sequence
  Description of Artificial Sequence: Synthetic coding sequence
atggctgctgctgaggaggagcccaagcccaagaagctgaaggtggaggccccccaggccctgcgggagaacatcctgtttggcatgggcaaccccctgctggacatctctgctgtggtggacaaggacttcctggacaagtacagcctgaagcccaatgaccagatcctggccgaggacaagcacaaggagctgtttgatgagctggtgaagaagttcaaggtggagtaccacgccggcggcagcacccagaacagcatcaaggtggcccagtggatgatccagcagccccacaaggccgccaccttcttcggctgcattggaattgacaagtttggagagatcctgaagaggaaggctgctgaggcccacgtggatgcccactactatgagcagaatgagcagcccaccggcacctgtgccgcctgcatcactggagacaacagaagcctcatcgccaacctggccgccgccaactgctacaagaaggagaagcacctggacctggagaagaactggatgctggtggagaaggcccgggtgtgctacatcgccggcttcttcctgactgtgtccccagagagcgtgctgaaggtggcccaccacgccagcgagaacaaccgcatcttcaccctgaacctgagcgcccccttcatcagccagttctacaaggagagcctgatgaaggtgatgccctacgtggacatcctgtttggaaatgaaacagaggccgccacctttgcccgggagcagggctttgagaccaaggacatcaaggagatcgccaagaagacccaggccctgcccaagatgaacagcaagaggcagagaattgtcatcttcacccagggcagagatgacaccatcatggccacagagagcgaggtgacagcctttgctgtgctggaccaggaccagaaggagatcatcgacaccaatggagctggagatgcctttgtgggcggcttcctgagccagctggtgtctgacaagcccctgacagagtgcatccgggccggccactatgctgccagcatcatcatcagaagaacaggctgcaccttccctgagaagccagacttccactag

SEQ ID NO: 142848 - DNA, 1038 bp, Artificial Sequence
  Description of Artificial Sequence: Synthetic coding sequence
atgacctctgtgcgggagaacatcctgtttggcatgggcaaccccctgctggacatctctgctgtggtggacaaggacttcctggacaagtacagcctgaagcccaatgaccagatcctggccgaggacaagcacaaggagctgtttgatgagctggtgaagaagttcaaggtggagtaccacgccggcggcagcacccagaacagcatcaaggtggcccagtggatgatccagcagccccacaaggccgccaccttcttcggctgcatcggcatcgacaagtttggagagatcctgaagaggaaggctgctgaggcccacgtggatgcccactactatgagcagaatgagcagcccaccggcacctgtgccgcctgcatcaccggggacaacagaagcctgattgccaacctggccgccgccaactgctacaagaaggagaagcacctggacctggagaagaactggatgctggtggagaaggcccgggtgtgctacatcgccggcttcttcctgactgtgtccccagagagcgtgctgaaggtggcccaccacgccagcgagaacaaccgcatcttcaccctgaacctgagcgcccccttcatcagccagttctacaaggagagcctgatgaaggtgatgccctacgtggacatcctgtttggaaatgaaacagaagctgccacctttgcccgggagcagggctttgagaccaaggacatcaaggagatcgccaagaagacccaggccctgcccaagatgaacagcaagaggcagagaattgtcatcttcacccagggcagagatgacaccatcatggccacagaaagtgaggtgacagcctttgctgtgctggaccaggaccagaaggagatcatcgacaccaacggggctggagatgcctttgtgggcggcttcctgagccagctggtgtctgacaagcccctgacagagtgcatccgggccggccactacgccgccagcatcatcatccggaggacaggctgcaccttccctgagaagccagacttccactag

SEQ ID NO: 142849 - DNA, 918 bp, Artificial Sequence
  Description of Artificial Sequence: Synthetic coding sequence
atggctgctgctgaggaggagcccaagcccaagaagctgaaggtggaggccccccaggccctgcgggagaacatcctgtttggcatgggcaaccccctgctggacatctctgctgtggtggacaaggacttcctggacaagtacagcctgaagcccaatgaccagatcctggccgaggacaagcacaaggagctgtttgatgagctggtgaagaagttcaaggtggagtaccacgccggcggcagcacccagaacagcatcaaggtggcccagtggatgatccagcagccccacaaggccgccaccttcttcggctgcattggaattgacaagtttggagagatcctgaagaggaaggctgctgaggcccacgtggatgcccactactatgagcagaatgagcagcccaccggcacctgtgccgcctgcatcactggagacaacagaagcctcatcgccaacctggccgccgccaactgctacaagaaggagaagcacctggacctggagaagaactggatgctggtggagaaggcccgggtgtgctacatcgccgaggccgccacctttgcccgggagcagggctttgagaccaaggacatcaaggagatcgccaagaagacccaggccctgcccaagatgaacagcaagaggcagagaattgtcatcttcacccagggcagagatgacaccatcatggccacagaaagtgaggtgacagcctttgctgtgctggaccaggaccagaaggagatcatcgacaccaacggggctggagatgcctttgtgggcggcttcctgagccagctggtgtctgacaagcccctgacagagtgcatccgggccggccactacgccgccagcatcatcatccggaggacaggctgcaccttccctgagaagccagacttccactag

SEQ ID NO: 142850 - DNA, 984 bp, Artificial Sequence
  Description of Artificial Sequence: Synthetic coding sequence
atgacctctgtgcgggagaacatcctgtttggcatgggcaaccccctgctggacatctctgctgtggtggacaaggacttcctggacaagtttgatgagctggtgaagaagttcaaggtggagtaccacgccggcggcagcacccagaacagcatcaaggtggcccagtggatgatccagcagccccacaaggccgccaccttcttcggctgcatcggcatcgacaagtttggagagatcctgaagaggaaggctgctgaggcccacgtggatgcccactactatgagcagaatgagcagcccaccggcacctgtgccgcctgcatcaccggggacaacagaagcctgattgccaacctggccgccgccaactgctacaagaaggagaagcacctggacctggagaagaactggatgctggtggagaaggcccgggtgtgctacatcgccggcttcttcctgactgtgtccccagagagcgtgctgaaggtggcccaccacgccagcgagaacaaccgcatcttcaccctgaacctgagcgcccccttcatcagccagttctacaaggagagcctgatgaaggtgatgccctacgtggacatcctgtttggaaatgaaacagaagctgccacctttgcccgggagcagggctttgagaccaaggacatcaaggagatcgccaagaagacccaggccctgcccaagatgaacagcaagaggcagagaattgtcatcttcacccagggcagagatgacaccatcatggccacagaaagtgaggtgacagcctttgctgtgctggaccaggaccagaaggagatcatcgacaccaacggggctggagatgcctttgtgggcggcttcctgagccagctggtgtctgacaagcccctgacagagtgcatccgggccggccactacgccgccagcatcatcatccggaggacaggctgcaccttccctgagaagccagacttccactag

SEQ ID NO: 142851 - DNA, 2244 bp, Artificial Sequence
  Description of Artificial Sequence: Synthetic coding sequence
atgcccctcttcaagctgcctgctgaggagaagcagattgatgatgccatgaggaactttgctgagaaggtgtttgccagcgaggtgaaggatgaaggaggccggcaggagatcagcccctttgatgtggatgagatctgccccatcagccaccacgagatgcaggcccacatcttccacctggagaccctgagcaccagcacagaggcccggaggaagaagcgcttccagggcaggaagacagtgaacctgagcatccccctgtctgagaccagcagcaccaagctgagccacattgatgagtacatcagcagcagccccacctaccagacagtgcctgacttccagagggtgcagatcactggagactatgccagcggcgtgacagtggaggactttgaaattgtgtgcaagggcctgtaccgggccctgtgcatccgggagaagtacatgcagaagagcttccagcgcttccccaagacccccagcaagtacctgagaaatattgatggagaggcctgggtggccaatgaaagcttctaccctgtgttcaccccacctgtgaagaagggggaggaccccttcagaacagacaacctgcctgagaacctgggctaccacctgaagatgaaggatggagtggtgtatgtgtacccaaatgaggccgctgtgtccaaggatgagcccaagcccctgccctaccccaacctggacaccttcctggatgacatgaacttcctgctggccctgattgcccagggccctgtgaagacctacacccaccggcggctgaagttcctgagcagcaagttccaggtgcaccagatgctgaatgagatggatgagctgaaggagctgaagaacaacccccaccgggacttctacaactgcaggaaggtggacacccacatccacgccgccgcctgcatgaaccagaagcacctgctgcgcttcatcaagaagagctaccagattgatgctgacagagtggtgtacagcaccaaggagaagaacctgaccctgaaggagctgtttgccaagctgaagatgcacccctatgacctgactgtggacagcctggatgtgcacgccggccggcagaccttccagagatttgacaagttcaatgacaagtacaaccctgtgggcgccagcgagctgcgggacctgtacctgaagacagacaactacatcaatggagagtactttgccaccatcatcaaggaggtgggcgctgacctggtggaggccaagtaccagcacgccgagccccggctgagcatctacggccgcagcccagatgagtggagcaagctgagctcctggtttgtgtgcaaccgcatccactgccccaacatgacctggatgatccaggtgccccgcatctatgatgtgttccgcagcaagaacttcctgccccactttgggaagatgctggagaacatcttcatgcctgtgtttgaggccaccatcaacccccaggccgaccctgagctgagcgtcttcctgaagcacatcactggatttgattctgtggatgatgagagcaagcacagcggccacatgttcagcagcaagagccccaagccccaggagtggaccctggagaagaaccccagctacacctactatgcctactacatgtatgccaacatcatggtgctgaacagcctgaggaaggagcggggcatgaacaccttcctgttccggccccactgtggggaggccggggccctgacccacctgatgacagccttcatgattgctgatgacatcagccacggcctgaacctgaagaagagccctgtgctgcagtacctgttcttcctggcccagatccccatcgccatgagccccctgagcaacaacagcctcttcctggagtatgccaagaaccccttcctggacttcctgcagaagggcctgatgatcagcctgagcacagatgaccccatgcagttccacttcaccaaggagcccctgatggaggagtatgccatcgccgcccaggtgttcaagctgagcacctgtgacatgtgtgaggtggccaggaacagcgtgctgcagtgtggcatcagccatgaggagaaggtgaagttcctgggggacaactacctggaggagggccctgctggaaatgacatccggaggaccaacgtggcccagatccgcatggcctaccgctatgagacctggtgctatgagctgaacctgattgctgagggcctgaagagcacagaatag

SEQ ID NO: 142852 - DNA, 2343 bp, Artificial Sequence
  Description of Artificial Sequence: Synthetic coding sequence
atgaatgtgcgcatcttctacagcgtgtcccagagcccccacagcctgctgagcctgctcttctactgtgccatcctggagagccgcatcagcgccaccatgcccctcttcaagctgcctgctgaggagaagcagattgatgatgccatgaggaactttgctgagaaggtgtttgccagcgaggtgaaggatgagggcggccggcaggagatcagcccctttgatgtggatgagatctgccccatcagccaccacgagatgcaggcccacatcttccacctggagaccctgagcaccagcacagaggcccggaggaagaagcgcttccagggcaggaagacagtgaacctgagcatccccctgtctgagaccagcagcaccaagctgagccacattgatgagtacatcagcagcagccccacctaccagacagtgcctgacttccagagggtgcagatcaccggggactatgccagcggcgtgacagtggaggactttgagatcgtgtgcaagggcctgtaccgggccctgtgcatccgggagaagtacatgcagaagagcttccagcgcttccccaagacccccagcaagtacctgaggaacattgatggagaggcctgggtggccaatgaaagcttctaccctgtgttcaccccacctgtgaagaagggggaggaccccttcagaacagacaacctgcctgagaacctgggctaccacctgaagatgaaggatggagtggtgtatgtgtacccaaatgaagctgctgtgtccaaggatgagcccaagcccctgccctaccccaacctggacaccttcctggatgacatgaacttcctgctggccctgattgcccagggccctgtgaagacctacacccaccggcggctgaagttcctgagcagcaagttccaggtgcaccagatgctgaatgagatggatgagctgaaggagctgaagaacaacccccaccgggacttctacaactgcaggaaggtggacacccacatccatgctgctgcctgcatgaaccagaagcacctgctgcgcttcatcaagaagagctaccagattgatgctgacagagtggtgtacagcaccaaggagaagaacctgaccctgaaggagctgtttgccaagctgaagatgcacccctatgacctgactgtggacagcctggatgtgcatgctggccggcagaccttccagagatttgacaagttcaatgacaagtacaaccctgtgggcgccagcgagctgcgggacctgtacctgaagacagacaactacatcaacggggagtactttgccaccatcatcaaggaggtgggcgctgacctggtggaggccaagtaccagcacgccgagccccggctgagcatctacggccgcagcccagatgagtggagcaagctgagctcctggtttgtgtgcaaccgcatccactgccccaacatgacctggatgatccaggtgccccgcatctatgatgtgttccgcagcaagaacttcctgccccactttgggaagatgctggagaacatcttcatgcctgtgtttgaggccaccatcaacccccaggccgaccctgagctgtctgtgttcctgaagcacatcaccggctttgacagcgtggatgatgagagcaagcacagcggccacatgttcagcagcaagagccccaagccccaggagtggaccctggagaagaaccccagctacacctactatgcctactacatgtatgccaacatcatggtgctgaacagcctgaggaaggagcggggcatgaacaccttcctgttccggccccactgtggggaggccggggccctgacccacctgatgacagccttcatgattgctgatgacatcagccacggcctgaacctgaagaagagccctgtgctgcagtacctgttcttcctggcccagatccccatcgccatgagccccctgagcaacaacagcctcttcctggagtatgccaagaaccccttcctggacttcctgcagaagggcctgatgatcagcctgagcacagatgaccccatgcagttccacttcaccaaggagcccctgatggaggagtatgccatcgccgcccaggtgttcaagctgagcacctgtgacatgtgtgaggtggccagaaattctgtgctgcagtgtggcatcagccatgaggagaaggtgaagttcctgggggacaactacctggaggagggccctgctggaaatgacatccggaggaccaacgtggcccagatccgcatggcctaccgctatgagacctggtgctatgagctgaacctgattgctgagggcctgaagagcacagaatag

SEQ ID NO: 142853 - DNA, 2331 bp, Artificial Sequence
  Description of Artificial Sequence: Synthetic coding sequence
atgaatgtgcgcatcttctacagcgtgtcccagagcccccacagcctgctgagcctgctcttctactgtgccatcctggagagccgcatcagcgccaccatgcccctcttcaagctgcctgagattgatgatgccatgaggaactttgctgagaaggtgtttgccagcgaggtgaaggatgagggcggccggcaggagatcagcccctttgatgtggatgagatctgccccatcagccaccacgagatgcaggcccacatcttccacctggagaccctgagcaccagcacagaggcccggaggaagaagcgcttccagggcaggaagacagtgaacctgagcatccccctgtctgagaccagcagcaccaagctgagccacattgatgagtacatcagcagcagccccacctaccagacagtgcctgacttccagagggtgcagatcaccggggactatgccagcggcgtgacagtggaggactttgagatcgtgtgcaagggcctgtaccgggccctgtgcatccgggagaagtacatgcagaagagcttccagcgcttccccaagacccccagcaagtacctgaggaacattgatggagaggcctgggtggccaatgaaagcttctaccctgtgttcaccccacctgtgaagaagggggaggaccccttcagaacagacaacctgcctgagaacctgggctaccacctgaagatgaaggatggagtggtgtatgtgtacccaaatgaagctgctgtgtccaaggatgagcccaagcccctgccctaccccaacctggacaccttcctggatgacatgaacttcctgctggccctgattgcccagggccctgtgaagacctacacccaccggcggctgaagttcctgagcagcaagttccaggtgcaccagatgctgaatgagatggatgagctgaaggagctgaagaacaacccccaccgggacttctacaactgcaggaaggtggacacccacatccatgctgctgcctgcatgaaccagaagcacctgctgcgcttcatcaagaagagctaccagattgatgctgacagagtggtgtacagcaccaaggagaagaacctgaccctgaaggagctgtttgccaagctgaagatgcacccctatgacctgactgtggacagcctggatgtgcatgctggccggcagaccttccagagatttgacaagttcaatgacaagtacaaccctgtgggcgccagcgagctgcgggacctgtacctgaagacagacaactacatcaacggggagtactttgccaccatcatcaaggaggtgggcgctgacctggtggaggccaagtaccagcacgccgagccccggctgagcatctacggccgcagcccagatgagtggagcaagctgagctcctggtttgtgtgcaaccgcatccactgccccaacatgacctggatgatccaggtgccccgcatctatgatgtgttccgcagcaagaacttcctgccccactttgggaagatgctggagaacatcttcatgcctgtgtttgaggccaccatcaacccccaggccgaccctgagctgtctgtgttcctgaagcacatcaccggctttgacagcgtggatgatgagagcaagcacagcggccacatgttcagcagcaagagccccaagccccaggagtggaccctggagaagaaccccagctacacctactatgcctactacatgtatgccaacatcatggtgctgaacagcctgaggaaggagcggggcatgaacaccttcctgttccggccccactgtggggaggccggggccctgacccacctgatgacagccttcatgattgctgatgacatcagccacggcctgaacctgaagaagagccctgtgctgcagtacctgttcttcctggcccagatccccatcgccatgagccccctgagcaacaacagcctcttcctggagtatgccaagaaccccttcctggacttcctgcagaagggcctgatgatcagcctgagcacagatgaccccatgcagttccacttcaccaaggagcccctgatggaggagtatgccatcgccgcccaggtgttcaagctgagcacctgtgacatgtgtgaggtggccagaaattctgtgctgcagtgtggcatcagccatgaggagaaggtgaagttcctgggggacaactacctggaggagggccctgctggaaatgacatccggaggaccaacgtggcccagatccgcatggcctaccgctatgagacctggtgctatgagctgaacctgattgctgagggcctgaagagcacagaatag

SEQ ID NO: 142854 - DNA, 2640 bp, Artificial Sequence
  Description of Artificial Sequence: Synthetic coding sequence
atgaggaacagaggccagggcctcttccggctgcggagccgctgcttcctgcaccagagcctgcccctgggcgccggccgcaggaagggcctggatgtggccgagcccggccccagccgctgccgcagtgacagccctgctgtggccgctgtggtgcctgccatggccagctaccccagcggcagcggcaagcccaaggccaagtaccccttcaagaagagggccagcctgcaggccagcacagctgcccctgaggcccggggcggcctgggcgccccacccctgcagagcgcccggagcctgcccggccctgccccctgcctgaagcacttccccctggacctgcggacctccatggatggcaagtgcaaggagattgctgaggagctgttcaccaggagcctggccgagagcgagctgcggagcgccccctatgagttccctgaggagagccccatcgagcagctggaggagcggcggcagaggctggagcggcagatcagccaggatgtgaagctggagccagacatcctgctgcgggccaagcaggacttcctgaagacagacagcgacagcgacctgcagctgtacaaggagcagggcgagggccagggcgacaggagcctgcgggagagagatgtgctggagcgggagttccagagggtgaccatctctggagaggagaagtgtggggtgcccttcacagacctgctggatgctgccaagtctgtggtgcgggccctcttcatccgggagaagtacatggccctgagcctgcagagcttctgccccaccacccggcgctacctgcagcagctggccgagaagcccctggagaccaggacctatgagcagggccctgacacccctgtgtctgcagatgcccctgtgcaccccccagccctggagcagcacccctatgagcactgtgagcccagcaccatgcctggggacctgggcctgggcctgaggatggtgcggggcgtggtgcacgtgtacacccggcgggagccagatgagcactgcagcgaggtggagctgccctacccagacctgcaggagtttgtggctgatgtgaatgtgctgatggccctgatcatcaatggccccatcaagagcttctgctacagaaggctgcagtacctgagcagcaagttccagatgcacgtgctgctgaatgagatgaaggagctggccgcccagaagaaggtgccccaccgggacttctacaacatcaggaaggtggacacccacatccacgccagcagctgcatgaaccagaagcacctgctgcgcttcatcaagagggccatgaagaggcacctggaggagatcgtgcacgtggagcagggccgggagcagaccctgcgggaggtgtttgagagcatgaacctgacagcctatgacctgtctgtggacaccctggatgtgcatgctgacaggaacaccttccacagatttgacaagttcaatgccaagtacaaccccatcggggagagcgtgctgcgggagatcttcatcaagacagacaacagagtgtctgggaagtactttgcccacatcatcaaggaggtgatgtctgacctggaggagagcaagtaccagaatgctgagctgcggctgagcatctacggccgcagcagagatgagtgggacaagctggcccgctgggccgtgatgcaccgggtgcacagccccaacgtgcgctggctggtgcaggtgccccggctgtttgatgtgtaccgcaccaagggccagctggccaacttccaggagatgctggagaacatcttcctgcccctgtttgaggccaccgtgcacccagccagccaccctgagctgcacctgttcctggagcacgtggatggctttgacagcgtggatgatgagagcaagccagagaaccacgtgttcaacctggagagccccctgcctgaggcctgggtggaggaggacaaccccccctatgcctactacctgtactacacctttgccaacatggccatgctgaaccacctgcggcggcagaggggcttccacacctttgtgctgcggccccactgtggggaggccggccccatccaccacctggtgtctgccttcatgctggccgagaacatcagccacggcctgctgctgaggaaggcccctgtgctgcagtacctgtactacctggcccagatcggcatcgccatgagccccctgagcaacaacagcctcttcctgagctaccacaggaaccccctgcctgagtacctgagccggggcctgatggtgtccctgagcacagatgaccccctgcagttccacttcaccaaggagcccctgatggaggagtacagcatcgccacccaggtgtggaagctgagcagctgtgacatgtgtgagctggccagaaattctgtgctgatgagcggcttcagccacaaggtgaagagccactggctgggccccaactacaccaaggagggccctgagggcaatgacatccggaggaccaacgtgcctgacatccgggtgggctaccgctatgagaccctgtgccaggagctggccctgatcacccaggccgtgcagagcgagatgctggagaccatccctgaggaggccggcatcaccatgagccctggcccccagtag

SEQ ID NO: 142855 - DNA, 2397 bp, Artificial Sequence
  Description of Artificial Sequence: Synthetic coding sequence
atggccagcgaggcccggggcggcctgggcgccccacccctgcagagcgcccggagcctgcccggccctgccccctgcctgaagcacttccccctggacctgcggacctccatggatggcaagtgcaaggagattgctgaggagctgttcaccaggagcctggccgagagcgagctgcggagcgccccctatgagttccctgaggagagccccatcgagcagctggaggagcggcggcagaggctggagcggcagatcagccaggatgtgaagctggagccagacatcctgctgcgggccaagcaggacttcctgaagacagacagcgacagcgacctgcagctgtacaaggagcagggcgagggccagggcgacaggagcctgcgggagagagatgtgctggagcgggagttccagagggtgaccatcagcggggaggagaagtgtggggtgcccttcacagacctgctggatgctgccaagtctgtggtgcgggccctcttcatccgggagaagtacatggccctgagcctgcagagcttctgccccaccacccggcgctacctgcagcagctggccgagaagcccctggagaccaggacctatgagcagggccctgacacccctgtgtctgcagatgcccctgtgcaccccccagccctggagcagcacccctatgagcactgtgagcccagcaccatgcctggggacctgggcctgggcctgaggatggtgcggggcgtggtgcacgtgtacacccggcgggagccagatgagcactgcagcgaggtggagctgccctacccagacctgcaggagtttgtggctgatgtgaatgtgctgatggccctgatcatcaatggccccatcaagagcttctgctaccgccgcctgcagtacctgagcagcaagttccagatgcacgtgctgctgaatgagatgaaggagctggccgcccagaagaaggtgccccaccgggacttctacaacatcaggaaggtggacacccacatccacgccagcagctgcatgaaccagaagcacctgctgcgcttcatcaagagggccatgaagaggcacctggaggagatcgtgcacgtggagcagggccgggagcagaccctgcgggaggtgtttgagagcatgaacctgacagcctatgacctgtctgtggacaccctggatgtgcacgccgacaggaacaccttccacagatttgacaagttcaatgccaagtacaaccccatcggggagagcgtgctgcgggagatcttcatcaagacagacaacagagtgtctgggaagtactttgcccacatcatcaaggaggtgatgtctgacctggaggagagcaagtaccagaatgctgagctgcggctgagcatctacggccgcagcagagatgagtgggacaagctggcccgctgggccgtgatgcaccgggtgcacagccccaacgtgcgctggctggtgcaggtgccccggctgtttgatgtgtaccgcaccaagggccagctggccaacttccaggagatgctggagaacatcttcctgcccctgtttgaggccaccgtgcacccagccagccaccctgagctgcacctgttcctggagcacgtggatggctttgattctgtggatgatgagagcaagccagaaaatcatgtgttcaacctggagagccccctgcctgaggcctgggtggaggaggacaaccccccctatgcctactacctgtactacacctttgccaacatggccatgctgaaccacctgcggcggcagaggggcttccacacctttgtgctgcggccccactgtggggaggccggccccatccaccacctggtgtctgccttcatgctggccgagaacatcagccacggcctgctgctgaggaaggcccctgtgctgcagtacctgtactacctggcccagattggaattgccatgagccccctgagcaacaacagcctcttcctgagctaccacaggaaccccctgcctgagtacctgagccggggcctgatggtgtccctgagcacagatgaccccctgcagttccacttcaccaaggagcccctgatggaggagtacagcatcgccacccaggtgtggaagctgagcagctgtgacatgtgtgagctggccaggaacagcgtgctgatgagcggcttcagccacaaggtgaagagccactggctgggccccaactacaccaaggagggccctgagggcaatgacatccggaggaccaacgtgcctgacatccgggtgggctaccgctatgagaccctgtgccaggagctggccctgatcacccaggccgtgcagagcgagatgctggagaccatccctgaggaggccggcatcaccatgagccctggcccccagtag

SEQ ID NO: 142856 - DNA, 2415 bp, Artificial Sequence
  Description of Artificial Sequence: Synthetic coding sequence
atgtggcagagccaggccccagctggggccgcccagaccccacccctgagccccccctggagccagccctggcaccccatccacctggccctggccagcccccggcccaacatccccctgcggagcggccctgcctgccggccccccctgcagctgcaggagctgttcaccaggagcctggccgagagcgagctgcggagcgccccctatgagttccctgaggagagccccatcgagcagctggaggagcggcggcagaggctggagcggcagatcagccaggatgtgaagctggagccagacatcctgctgcgggccaagcaggacttcctgaagacagacagcgacagcgacctgcagctgtacaaggagcagggcgagggccagggcgacaggagcctgcgggagagagatgtgctggagcgggagttccagagggtgaccatcagcggggaggagaagtgtggggtgcccttcacagacctgctggatgctgccaagtctgtggtgcgggccctcttcatccgggagaagtacatggccctgagcctgcagagcttctgccccaccacccggcgctacctgcagcagctggccgagaagcccctggagaccaggacctatgagcagggccctgacacccctgtgtctgcagatgcccctgtgcaccccccagccctggagcagcacccctatgagcactgtgagcccagcaccatgcctggggacctgggcctgggcctgaggatggtgcggggcgtggtgcacgtgtacacccggcgggagccagatgagcactgcagcgaggtggagctgccctacccagacctgcaggagtttgtggctgatgtgaatgtgctgatggccctgatcatcaatggccccatcaagagcttctgctaccgccgcctgcagtacctgagcagcaagttccagatgcacgtgctgctgaatgagatgaaggagctggccgcccagaagaaggtgccccaccgggacttctacaacatcaggaaggtggacacccacatccacgccagcagctgcatgaaccagaagcacctgctgcgcttcatcaagagggccatgaagaggcacctggaggagatcgtgcacgtggagcagggccgggagcagaccctgcgggaggtgtttgagagcatgaacctgacagcctatgacctgtctgtggacaccctggatgtgcacgccgacaggaacaccttccacagatttgacaagttcaatgccaagtacaaccccatcggggagagcgtgctgcgggagatcttcatcaagacagacaacagagtgtctgggaagtactttgcccacatcatcaaggaggtgatgtctgacctggaggagagcaagtaccagaatgctgagctgcggctgagcatctacggccgcagcagagatgagtgggacaagctggcccgctgggccgtgatgcaccgggtgcacagccccaacgtgcgctggctggtgcaggtgccccggctgtttgatgtgtaccgcaccaagggccagctggccaacttccaggagatgctggagaacatcttcctgcccctgtttgaggccaccgtgcacccagccagccaccctgagctgcacctgttcctggagcacgtggatggctttgattctgtggatgatgagagcaagccagaaaatcatgtgttcaacctggagagccccctgcctgaggcctgggtggaggaggacaaccccccctatgcctactacctgtactacacctttgccaacatggccatgctgaaccacctgcggcggcagaggggcttccacacctttgtgctgcggccccactgtggggaggccggccccatccaccacctggtgtctgccttcatgctggccgagaacatcagccacggcctgctgctgaggaaggcccctgtgctgcagtacctgtactacctggcccagattggaattgccatgagccccctgagcaacaacagcctcttcctgagctaccacaggaaccccctgcctgagtacctgagccggggcctgatggtgtccctgagcacagatgaccccctgcagttccacttcaccaaggagcccctgatggaggagtacagcatcgccacccaggtgtggaagctgagcagctgtgacatgtgtgagctggccaggaacagcgtgctgatgagcggcttcagccacaaggtgaagagccactggctgggccccaactacaccaaggagggccctgagggcaatgacatccggaggaccaacgtgcctgacatccgggtgggctaccgctatgagaccctgtgccaggagctggccctgatcacccaggccgtgcagagcgagatgctggagaccatccctgaggaggccggcatcaccatgagccctggcccccagtag

SEQ ID NO: 142857 - DNA, 2283 bp, Artificial Sequence
  Description of Artificial Sequence: Synthetic coding sequence
atgctgaccttcctgcccagcccccaggagctgttcaccaggagcctggccgagagcgagctgcggagcgccccctatgagttccctgaggagagccccatcgagcagctggaggagcggcggcagaggctggagcggcagatcagccaggatgtgaagctggagccagacatcctgctgcgggccaagcaggacttcctgaagacagacagcgacagcgacctgcagctgtacaaggagcagggcgagggccagggcgacaggagcctgcgggagagagatgtgctggagcgggagttccagagggtgaccatcagcggggaggagaagtgtggggtgcccttcacagacctgctggatgctgccaagtctgtggtgcgggccctcttcatccgggagaagtacatggccctgagcctgcagagcttctgccccaccacccggcgctacctgcagcagctggccgagaagcccctggagaccaggacctatgagcagggccctgacacccctgtgtctgcagatgcccctgtgcaccccccagccctggagcagcacccctatgagcactgtgagcccagcaccatgcctggggacctgggcctgggcctgaggatggtgcggggcgtggtgcacgtgtacacccggcgggagccagatgagcactgcagcgaggtggagctgccctacccagacctgcaggagtttgtggctgatgtgaatgtgctgatggccctgatcatcaatggccccatcaagagcttctgctaccgccgcctgcagtacctgagcagcaagttccagatgcacgtgctgctgaatgagatgaaggagctggccgcccagaagaaggtgccccaccgggacttctacaacatcaggaaggtggacacccacatccacgccagcagctgcatgaaccagaagcacctgctgcgcttcatcaagagggccatgaagaggcacctggaggagatcgtgcacgtggagcagggccgggagcagaccctgcgggaggtgtttgagagcatgaacctgacagcctatgacctgtctgtggacaccctggatgtgcacgccgacaggaacaccttccacagatttgacaagttcaatgccaagtacaaccccatcggggagagcgtgctgcgggagatcttcatcaagacagacaacagagtgtctgggaagtactttgcccacatcatcaaggaggtgatgtctgacctggaggagagcaagtaccagaatgctgagctgcggctgagcatctacggccgcagcagagatgagtgggacaagctggcccgctgggccgtgatgcaccgggtgcacagccccaacgtgcgctggctggtgcaggtgccccggctgtttgatgtgtaccgcaccaagggccagctggccaacttccaggagatgctggagaacatcttcctgcccctgtttgaggccaccgtgcacccagccagccaccctgagctgcacctgttcctggagcacgtggatggctttgattctgtggatgatgagagcaagccagaaaatcatgtgttcaacctggagagccccctgcctgaggcctgggtggaggaggacaaccccccctatgcctactacctgtactacacctttgccaacatggccatgctgaaccacctgcggcggcagaggggcttccacacctttgtgctgcggccccactgtggggaggccggccccatccaccacctggtgtctgccttcatgctggccgagaacatcagccacggcctgctgctgaggaaggcccctgtgctgcagtacctgtactacctggcccagattggaattgccatgagccccctgagcaacaacagcctcttcctgagctaccacaggaaccccctgcctgagtacctgagccggggcctgatggtgtccctgagcacagatgaccccctgcagttccacttcaccaaggagcccctgatggaggagtacagcatcgccacccaggtgtggaagctgagcagctgtgacatgtgtgagctggccaggaacagcgtgctgatgagcggcttcagccacaaggtgaagagccactggctgggccccaactacaccaaggagggccctgagggcaatgacatccggaggaccaacgtgcctgacatccgggtgggctaccgctatgagaccctgtgccaggagctggccctgatcacccaggccgtgcagagcgagatgctggagaccatccctgaggaggccggcatcaccatgagccctggcccccagtag

SEQ ID NO: 142858 - DNA, 6 bp, Artificial Sequence
  Description of Artificial Sequence: Synthetic coding sequence
atgtag

SEQ ID NO: 142859 - DNA, 2640 bp, Artificial Sequence; identical to SEQ ID NO: 142854
  Description of Artificial Sequence: Synthetic coding sequence

SEQ ID NO: 142860 - DNA, 312 bp, Artificial Sequence
  Description of Artificial Sequence: Synthetic coding sequence
atggccagcgaggcccggggcggcctgggcgccccacccctgcagagcgcccggagcctgcccggccctgccccctgcctgaagcacttccccctggacctgcggacctccatggatggcaagtgcaaggagattgctgaggagctgttcaccaggagcctggccgagagcgagctgcggagcgccccctatgagttccctgaggagagccccatcgagcagctggaggagcggcggcagaggctggagcggcagatcagccaggatgtgaagctggagccagacatcctgctgcgggccaagcaggactag

SEQ ID NO: 142861 - DNA, 2304 bp, Artificial Sequence
  Description of Artificial Sequence: Synthetic coding sequence
atgccccggcagttccccaagctgaacatcagcgaggtggatgagcaggtgcggctgctggccgagaaggtgtttgccaaggtgctgcgggaggaggacagcaaggatgccctgagcctcttcaccgtgcctgaggactgccccatcggccagaaggaggccaaggagcgggagctgcagaaggagctggccgagcagaagtctgtggagacagccaagaggaagaagagcttcaagatgatccgcagccagagcctgagcctgcagatgccaccccagcaggactggaagggccccccagctgccagccctgccatgagccccaccacccctgtggtgactggagccaccagcctgcccaccccagccccctatgccatgcctgagttccagagggtgaccatcagcggggactactgtgccggcatcaccctggaggactatgagcaggccgccaagagcctggccaaggccctgatgatccgggagaagtatgcccggctggcctaccaccgcttcccccgcatcaccagccagtacctgggccaccccagggctgacacagcccctcctgaggagggcctgcctgacttccaccccccacccctgccccaggaggacccctactgcctggatgatgccccacccaacctggactacctggtgcacatgcagggcggcatcctgtttgtgtatgacaacaagaagatgctggagcaccaggagccccacagcctgccctacccagacctggagacctacacagtggacatgagccacatcctggccctgatcacagatggccccaccaagacctactgccaccggcggctgaacttcctggagagcaagttcagcctgcacgagatgctgaatgagatgtctgagttcaaggagctgaagagcaacccccaccgggacttctacaacgtgaggaaggtggacacccacatccacgccgccgcctgcatgaaccagaagcacctgctgcgcttcatcaagcacacctaccagacagagccagacagaacagtggccgagaagaggggcaggaagatcaccctgcggcaggtgtttgatggcctgcacatggacccctatgacctgactgtggacagcctggatgtgcacgccggccggcagaccttccacagatttgacaagttcaacagcaagtacaaccctgtgggcgccagcgagctgcgggacctgtacctgaagacagagaactacctgggcggggagtactttgccaggatggtgaaggaggtggcccgggagctggaggagagcaagtaccagtacagcgagccccggctgagcatctacggccgcagccctgaggagtggcccaacctggcctactggttcatccagcacaaggtgtacagccccaacatgcgctggatcatccaggtgccccgcatctatgacatcttccgcagcaagaagctgctgcccaactttgggaagatgctggagaacatcttcctgcccctcttcaaggccaccatcaacccccaggaccaccgggagctgcacctgttcctgaagtatgtgactggatttgattctgtggatgatgagagcaagcacagcgaccacatgttcagtgacaagagccccaacccagatgtgtggaccagcgagcagaaccccccctacagctactacctgtactacatgtatgccaacatcatggtgctgaacaacctgcggcgggagcggggcctgagcaccttcctgttccggccccactgtggggaggccggcagcatcacccacctggtgtctgccttcctgacagctgacaacatcagccacggcctgctgctgaagaagagccctgtgctgcagtacctgtactacctggcccagatccccatcgccatgagccccctgagcaacaacagcctcttcctggagtacagcaagaaccccctgcgggagttcctgcacaagggcctgcacgtgtccctgagcacagatgaccccatgcagttccactacaccaaggaggccctgatggaggagtatgccatcgccgcccaggtgtggaagctgagcacctgtgacctgtgtgagatcgccaggaacagcgtgctgcagagcggcctgagccaccaggagaagcagaagttcctgggccagaactactacaaggagggccctgagggcaatgacatcaggaagaccaacgtggcccagatccgcatggccttccgctatgagaccctgtgcaatgagctgtccttcctgagtgatgccatgaagtctgaggagatcacagccctgaccaactag

SEQ ID NO: 142862 - DNA, 2331 bp, Artificial Sequence
  Description of Artificial Sequence: Synthetic coding sequence
atggccctgagcagcgagcctgctgagatgccccggcagttccccaagctgaacatcagcgaggtggatgagcaggtgcggctgctggccgagaaggtgtttgccaaggtgctgcgggaggaggacagcaaggatgccctgagcctcttcaccgtgcctgaggactgccccatcggccagaaggaggccaaggagcgggagctgcagaaggagctggccgagcagaagtctgtggagacagccaagaggaagaagagcttcaagatgatccgcagccagagcctgagcctgcagatgccaccccagcaggactggaagggccccccagctgccagccctgccatgagccccaccacccctgtggtgactggagccaccagcctgcccaccccagccccctatgccatgcctgagttccagagggtgaccatcagcggggactactgtgccggcatcaccctggaggactatgagcaggccgccaagagcctggccaaggccctgatgatccgggagaagtatgcccggctggcctaccaccgcttcccccgcatcaccagccagtacctgggccaccccagggctgacacagcccctcctgaggagggcctgcctgacttccaccccccacccctgccccaggaggacccctactgcctggatgatgccccacccaacctggactacctggtgcacatgcagggcggcatcctgtttgtgtatgacaacaagaagatgctggagcaccaggagccccacagcctgccctacccagacctggagacctacacagtggacatgagccacatcctggccctgatcacagatggccccaccaagacctactgccaccggcggctgaacttcctggagagcaagttcagcctgcacgagatgctgaatgagatgtctgagttcaaggagctgaagagcaacccccaccgggacttctacaacgtgaggaaggtggacacccacatccatgctgctgcctgcatgaaccagaagcacctgctgcgcttcatcaagcacacctaccagacagagccagacagaacagtggccgagaagaggggcaggaagatcaccctgcggcaggtgtttgatggcctgcacatggacccctatgacctgactgtggacagcctggatgtgcatgctggccggcagaccttccacagatttgacaagttcaacagcaagtacaaccctgtgggcgccagcgagctgcgggacctgtacctgaagacagagaactacctgggcggggagtactttgccaggatggtgaaggaggtggcccgggagctggaggagagcaagtaccagtacagcgagccccggctgagcatctacggccgcagccctgaggagtggcccaacctggcctactggttcatccagcacaaggtgtacagccccaacatgcgctggatcatccaggtgccccgcatctatgacatcttccgcagcaagaagctgctgcccaactttgggaagatgctggagaacatcttcctgcccctcttcaaggccaccatcaacccccaggaccaccgggagctgcacctgttcctgaagtatgtgacaggctttgacagcgtggatgatgagagcaagcacagcgaccacatgttcagtgacaagagccccaacccagatgtgtggaccagcgagcagaaccccccctacagctactacctgtactacatgtatgccaacatcatggtgctgaacaacctgcggcgggagcggggcctgagcaccttcctgttccggccccactgtggggaggccggcagcatcacccacctggtgtctgccttcctgacagctgacaacatcagccacggcctgctgctgaagaagagccctgtgctgcagtacctgtactacctggcccagatccccatcgccatgagccccctgagcaacaacagcctcttcctggagtacagcaagaaccccctgcgggagttcctgcacaagggcctgcacgtgtccctgagcacagatgaccccatgcagttccactacaccaaggaggccctgatggaggagtatgccatcgccgcccaggtgtggaagctgagcacctgtgacctgtgtgaaattgccagaaattctgtgctgcagagcggcctgagccaccaggagaagcagaagttcctgggccagaactactacaaggagggccctgagggcaatgacatcaggaagaccaacgtggcccagatccgcatggccttccgctatgagaccctgtgcaatgagctgtccttcctgagtgatgccatgaagtctgaggagatcacagccctgaccaactag

SEQ ID NO: 142863 - DNA, 1827 bp, Artificial Sequence
  Description of Artificial Sequence: Synthetic coding sequence
atgatccgggagaagtatgcccggctggcctaccaccgcttcccccgcatcaccagccagtacctgggccaccccagggctgacacagcccctcctgaggagggcctgcctgacttccaccccccacccctgccccaggaggacccctactgcctggatgatgccccacccaacctggactacctggtgcacatgcagggcggcatcctgtttgtgtatgacaacaagaagatgctggagcaccaggagccccacagcctgccctacccagacctggagacctacacagtggacatgagccacatcctggccctgatcacagatggccccaccaagacctactgccaccggcggctgaacttcctggagagcaagttcagcctgcacgagatgctgaatgagatgtctgagttcaaggagctgaagagcaacccccaccgggacttctacaacgtgaggaaggtggacacccacatccatgctgctgcctgcatgaaccagaagcacctgctgcgcttcatcaagcacacctaccagacagagccagacagaacagtggccgagaagaggggcaggaagatcaccctgcggcaggtgtttgatggcctgcacatggacccctatgacctgactgtggacagcctggatgtgcatgctggccggcagaccttccacagatttgacaagttcaacagcaagtacaaccctgtgggcgccagcgagctgcgggacctgtacctgaagacagagaactacctgggcggggagtactttgccaggatggtgaaggaggtggcccgggagctggaggagagcaagtaccagtacagcgagccccggctgagcatctacggccgcagccctgaggagtggcccaacctggcctactggttcatccagcacaaggtgtacagccccaacatgcgctggatcatccaggtgccccgcatctatgacatcttccgcagcaagaagctgctgcccaactttgggaagatgctggagaacatcttcctgcccctcttcaaggccaccatcaacccccaggaccaccgggagctgcacctgttcctgaagtatgtgacaggctttgacagcgtggatgatgagagcaagcacagcgaccacatgttcagtgacaagagccccaacccagatgtgtggaccagcgagcagaaccccccctacagctactacctgtactacatgtatgccaacatcatggtgctgaacaacctgcggcgggagcggggcctgagcaccttcctgttccggccccactgtggggaggccggcagcatcacccacctggtgtctgccttcctgacagctgacaacatcagccacggcctgctgctgaagaagagccctgtgctgcagtacctgtactacctggcccagatccccatcgccatgagccccctgagcaacaacagcctcttcctggagtacagcaagaaccccctgcgggagttcctgcacaagggcctgcacgtgtccctgagcacagatgaccccatgcagttccactacaccaaggaggccctgatggaggagtatgccatcgccgcccaggtgtggaagctgagcacctgtgacctgtgtgaaattgccagaaattctgtgctgcagagcggcctgagccaccaggagaagcagaagttcctgggccagaactactacaaggagggccctgagggcaatgacatcaggaagaccaacgtggcccagatccgcatggccttccgctatgagaccctgtgcaatgagctgtccttcctgagtgatgccatgaagtctgaggagatcacagccctgaccaactag

SEQ ID NO: 142864 - DNA, 804 bp, Artificial Sequence
  Description of Artificial Sequence: Synthetic coding sequence
atgccccggcagttccccaagctgaacatcagcgaggtggatgagcaggtgcggctgctggccgagaaggtgtttgccaaggtgctgcgggaggaggacagcaaggatgccctgagcctcttcaccgtgcctgaggactgccccatcggccagaaggaggccaaggagcgggagctgcagaaggagctggccgagcagaagtctgtggagacagccaagaggaagaagagcttcaagatgatccgcagccagagcctgagcctgcagatgccaccccagcaggactggaagggccccccagctgccagccctgccatgagccccaccacccctgtggtgactggagccaccagcctgcccaccccagccccctatgccatgcctgagttccagagggtgaccatcagcggggactactgtgccggcatcaccctggaggactatgagcaggccgccaagagcctggccaaggccctgatgatccgggagaagtatgcccggctggcctaccaccgcttcccccgcatcaccagccagtacctgggccaccccagggctgacacagcccctcctgaggagggcctgcctgacttccaccccccacccctgccccaggaggacccctactgcctggatgatgccccacccaacctggactacctggtgcacatgcagggcggcatcctgtttgtgtatgacaacaagaagatgctggagcaccaggagccccacagcctgccctacccagacctggagacctacacagtggacatgagccacatcctggccctgatcacagactag

SEQ ID NO: 142865 - DNA, 2325 bp, Artificial Sequence
  Description of Artificial Sequence: Synthetic coding sequence
atggagcccggcagcgctgagatgccccggcagttccccaagctgaacatcagcgaggtggatgagcaggtgcggctgctggccgagaaggtgtttgccaaggtgctgcgggaggaggacagcaaggatgccctgagcctcttcaccgtgcctgaggactgccccatcggccagaaggaggccaaggagcgggagctgcagaaggagctggccgagcagaagtctgtggagacagccaagaggaagaagagcttcaagatgatccgcagccagagcctgagcctgcagatgccaccccagcaggactggaagggccccccagctgccagccctgccatgagccccaccacccctgtggtgactggagccaccagcctgcccaccccagccccctatgccatgcctgagttccagagggtgaccatcagcggggactactgtgccggcatcaccctggaggactatgagcaggccgccaagagcctggccaaggccctgatgatccgggagaagtatgcccggctggcctaccaccgcttcccccgcatcaccagccagtacctgggccaccccagggctgacacagcccctcctgaggagggcctgcctgacttccaccccccacccctgccccaggaggacccctactgcctggatgatgccccacccaacctggactacctggtgcacatgcagggcggcatcctgtttgtgtatgacaacaagaagatgctggagcaccaggagccccacagcctgccctacccagacctggagacctacacagtggacatgagccacatcctggccctgatcacagatggccccaccaagacctactgccaccggcggctgaacttcctggagagcaagttcagcctgcacgagatgctgaatgagatgtctgagttcaaggagctgaagagcaacccccaccgggacttctacaacgtgaggaaggtggacacccacatccatgctgctgcctgcatgaaccagaagcacctgctgcgcttcatcaagcacacctaccagacagagccagacagaacagtggccgagaagaggggcaggaagatcaccctgcggcaggtgtttgatggcctgcacatggacccctatgacctgactgtggacagcctggatgtgcatgctggccggcagaccttccacagatttgacaagttcaacagcaagtacaaccctgtgggcgccagcgagctgcgggacctgtacctgaagacagagaactacctgggcggggagtactttgccaggatggtgaaggaggtggcccgggagctggaggagagcaagtaccagtacagcgagccccggctgagcatctacggccgcagccctgaggagtggcccaacctggcctactggttcatccagcacaaggtgtacagccccaacatgcgctggatcatccaggtgccccgcatctatgacatcttccgcagcaagaagctgctgcccaactttgggaagatgctggagaacatcttcctgcccctcttcaaggccaccatcaacccccaggaccaccgggagctgcacctgttcctgaagtatgtgacaggctttgacagcgtggatgatgagagcaagcacagcgaccacatgttcagtgacaagagccccaacccagatgtgtggaccagcgagcagaaccccccctacagctactacctgtactacatgtatgccaacatcatggtgctgaacaacctgcggcgggagcggggcctgagcaccttcctgttccggccccactgtggggaggccggcagcatcacccacctggtgtctgccttcctgacagctgacaacatcagccacggcctgctgctgaagaagagccctgtgctgcagtacctgtactacctggcccagatccccatcgccatgagccccctgagcaacaacagcctcttcctggagtacagcaagaaccccctgcgggagttcctgcacaagggcctgcacgtgtccctgagcacagatgaccccatgcagttccactacaccaaggaggccctgatggaggagtatgccatcgccgcccaggtgtggaagctgagcacctgtgacctgtgtgaaattgccagaaattctgtgctgcagagcggcctgagccaccaggagaagcagaagttcctgggccagaactactacaaggagggccctgagggcaatgacatcaggaagaccaacgtggcccagatccgcatggccttccgctatgagaccctgtgcaatgagctgtccttcctgagtgatgccatgaagtctgaggagatcacagccctgaccaactag

SEQ ID NO: 142866 - DNA, 2304 bp, Artificial Sequence; identical to SEQ ID NO: 142861
  Description of Artificial Sequence: Synthetic coding sequence

SEQ ID NO: 142867 - DNA, 336 bp, Artificial Sequence
  Description of Artificial Sequence: Synthetic coding sequence
atgccccggcagttccccaagctgaacatcagcgaggtggatgagcaggtgcggctgctggccgagaaggtgtttgccaaggtgctgcgggaggaggacagcaaggatgccctgagcctcttcaccgtgcctgaggactgccccatcggccagaaggaggccaaggagcgggagctgcagaaggagctggccgagcagaagtctgtggagacagccaagaggaagaagagcttcaagatgatccgcagccagagcctgagcctgcagatgccaccccagcaggactggaagggccccccagctgccagccctgccatgagccccaccaccccctag

SEQ ID NO: 142868 - DNA, 426 bp, Artificial Sequence
  Description of Artificial Sequence: Synthetic coding sequence
atggcccggcccctgtgcaccctgctgctgctgatggccaccctggccggggccctggccagcagcagcaaggaggagaaccgcatcatccctgggggcatctatgatgctgacctgaatgatgagtgggtgcagagggccctgcactttgccatcagcgagtacaacaaggccacagaagatgagtactacagaagacccctgcaggtgctgcgggcccgggagcagaccttcggcggcgtgaactacttctttgatgtggaggtgggccgcaccatctgcaccaagagccagcccaacctggacacctgtgccttccacgagcagcctgagctgcagaagaagcagctgtgcagctttgagatctatgaggtgccctgggaggacaggatgagcctggtgaacagccgctgccaggaggcctag

SEQ ID NO: 142869 - DNA, 1215 bp, Artificial Sequence
  Description of Artificial Sequence: Synthetic coding sequence
atgcctggcctgatgaggatgagggagcgctacagcgccagcaagcccctgaagggggccagaattgctggctgcctgcacatgacagtggagacagctgtgctgattgagaccctggtgaccctgggcgctgaggtgcagtggagcagctgcaacatcttcagcacccaggaccacgccgccgccgccatcgccaaggccggcatccctgtgtatgcctggaagggggagacagatgaggagtacctgtggtgcatcgagcagaccctgtacttcaaggatggccccctgaacatgatcctggatgatggaggagacctgaccaacctgatccacaccaagtacccccagctgctgcccggcatccggggcatcagcgaggagaccaccactggagtgcacaacctgtacaagatgatggccaacggcatcctgaaggtgcctgccatcaacgtgaatgattctgtgaccaagagcaagtttgacaacctgtatggctgccgggagagcctgattgatggcatcaagagggccacagatgtgatgattgctgggaaggtggccgtggtggccggctatggagatgtgggcaagggctgtgcccaggccctgcggggctttggagcccgggtcatcatcacagaaattgaccccatcaatgccctgcaggccgccatggagggctatgaggtgaccaccatggatgaggcctgccaggagggcaacatctttgtgaccaccaccggctgcatcgacatcatcctgggccgccactttgagcagatgaaggatgatgccatcgtgtgcaacatcggccactttgatgtggagattgatgtgaagtggctgaatgaaaatgctgtggagaaggtgaacatcaagccccaggtggaccgctaccgcctgaagaatggccgccgcatcatcctgctggccgagggccgcctggtgaacctgggctgtgccatgggccaccccagctttgtgatgagcaacagcttcaccaaccaggtgatggcccagatcgagctgtggacccacccagacaagtaccctgtgggcgtgcacttcctgcccaagaagctggatgaagctgtggccgaggcccacctgggcaagctgaatgtgaagctgaccaagctgacagagaagcaggcccagtacctgggcatgagctgtgatggccccttcaagccagaccactaccgctactag

SEQ ID NO: 142870 - DNA, 798 bp, Artificial Sequence
  Description of Artificial Sequence: Synthetic coding sequence
atgtttgtgtccaagaggcgcttcatcctgaagacctgtggcaccaccctgctgctgaaggccctggtgcccctgctgaagctggcccgggactacagcggctttgacagcatccagagcttcttctacagcaggaagaacttcatgaagcccagccaccagggctacccccacaggaacttccaggaggagattgagttcctgaatgccatcttccccaacggggccgcctactgcatgggccgcatgaacagcgactgctggtacctgtacaccctggacttccctgagagcagggtcatcagccagcctgaccagaccctggagatcctgatgtctgagctggaccctgctgtgatggaccagttctacatgaaggatggagtgacagccaaggatgtgacccgggagagcggcatccgggacctgatccctggctctgtgattgatgccaccatgttcaacccctgtggctacagcatgaatggcatgaagagtgatggcacctactggaccatccacatcaccccagagcctgagttctcctatgtgtcctttgagaccaacctgagccagaccagctatgatgacctgatcaggaaggtggtggaggtgttcaagccaggcaagtttgtgaccaccctgtttgtgaaccagagcagcaagtgcaggacagtgctggccagcccccagaagattgagggcttcaagaggctggactgccagagcgccatgtttaatgactacaactttgtgttcaccagctttgccaagaagcagcagcagcagcagagctag

SEQ ID NO: 142871 - DNA, 918 bp, Artificial Sequence
  Description of Artificial Sequence: Synthetic coding sequence
atggaggccgcccacttctttgagggcacagagaagctgctggaggtgtggttcagccggcagcagccagatgccaaccagggcagcggggacctgcggaccatccccagcgagagctccatgtttgtgtccaagaggcgcttcatcctgaagacctgtggcaccaccctgctgctgaaggccctggtgcccctgctgaagctggcccgggactacagcggctttgacagcatccagagcttcttctacagcaggaagaacttcatgaagcccagccaccagggctacccccacaggaacttccaggaggagattgagttcctgaatgccatcttccccaacggggccgcctactgcatgggccgcatgaacagcgactgctggtacctgtacaccctggacttccctgagagcagggtcatcagccagcctgaccagaccctggagatcctgatgtctgagctggaccctgctgtgatggaccagttctacatgaaggatggagtgacagccaaggatgtgacccgggagagcggcatccgggacctgatccctggctctgtgattgatgccaccatgttcaacccctgtggctacagcatgaatggcatgaagagtgatggcacctactggaccatccacatcaccccagagcctgagttctcctatgtgtcctttgagaccaacctgagccagaccagctatgatgacctgatcaggaaggtggtggaggtgttcaagccaggcaagtttgtgaccaccctgtttgtgaaccagagcagcaagtgcaggacagtgctggccagcccccagaagattgagggcttcaagaggctggactgccagagcgccatgtttaatgactacaactttgtgttcaccagctttgccaagaagcagcagcagcagcagagctag

SEQ ID NO: 142872 - DNA, 561 bp, Artificial Sequence
  Description of Artificial Sequence: Synthetic coding sequence
atgggccgcatgaacagcgactgctggtacctgtacaccctggacttccctgagagcagggtcatcagccagcctgaccagaccctggagatcctgatgtctgagctggaccctgctgtgatggaccagttctacatgaaggatggagtgacagccaaggatgtgacccgggagagcggcatccgggacctgatccctggctctgtgattgatgccaccatgttcaacccctgtggctacagcatgaatggcatgaagagtgatggcacctactggaccatccacatcaccccagagcctgagttctcctatgtgtcctttgagaccaacctgagccagaccagctatgatgacctgatcaggaaggtggtggaggtgttcaagccaggcaagtttgtgaccaccctgtttgtgaaccagagcagcaaatgtagaacagtgctggccagcccccagaagattgagggcttcaagaggctggactgccagagcgccatgtttaatgactacaactttgtgttcaccagctttgccaagaagcagcagcagcagcagagctag

SEQ ID NO: 142873 - DNA, 1005 bp, Artificial Sequence
  Description of Artificial Sequence: Synthetic coding sequence
atggaggccgcccacttctttgagggcacagagaagctgctggaggtgtggttcagccggcagcagccagatgccaaccagggcagcggggacctgcggaccatccccaggtctgagtgggacatcctgctgaaggatgtgcagtgcagcatcatctctgtgaccaagacagacaagcaggaggcctacgtgctgtctgagagctccatgtttgtgtccaagaggcgcttcatcctgaagacctgtggcaccaccctgctgctgaaggccctggtgcccctgctgaagctggcccgggactacagcggctttgacagcatccagagcttcttctacagcaggaagaacttcatgaagcccagccaccagggctacccccacaggaacttccaggaggagattgagttcctgaatgccatcttccccaatggagctgcctactgcatgggccgcatgaacagcgactgctggtacctgtacaccctggacttccctgagagcagggtcatcagccagcctgaccagaccctggagatcctgatgtctgagctggaccctgctgtgatggaccagttctacatgaaggatggagtgacagccaaggatgtgacccgggagagcggcatccgggacctgatccctggctctgtgattgatgccaccatgttcaacccctgtggctacagcatgaatggcatgaagagtgatggcacctactggaccatccacatcaccccagagcctgagttctcctatgtgtcctttgagaccaacctgagccagaccagctatgatgacctgatcaggaaggtggtggaggtgttcaagccaggcaagtttgtgaccaccctgtttgtgaaccagagcagcaaatgtagaacagtgctggccagcccccagaagattgagggcttcaagaggctggactgccagagcgccatgtttaatgactacaactttgtgttcaccagctttgccaagaagcagcagcagcagcagagctag

SEQ ID NO: 142874 - DNA, 645 bp, Artificial Sequence
  Description of Artificial Sequence: Synthetic coding sequence
atggaggccgcccacttctttgagggcacagagaagctgctggaggtgtggttcagccggcagcagccagatgccaaccagggcagcggggacctgcggaccatcccccgctacctgtacaccctggacttccctgagagcagggtcatcagccagcctgaccagaccctggagatcctgatgtctgagctggaccctgctgtgatggaccagttctacatgaaggatggagtgacagccaaggatgtgacccgggagagcggcatccgggacctgatccctggctctgtgattgatgccaccatgttcaacccctgtggctacagcatgaatggcatgaagagtgatggcacctactggaccatccacatcaccccagagcctgagttctcctatgtgtcctttgagaccaacctgagccagaccagctatgatgacctgatcaggaaggtggtggaggtgttcaagccaggcaagtttgtgaccaccctgtttgtgaaccagagcagcaaatgtagaacagtgctggccagcccccagaagattgagggcttcaagaggctggactgccagagcgccatgtttaatgactacaactttgtgttcaccagctttgccaagaagcagcagcagcagcagagctag

SEQ ID NO: 142875 - DNA, 3360 bp, Artificial Sequence
  Description of Artificial Sequence: Synthetic coding sequence
atggccggggccccccggggcggcggcggcggcggcggcggggccggggagcccggcggcgctgagagagctgctggcaccagcagaagaagaggcctgcgggcctgtgatgaggagtttgcctgcccagagctggaggccctcttccggggctacaccctgcggctggagcaggccgccaccctgaaggccctggccgtgctgagcctgctggccggggccctggccctggccgagctgctgggcgcccctggccctgcccctggcctggccaagggcagccaccctgtgcactgtgtgctcttcctggccctgctggtggtgaccaacgtgcgcagcctgcaggtgccccagctgcagcaggtgggccagctggccctgctcttcagcctgacctttgccctgctgtgctgcccctttgccctgggcggccctgcccggggcagcgctggagctgctgggggccctgccacagctgagcagggcgtgtggcagctgctgctggtgacctttgtgtcctatgccctgctgcctgtgcgcagcctgctggccatcggcttcggcctggtggtggccgccagccacctgctggtgacagccaccctggtgcctgccaagaggccccggctgtggaggaccctgggcgccaatgccctgctgtttgtgggcgtgaacatgtatggagtgtttgtgcgcatcctgacagagaggagccagaggaaggccttcctgcaggcccggagctgcattgaagatcggctgcggctggaggatgaaaatgagaagcaggagcggctgctgatgagcctgctgcccagaaatgtggccatggagatgaaggaggacttcctgaagcccccagagcgcatcttccacaagatctacatccagagacatgacaacgtgtccatcctgtttgctgacatcgtgggcttcaccggcctggccagccagtgcacagcccaggagctggtgaagctgctgaatgagctgtttgggaagtttgatgagctggccacagagaaccactgccgccgcatcaagatcctgggggactgctactactgtgtgtctggcctgacccagcccaagacagaccacgcccactgctgcgtggagatgggcctggacatgattgacaccatcacctctgtggccgaggccacagaggtggacctgaacatgagggtgggcctgcacacaggccgggtgctgtgtggggtgctgggcctgaggaagtggcagtatgatgtgtggagcaatgatgtgaccctggccaacgtgatggaggccgccggcctgcccgggaaggtgcacatcaccaagaccaccctggcctgcctgaatggagactatgaggtggagcccggctacggccacgagaggaacagcttcctgaagacccacaacatcgagaccttcttcatcgtgcccagccacaggaggaagatcttccctggcctcatcctgagtgacatcaagccagccaagaggatgaagttcaagacagtgtgctacctgctggtgcagctgatgcactgcaggaagatgttcaaggccgagatccccttcagcaatgtgatgacctgtgaagatgatgacaagaggcgggccctgaggacagccagcgagaagctgaggaacagaagcagcttcagcaccaacgtggtgtacaccaccccaggcaccagggtgaaccgctacatcagccggctgctggaggcccggcagacagagctggagatggctgacctgaacttcttcaccctgaagtacaagcacgtggagcgggagcagaagtaccaccagctgcaggatgagtacttcaccagcgctgtggtgctgaccctcatcctggccgccctgtttggcctggtgtacctgctgatcttcccccagagcgtggtggtgctgctgctgctggtgttctgcatctgcttcctggtggcctgtgtgctgtacctgcacatcaccagggtgcagtgcttccctggctgcctgaccatccagatcagaacagtgctgtgcatcttcatcgtggtgctgatctacagcgtggcccagggctgtgtggtgggctgcctgccctgggcctggagcagcaagcccaacagcagcctggtggtgctgagcagcggcggccagaggacagccctgcccaccctgccctgtgagagcacccaccacgccctgctgtgctgcctggtgggcaccctgcccctggccatcttcttccgggtgagcagcctgcccaagatgatcctgctgagcggcctgaccaccagctacatcctggtgctggagctgagcggctacaccaggactggaggcggcgctgtgtctggccgctcctatgagcccatcgtggccatcctgctcttcagctgtgccctggccctgcacgcccggcaggtggacatccggctgcggctggactacctgtgggccgcccaggccgaggaggagcgggaggacatggagaaggtgaagctggacaacagacgcatcctcttcaacctgctgcctgcccacgtggcccagcacttcctgatgagcaaccccaggaacatggacctgtactaccagagctacagccaggtgggcgtgatgtttgccagcatccccaacttcaatgacttctacatcgagctggatggcaacaacatgggcgtggagtgcctgcggctgctgaatgagatcatcgctgactttgatgagctgatggagaaggacttctacaaggacatcgagaagatcaagaccatcggcagcacctacatggctgctgtgggcctggcccccaccagcggcaccaaggccaagaagagcatcagcagccacctgagcaccctggccgactttgccatcgagatgtttgatgtgctggatgagatcaactaccagagctacaatgactttgtgctgcgggtgggcatcaacgtgggccctgtggtggccggcgtgattggagcccggcggccccagtatgacatctggggcaacacagtgaatgtggccagcaggatggacagcactggagtgcagggccgcatccaggtgacagaggaggtgcaccggctgctgcggcgctgcccctaccactttgtgtgccggggcaaggtgtctgtgaagggcaagggggagatgctgacctacttcctggagggccgcacagatggaaatggcagccagatccgcagcctgggcctggacaggaagatgtgccccttcggccgggccggcctgcagggcagaagacctcctgtgtgccccatgcctggggtgtctgtgcgggccggcctgcccccccacagccctggccagtacctgcccagcgctgctgctgggaaggaggcctag

SEQ ID NO: 142876 - DNA, 3174 bp, Artificial Sequence
  Description of Artificial Sequence: Synthetic coding sequence
atggccggggccccccggggcggcggcggcggcggcggcggggccggggagcccggcggcgctgagagagctgctggcaccagcagaagaagaggcctgcgggcctgtgatgaggagtttgcctgcccagagctggaggccctcttccggggctacaccctgcggctggagcaggccgccaccctgaaggccctggccgtgctgagcctgctggccggggccctggccctggccgagctgctgggcgcccctggccctgcccctggcctggccaagggcagccaccctgtgcactgtgtgctcttcctggccctgctggtggtgaccaacgtgcgcagcctgcaggtgccccagctgcagcaggtgggccagctggccctgctcttcagcctgacctttgccctgctgtgctgcccctttgccctgggcggccctgcccggggcagcgctggagctgctgggggccctgccacagctgagcagggcgtgtggcagctgctgctggtgacctttgtgtcctatgccctgctgcctgtgcgcagcctgctggccatcggcttcggcctggtggtggccgccagccacctgctggtgacagccaccctggtgcctgccaagaggccccggctgtggaggaccctgggcgccaatgccctgctgtttgtgggcgtgaacatgtatggagtgtttgtgcgcatcctgacagagaggagccagaggaaggccttcctgcaggcccggagctgcattgaagatcggctgcggctggaggatgaaaatgagaagcaggagcggctgctgatgagcctgctgcccagaaatgtggccatggagatgaaggaggacttcctgaagcccccagagcgcatcttccacaagatctacatccagagacatgacaacgtgtccatcctgtttgctgacatcgtgggcttcaccggcctggccagccagtgcacagcccaggagctggtgaagctgctgaatgagctgtttgggaagtttgatgagctggccacagagaaccactgccgccgcatcaagatcctgggggactgctactactgtgtgtctggcctgacccagcccaagacagaccacgcccactgctgcgtggagatgggcctggacatgattgacaccatcacctctgtggccgaggccacagaggtggacctgaacatgagggtgggcctgcacacaggccgggtgctgtgtggggtgctgggcctgaggaagtggcagtatgatgtgtggagcaatgatgtgaccctggccaacgtgatggaggccgccggcctgcccgggaaggtgcacatcaccaagaccaccctggcctgcctgaatggagactatgaggtggagcccggctacggccacgagaggaacagcttcctgaagacccacaacatcgagaccttcttcatcgtgcccagccacaggaggaagatcttccctggcctcatcctgagtgacatcaagccagccaagaggatgaagttcaagacagtgtgctacctgctggtgcagctgatgcactgcaggaagatgttcaaggccgagatccccttcagcaatgtgatgacctgtgaagatgatgacaagaggcgggccctgaggacagccagcgagaagctgaggaacagaagcagcttcagcaccaacgtggtgtacaccaccccaggcaccagggtgaaccgctacatcagccggctgctggaggcccggcagacagagctggagatggctgacctgaacttcttcaccctgaagtacaagcacgtggagcgggagcagaagtaccaccagctgcaggatgagtacttcaccagcgctgtggtgctgaccctcatcctggccgccctgtttggcctggtgtacctgctgatcttcccccagagcgtggtggtgctgctgctgctggtgttctgcatctgcttcctggtggcctgtgtgctgtacctgcacatcaccagggtgcagtgcttccctggctgcctgaccatccagatcagaacagtgctgtgcatcttcatcgtggtgctgatctacagcgtggcccagggctgtgtggtgggctgcctgccctgggcctggagcagcaagcccaacagcagcctggtggtgctgagcagcggcggccagaggacagccctgcccaccctgccctgtgagagcacccaccacgccctgctgtgctgcctggtgggcaccctgcccctggccatcttcttccgggtgagcagcctgcccaagatgatcctgctgagcggcctgaccaccagctacatcctggtgctggagctgagcggctacaccaggactggaggcggcgctgtgtctggccgctcctatgagcccatcgtggccatcctgctcttcagctgtgccctggccctgcacgcccggcaggtggacatccggctgcggctggactacctgtgggccgcccaggccgaggaggagcgggaggacatggagaaggtgaagctggacaacagacgcatcctcttcaacctgctgcctgcccacgtggcccagcacttcctgatgagcaaccccaggaacatggacctgtactaccagagctacagccaggtgggcgtgatgtttgccagcatccccaacttcaatgacttctacatcgagctggatggcaacaacatgggcgtggagtgcctgcggctgctgaatgagatcatcgctgactttgatgagctgatggagaaggacttctacaaggacatcgagaagatcaagaccatcggcagcacctacatggctgctgtgggcctggcccccaccagcggcaccaaggccaagaagagcatcagcagccacctgagcaccctggccgactttgccatcgagatgtttgatgtgctggatgagatcaactaccagagctacaatgactttgtgctgcgggtgggcatcaacgtgggccctgtggtggccggcgtgattggagcccggcggccccagtatgacatctggggcaacacagtgaatgtggccagcaggatggacagcactggagtgcagggccgcatccaggtgacagaggaggtgcaccggctgctgcggcgctgcccccccctgtgtgtgccccggcagagccagtgccagggccagaggagagatgtggacatcctgagccggcggcaggactag

SEQ ID NO: 142877 - DNA, 3276 bp, Artificial Sequence
  Description of Artificial Sequence: Synthetic coding sequence
atgtggcaggaggccatgagaagaagacgctacctgcgggacagaagtgaggaggccgccggcggcggagatggcctgcccaggagccgggactggctgtatgagagctactactgcatgagccagcagcaccccctgattgtgttcctgctgctgattgtgatgggcagctgcctggccctgctggccgtgttctttgccctgggcctggaggtggaggaccacgtggccttcctgatcaccgtgcccacagccctggccatcttctttgccatcttcatcctggtgtgcatcgagagcgtcttcaagaagctgctgcggctcttcagcctggtgatctggatctgcctggtggccatgggctacctgttcatgtgctttggaggcaccgtgagcccctgggaccaggtgtccttcttcctgttcatcatctttgtggtgtacaccatgctgcccttcaacatgagagatgccatcatcgcctctgtgctgaccagcagcagccacaccatcgtgctgtctgtgtgcctgagcgccaccccaggcggcaaggagcacctggtgtggcagatcctggccaacgtcatcatcttcatctgtggcaacctggccggggcctaccacaagcacctgatggagctggccctgcagcagacctaccaggacacctgcaactgcatcaagagccgcatcaagctggagtttgagaagaggcagcaggagcggctgctgctgagcctgctgcctgcccacatcgccatggagatgaaggccgagatcatccagaggctgcagggccccaaggccggccagatggagaacaccaacaacttccacaacctgtatgtgaagaggcacaccaacgtgtccatcctgtatgctgacatcgtgggcttcacccggctggccagtgactgcagccctggagagctggtgcacatgctgaatgagctgtttgggaagtttgaccagatcgccaaggaaaatgaatgcatgaggatcaagatcctgggggactgctactactgtgtgtctggcctgcccatcagcctgcccaaccacgccaagaactgtgtgaagatgggcctggacatgtgtgaggccatcaagaaggtgagagatgccaccggggtggacatcaacatgagggtgggcgtgcacagcggaaatgtgctgtgtggggtcatcggcctgcagaagtggcagtatgatgtgtggagccatgatgtgaccctggccaaccacatggaggccggcggcgtgcccggccgggtgcacatcagctctgtgaccctggagcacctgaatggagcctacaaggtggaggagggagatggagacatccgggacccctacctgaagcagcacctggtgaagacctacttcgtcatcaaccccaagggggagcggcgcagcccccagcacctgttccggcccaggcacaccctggatggagccaagatgagggcctctgtgaggatgacccgctacctggagagctggggcgccgccaagccctttgcccacctgcaccaccgggacagcatgaccacagaaaatggcaagatcagcaccacagatgtgcccatgggccagcacaacttccagaacagaaccctgcggaccaagagccagaagaagagatttgaggaggagctgaatgaaagaatgatccaggccattgatggcatcaatgcccagaagcagtggctgaagtctgaggacatccagaggatcagcctgctcttctacaacaaggtgctggagaaggagtaccgggccacagccctgcctgccttcaagtactacgtgacctgtgcctgcctgatcttcttctgcatcttcatcgtgcagatcctggtgctgcccaagacctctgtgctgggcatcagctttggagctgccttcctgctgctggccttcatcctgtttgtgtgctttgctggccagctgctgcagtgcagcaagaaggccagccccctgctgatgtggctgctgaagagcagcggcatcatcgccaaccggccctggccccgcatcagcctgaccatcatcaccacagccatcatcctgatgatggctgtgttcaacatgttcttcctgagtgacagcgaggagaccatccccccaacagccaacaccaccaacaccagcttcagcgccagcaacaaccaggtggccatcctgcgggcccagaacctcttcttcctgccctacttcatctacagctgcatcctgggcctcatcagctgcagcgtcttcctgcgggtgaactatgagctgaagatgctgatcatgatggtggccctggtgggctacaacaccatcctgctgcacacccacgcccacgtgctgggggactacagccaggtgctgtttgagcggcccggcatctggaaggacctgaagaccatgggctctgtgtccctgagcatcttcttcatcaccctgctggtgctgggccggcagaatgagtactactgccgcctggacttcctgtggaagaacaagttcaagaaggagcgggaggagattgagaccatggagaacctgaacagagtgctgctggagaatgtgctgcctgcccacgtggccgagcacttcctggcccggagcctgaagaatgaggagctgtaccaccagagctatgactgtgtgtgtgtgatgtttgccagcatcccagacttcaaggagttctacacagaaagtgatgtgaacaaggagggcctggagtgcctgcggctgctgaatgagatcatcgctgactttgatgacctgctgagcaagcccaagttctctggagtggagaagatcaagaccatcggcagcacctacatggccgccaccggcctgtctgctgtgcccagccaggagcacagccaggagcctgagcggcagtacatgcacatcggcaccatggtggagtttgcctttgccctggtgggcaagctggatgccatcaacaagcacagcttcaatgacttcaagctgcgggtgggcatcaaccacggccctgtgattgctggggtgattggagcccagaagccccagtatgacatctggggcaacacagtgaatgtggccagcaggatggacagcactggagtgctggacaagatccaggtgacagaggagaccagcctggtgctgcagaccctgggctacacctgcacctgccggggcatcatcaacgtgaagggcaagggggacctgaagacctactttgtgaacacagagatgagccgcagcctgagccagagcaatgtggccagctag

SEQ ID NO: 142878 - DNA, 612 bp, Artificial Sequence
  Description of Artificial Sequence: Synthetic coding sequence
atggagaacctgaacagagtgctgctggagaatgtgctgcctgcccacgtggccgagcacttcctggcccggagcctgaagaatgaggagctgtaccaccagagctatgactgtgtgtgtgtgatgtttgccagcatcccagacttcaaggagttctacacagaaagtgatgtgaacaaggagggcctggagtgcctgcggctgctgaatgagatcatcgctgactttgatgacctgctgagcaagcccaagttcagcggcgtggagaagatcaagaccatcggcagcacctacatggccgccaccggcctgtctgctgtgcccagccaggagcacagccaggagcctgagcggcagtacatgcacatcggcaccatggtggagtttgcctttgccctggtgggcaagctggatgccatcaacaagcacagcttcaatgacttcaagctgcgggtgggcgtgacagaggagaccagcctggtgctgcagaccctgggctacacctgcacctgccggggcatcatcaacgtgaagggcaagggggacctgaagacctactttgtgaacacagagatgagccgcagcctgagccagagcaatgtggccagctag

SEQ ID NO: 142879 - DNA, 2736 bp, Artificial Sequence
  Description of Artificial Sequence: Synthetic coding sequence
atggacctgcgctgggcccgggacctgcacctgcgggaggccagccgctctgtggccttcaccaccctgcggctgggcgctgtgaccaccggcctgctgaccttccgggagcccggggacaaggagaagagcggcaagggcctgggcaagcgctggaggatccagcgggaggagagccaggagcggctgctgctgagcctgctgcctgcccacatcgccatggagatgaaggccgagatcatccagaggctgcagggccccaaggccggccagatggagaacaccaacaacttccacaacctgtatgtgaagaggcacaccaacgtgtccatcctgtatgctgacatcgtgggcttcacccggctggccagtgactgcagccctggagagctggtgcacatgctgaatgagctgtttgggaagtttgaccagatcgccaaggaaaatgaatgcatgaggatcaagatcctgggggactgctactactgtgtgtctggcctgcccatcagcctgcccaaccacgccaagaactgtgtgaagatgggcctggacatgtgtgaggccatcaagaaggtgagagatgccaccggggtggacatcaacatgagggtgggcgtgcacagcggaaatgtgctgtgtggggtcatcggcctgcagaagtggcagtatgatgtgtggagccatgatgtgaccctggccaaccacatggaggccggcggcgtgcccggccgggtgcacatcagctctgtgaccctggagcacctgaatggagcctacaaggtggaggagggagatggagacatccgggacccctacctgaagcagcacctggtgaagacctacttcgtcatcaaccccaagggggagcggcgcagcccccagcacctgttccggcccaggcacaccctggatggagccaagatgagggcctctgtgaggatgacccgctacctggagagctggggcgccgccaagccctttgcccacctgcaccaccgggacagcatgaccacagaaaatggcaagatcagcaccacagatgtgcccatgggccagcacaacttccagaacagaaccctgcggaccaagagccagaagaagagatttgaggaggagctgaatgaaagaatgatccaggccattgatggcatcaatgcccagaagcagtggctgaagtctgaggacatccagaggatcagcctgctcttctacaacaaggtgctggagaaggagtaccgggccacagccctgcctgccttcaagtactacgtgacctgtgcctgcctgatcttcttctgcatcttcatcgtgcagatcctggtgctgcccaagacctctgtgctgggcatcagctttggagctgccttcctgctgctggccttcatcctgtttgtgtgctttgctggccagctgctgcagtgcagcaagaaggccagccccctgctgatgtggctgctgaagagcagcggcatcatcgccaaccggccctggccccgcatcagcctgaccatcatcaccacagccatcatcctgatgatggctgtgttcaacatgttcttcctgagtgacagcgaggagaccatccccccaacagccaacaccaccaacaccagcttcagcgccagcaacaaccaggtggccatcctgcgggcccagaacctcttcttcctgccctacttcatctacagctgcatcctgggcctcatcagctgcagcgtcttcctgcgggtgaactatgagctgaagatgctgatcatgatggtggccctggtgggctacaacaccatcctgctgcacacccacgcccacgtgctgggggactacagccaggtgctgtttgagcggcccggcatctggaaggacctgaagaccatgggctctgtgtccctgagcatcttcttcatcaccctgctggtgctgggccggcagaatgagtactactgccgcctggacttcctgtggaagaacaagttcaagaaggagcgggaggagattgagaccatggagaacctgaacagagtgctgctggagaatgtgctgcctgcccacgtggccgagcacttcctggcccggagcctgaagaatgaggagctgtaccaccagagctatgactgtgtgtgtgtgatgtttgccagcatcccagacttcaaggagttctacacagaaagtgatgtgaacaaggagggcctggagtgcctgcggctgctgaatgagatcatcgctgactttgatgacctgctgagcaagcccaagttctctggagtggagaagatcaagaccatcggcagcacctacatggccgccaccggcctgtctgctgtgcccagccaggagcacagccaggagcctgagcggcagtacatgcacatcggcaccatggtggagtttgcctttgccctggtgggcaagctggatgccatcaacaagcacagcttcaatgacttcaagctgcgggtgggcatcaaccacggccctgtgattgctggggtgattggagcccagaagccccagtatgacatctggggcaacacagtgaatgtggccagcaggatggacagcactggagtgctggacaagatccaggtgacagaggagaccagcctggtgctgcagaccctgggctacacctgcacctgccggggcatcatcaacgtgaagggcaagggggacctgaagacctactttgtgaacacagagatgagccgcagcctgagccagagcaatgtggccagctag

SEQ ID NO: 142880 - DNA, 2775 bp, Artificial Sequence
  Description of Artificial Sequence: Synthetic coding sequence
atgctgcccttcaacatgagagatgccatcatcgcctctgtgctgaccagcagcagccacaccatcgtgctgtctgtgtgcctgagcgccacccctgggggcaaggagcacctggtgtggcagatcctggccaacgtcatcatcttcatctgtggcaacctggccggggcctaccacaagcacctgatggagctggccctgcagcagacctaccaggacacctgcaactgcatcaagagccgcatcaagctggagtttgagaagaggcagcaggagcggctgctgctgagcctgctgcctgcccacatcgccatggagatgaaggccgagatcatccagaggctgcagggccccaaggccggccagatggagaacaccaacaacttccacaacctgtatgtgaagaggcacaccaacgtgtccatcctgtatgctgacatcgtgggcttcacccggctggccagtgactgcagccctggagagctggtgcacatgctgaatgagctgtttgggaagtttgaccagatcgccaaggaaaatgaatgcatgaggatcaagatcctgggggactgctactactgtgtgtctggcctgcccatcagcctgcccaaccacgccaagaactgtgtgaagatgggcctggacatgtgtgaggccatcaagaaggtgagagatgccactggagtggacatcaacatgagggtgggcgtgcacagcggaaatgtgctgtgtggggtgattggcctgcagaagtggcagtatgatgtgtggagccatgatgtgaccctggccaaccacatggaggccggcggcgtgcccggccgggtgcacatcagctctgtgaccctggagcacctgaatggagcctacaaggtggaggagggagatggagacatccgggacccctacctgaagcagcacctggtgaagacctactttgtgatcaaccccaagggggagaggaggagcccccagcacctgttccggcccaggcacaccctggatggagccaagccctttgcccacctgcaccaccgggacagcatgaccacagaaaatggcaagatcagcaccacagatgtgcccatgggccagcacaacttccagaacagaaccctgcggaccaagagccagaagaagagatttgaggaggagctgaatgaaagaatgatccaggccattgatggcatcaatgcccagaagcagtggctgaagtctgaggacatccagaggatcagcctgctcttctacaacaaggtgctggagaaggagtaccgggccacagccctgcctgccttcaagtactacgtgacctgtgcctgcctgatcttcttctgcatcttcatcgtgcagatcctggtgctgcccaagacctctgtgctgggcatcagctttggagctgccttcctgctgctggccttcatcctgtttgtgtgctttgctggccagctgctgcagtgcagcaagaaggccagccccctgctgatgtggctgctgaagagcagcggcatcatcgccaaccggccctggccccgcatcagcctgaccatcatcaccacagccatcatcctgatgatggctgtgttcaacatgttcttcctgagtgacagcgaggagaccatccccccaacagccaacaccaccaacaccagcttcagcgccagcaacaaccaggtggccatcctgcgggcccagaacctcttcttcctgccctacttcatctacagctgcatcctgggcctcatcagctgcagcgtcttcctgcgggtgaactatgagctgaagatgctgatcatgatggtggccctggtgggctacaacaccatcctgctgcacacccacgcccacgtgctgggggactacagccaggtgctgtttgagaggcctggcatctggaaggacctgaagaccatgggctctgtgtccctgagcatcttcttcatcaccctgctggtgctgggccggcagaatgagtactactgccgcctggacttcctgtggaagaacaagttcaagaaggagcgggaggagattgagaccatggagaacctgaacagagtgctgctggagaatgtgctgcctgcccacgtggccgagcacttcctggcccggagcctgaagaatgaggagctgtaccaccagagctatgactgtgtgtgtgtgatgtttgccagcatcccagacttcaaggagttctacacagaaagtgatgtgaacaaggagggcctggagtgcctgcggctgctgaatgagatcatcgctgactttgatgacctgctgagcaagcccaagttcagcggcgtggagaagatcaagaccatcggcagcacctacatggccgccaccggcctgtctgctgtgcccagccaggagcacagccaggagcctgagcggcagtacatgcacatcggcaccatggtggagtttgcctttgccctggtgggcaagctggatgccatcaacaagcacagcttcaatgacttcaagctgcgggtgggcatcaaccacggccctgtgattgctggggtcatcggggcccagaagccccagtatgacatctggggcaacacagtgaatgtggccagcaggatggacagcactggagtgctggacaagatccaggtgacagaggagaccagcctggtgctgcagaccctgggctacacctgcacctgccggggcatcatcaacgtgaagggcaaaggagacctgaagacctactttgtgaacacagagatgagccgcagcctgagccagagcaatgtggccagctag

SEQ ID NO: 142881 - DNA, 3435 bp, Artificial Sequence
  Description of Artificial Sequence: Synthetic coding sequence
atgcccaggaaccagggcttcagcgagcctgagtacagcgctgagtacagcgctgagtacagcgtgtccctgcccagcgaccctgacagaggagtgggccgcacccatgagatctctgtgagaaattctggcagctgcctgtgcctgccccgcttcatgaggctgacctttgtgcctgagagcctggagaacctgtaccagacctacttcaagaggcagagacatgagaccctgctggtgctggtggtgtttgctgccctgtttgactgctacgtggtggtgatgtgtgctgtggtgttcagcagtgacaagctggccagcctggccgtggccggcatcggcctggtgctggacatcatcctgtttgtgctgtgcaagaagggcctgctgcctgacagagtgacccggcgggtgctgccctacgtgctgtggctgctgatcacagcccagatcttctcctacctgggcctgaactttgcccgggcccacgccgccagtgacacagtgggctggcaggtgttctttgtgttctccttcttcatcaccctgcccctgagcctgagccccatcgtcatcatctctgtggtgtcctgtgtggtgcacaccctggtgctgggcgtgacagtggcccagcagcagcaggaggagctgaagggcatgcagctgctgcgggagatcctggccaacgtgttcctgtacctgtgtgccatcgctgtgggcatcatgagctactacatggctgacaggaagcacaggaaggccttcctggaggcccggcagagcctggaggtgaagatgaacctggaggagcagagccagcagcaggagaacctgatgctgagcatcctgcccaagcacgtggctgatgagatgctgaaggacatgaagaaggatgagagccagaaggaccagcagcagttcaacaccatgtacatgtacagacatgaaaatgtgtccatcctgtttgctgacatcgtgggcttcacccagctgagcagcgcctgcagcgcccaggagctggtgaagctgctgaatgagctgtttgccaggtttgacaagctggccgccaagtaccaccagctgcgcatcaagatcctgggggactgctactactgcatctgtggcctgcctgactacagagaagatcatgctgtgtgcagcatcctgatgggcctggccatggtggaggccatctcctatgtgcgggagaagaccaagacaggagtggacatgagggtgggcgtgcacactggaacagtgctgggcggcgtgctgggccagaagcgctggcagtatgatgtgtggagcacagatgtgacagtggccaacaagatggaggccggcggcatccctggccgggtgcacatcagccagagcaccatggactgcctgaagggggagtttgatgtggagcctggagatggcggcagccgctgtgactacctggaggagaagggcatcgagacctacctgatcatcgccagcaagccagaggtgaagaagacagccacccagaatggcctgaatggaagtgccctgcccaatggagccccagccagcagcaagagcagcagccctgccctgattgagaccaaggagcccaatggaagtgcccacagcagcggcagcaccagcgagaagccagaggagcaggatgcccaggccgacaaccccagcttccccaacccccggcggcggctgcggctgcaggacctggccgacagagtggtggatgcctctgaagatgagcacgagctgaaccagctgctgaatgaggccctgctggagcgggagagcgcccaggtggtgaagaagaggaacaccttcctgctgtccatgaggttcatggaccctgagatggagacccgctacagcgtggagaaggagaagcagagcggggccgccttcagctgcagctgtgtggtgctgctgtgcacagccctggtggagatcctgattgacccctggctgatgaccaactacgtgaccttcatggtgggggagatcctgctgctgatcctgaccatctgcagcctggccgccatcttcccccgggccttccccaagaagctggtggccttcagcacctggattgacaggacccgctgggccaggaacacctgggccatgctggccatcttcatcctggtgatggccaacgtggtggacatgctgagctgcctgcagtactacacaggccccagcaatgccacagctggcatggagacagagggcagctgcctggagaaccccaagtactacaactacgtggccgtgctgagcctgattgccaccatcatgctggtgcaggtgagccacatggtgaagctgaccctgatgctgctggtggccggggctgtggccaccatcaacctgtatgcctggaggcctgtgtttgatgaatatgaccacaagcgcttccgggagcatgacctgcccatggtggccctggagcagatgcagggcttcaaccctggcctgaatggaacagaccggctgcccctggtgcccagcaagtacagcatgacagtgatggtgttcctgatgatgctgtccttctactacttcagcagacatgtggagaagctggcccggaccctcttcctgtggaagattgaggtgcatgaccagaaggagcgggtgtatgagatgaggcgctggaatgaggccctggtgaccaacatgctgcctgagcacgtggcccggcacttcctgggcagcaagaagagagatgaggagctgtacagccagacctatgatgaaattggagtgatgtttgccagcctgcccaactttgctgacttctacacagaggagagcatcaacaatggaggcattgaatgtctgcgcttcctgaatgagatcatcagtgactttgacagcctgctggacaaccccaagttccgggtcatcaccaagatcaagaccatcggcagcacctacatggccgccagcggcgtgaccccagatgtgaacaccaacggctttgccagcagcaacaaggaggacaagtctgagcgggagcgctggcagcacctggccgacctggccgactttgccctggccatgaaggacaccctgaccaacatcaacaaccagagcttcaacaacttcatgctgcgcatcggcatgaacaagggcggcgtgctggccggggtcatcggggccaggaagccccactatgacatctggggcaacacagtgaatgtggccagcaggatggagagcactggagtgatgggcaacatccaggtggtggaggagacccaggtgatcctgcgggagtatggcttccgctttgtgcggcggggccccatctttgtgaagggcaaaggagagctgctgaccttcttcctgaagggccgggacaagctggccaccttccccaacggccccagcgtgaccctgccccaccaggtggtggacaacagctag

SEQ ID NO: 142882 - DNA, 3360 bp, Artificial Sequence
  Description of Artificial Sequence: Synthetic coding sequence
atgcccaggaaccagggcttcagcgagcctgagtacagcgctgagtacagcgctgagtacagcgtgtccctgccccgcttcatgaggctgacctttgtgcctgagagcctggagaacctgtaccagacctacttcaagaggcagagacatgagaccctgctggtgctggtggtgtttgctgccctgtttgactgctacgtggtggtgatgtgtgctgtggtgttcagcagtgacaagctggccagcctggccgtggccggcatcggcctggtgctggacatcatcctgtttgtgctgtgcaagaagggcctgctgcctgacagagtgaccaggagagtgctgccctacgtgctgtggctgctgatcacagcccagatcttctcctacctgggcctgaactttgcccgggcccatgctgccagtgacacagtgggctggcaggtgttctttgtgttctccttcttcatcaccctgcccctgagcctgagccccatcgtcatcatctctgtggtgtcctgtgtggtgcacaccctggtgctgggcgtgacagtggcccagcagcagcaggaggagctgaagggcatgcagctgctgcgggagatcctggccaacgtgttcctgtacctgtgtgccatcgctgtgggcatcatgagctactacatggctgacaggaagcacaggaaggccttcctggaggcccggcagagcctggaggtgaagatgaacctggaggagcagagccagcagcaggagaacctgatgctgagcatcctgcccaagcacgtggctgatgagatgctgaaggacatgaagaaggatgagagccagaaggaccagcagcagttcaacaccatgtacatgtacagacatgaaaatgtgtccatcctgtttgctgacatcgtgggcttcacccagctgagcagcgcctgcagcgcccaggagctggtgaagctgctgaatgagctgtttgccaggtttgacaagctggccgccaagtaccaccagctgcgcatcaagatcctgggggactgctactactgcatctgtggcctgcctgactaccgggaggaccatgctgtgtgcagcatcctgatgggcctggccatggtggaggccatctcctatgtgcgggagaagaccaagacaggagtggacatgagggtgggcgtgcacacaggcaccgtgctgggcggcgtgctgggccagaagcgctggcagtatgatgtgtggagcacagatgtgacagtggccaacaagatggaggccggcggcatccctggccgggtgcacatcagccagagcaccatggactgcctgaagggggagtttgatgtggagcctggagatggcggcagccgctgtgactacctggaggagaagggcatcgagacctacctgatcatcgccagcaagccagaggtgaagaagacagccacccagaatggcctgaatggcagcgccctgcccaacggggccccagccagcagcaagagcagcagccctgccctgattgagaccaaggagcccaacggcagcgcccacagcagcggcagcaccagcgagaagccagaggagcaggatgcccaggccgacaaccccagcttccccaacccccggcggcggctgcggctgcaggacctggccgacagagtggtggatgcctctgaagatgaacatgagctgaaccagctgctgaatgaggccctgctggagcgggagagcgcccaggtggtgaagaagaggaacaccttcctgctgtccatgaggttcatggaccctgagatggagacccgctacagcgtggagaaggagaagcagagcggggccgccttcagctgcagctgtgtggtgctgctgtgcacagccctggtggagatcctgattgacccctggctgatgaccaactacgtgaccttcatggtgggggagatcctgctgctgatcctgaccatctgcagcctggccgccatcttcccccgggccttccccaagaagctggtggccttcagcacctggattgacaggacccgctgggccaggaacacctgggccatgctggccatcttcatcctggtgatggccaacgtggtggacatgctgagctgcctgcagtactacacaggccccagcaatgccacagctggcatggagacagagggcagctgcctggagaaccccaagtactacaactacgtggccgtgctgagcctcatcgccaccatcatgctggtgcaggtgagccacatggtgaagctgaccctgatgctgctggtggccggggctgtggccaccatcaacctgtatgcctggaggcctgtgtttgatgaatatgaccacaagcgcttccgggagcatgacctgcccatggtggccctggagcagatgcagggcttcaaccctggcctgaatggaacagaccggctgcccctggtgcccagcaagtacagcatgacagtgatggtgttcctgatgatgctgtccttctactacttcagccgccacgtggagaagctggcccggaccctcttcctgtggaagattgaggtgcatgaccagaaggagcgggtgtatgagatgaggcgctggaatgaggccctggtgaccaacatgctgcctgagcacgtggcccggcacttcctgggcagcaagaagagagatgaggagctgtacagccagacctatgatgaaattggagtgatgtttgccagcctgcccaactttgctgacttctacacagaggagagcatcaacaacggcggcatcgagtgcctgcgcttcctgaatgagatcatcagtgactttgacagcctgctggacaaccccaagttccgggtcatcaccaagatcaagaccatcggcagcacctacatggccgccagcggcgtgaccccagatgtgaacaccaatggatttgccagcagcaacaaggaggacaagtctgagcgggagcgctggcagcacctggccgacctggccgactttgccctggccatgaaggacaccctgaccaacatcaacaaccagagcttcaacaacttcatgctgagaattggcatgaacaagggcggcgtgctggccggcgtgattggagccaggaagccccactatgacatctggggcaacacagtgaatgtggccagcaggatggagagcactggagtgatgggcaacatccaggtggtggaggagacccaggtgatcctgcgggagtatggcttccgctttgtgagaagaggccccatctttgtgaagggcaagggggagctgctgaccttcttcctgaagggccgggacaagctggccaccttccccaacggccccagcgtgaccctgccccaccaggtggtggacaacagctag

SEQ ID NO: 142883 - DNA, 339 bp, Artificial Sequence
  Description of Artificial Sequence: Synthetic coding sequence
atgcccaggaaccagggcttcagcgagcctgagtacagcgctgagtacagcgctgagtacagcgtgtccctgcccagcgaccctgacagaggagtgggccgcacccatgagatctctgtgagaaattctggcagctgcctgtgcctgccccgcttcatgaggctgacctttgtgcctgagagcctggagaacctgtaccagacctacttcaagaggcagagacatgagaccctgctggtgctggtggtgtttgctgccctgtttgactgctacgtggtggtgatgtgtgctgtggtgttcagcagtgacaagctggccagcctggccgtggccggctag

SEQ ID NO: 142884 - DNA, 3234 bp, Artificial Sequence
  Description of Artificial Sequence: Synthetic coding sequence
atggcccggctcttcagcccccggcccccacccagtgaagatctcttctatgagacctactacagcctgagccagcagtaccccctgctgctgctgctgctgggcatcgtgctgtgtgccctggccgccctgctggccgtggcctgggccagcggccgggagctgaccagtgaccccagcttcctgaccaccgtgctgtgtgccctgggcggcttcagcctgctgctgggcctggccagccgggagcagaggctgcagcgctggacccggcccctgagcggcctggtgtgggtggccctgctggccctgggccacgccttcctgttcaccggcggcgtggtgtctgcctgggaccaggtgtcctacttcctgtttgtgatcttcaccgcctatgccatgctgcccctgggcatgagagatgctgctgtggccggcctggccagcagcctgagccacctgctggtgctgggcctgtacctgggcccccagcctgacagcaggcctgccctgctgccccagctggccgccaatgctgtgctcttcctgtgtggaaatgtggccggcgtgtaccacaaggccctgatggagcgggccctgcgggccaccttccgggaggccctgagcagcctgcacagcagaagaaggctggacacagagaagaagcaccaggagcacctgctgctgagcatcctgcctgcctacctggcccgggagatgaaggccgagatcatggcccggctgcaggccggccagggcagcaggcctgagagcaccaacaacttccacagcctgtatgtgaagaggcaccagggcgtgtctgtgctgtatgctgacatcgtgggcttcacccggctggccagcgagtgcagccccaaggagctggtgctgatgctgaatgagctgtttgggaagtttgaccagatcgccaaggagcacgagtgcatgaggatcaagatcctgggggactgctactactgtgtgtctggcctgcccctgagcctgcctgaccacgccatcaactgtgtgaggatgggcctggacatgtgccgggccatcaggaagctgcgggccgccactggagtggacatcaacatgagggtgggcgtgcacagcggctctgtgctgtgtggggtgattggcctgcagaagtggcagtatgatgtgtggagccatgatgtgaccctggccaaccacatggaggccggcggcgtgcccggccgggtgcacatcactggagccaccctggccctgctggccggggcctatgctgtggaggatgctggcatggagcaccgggacccctacctgcgggagctgggggagcccacctacctggtgattgaccccagggctgaggaggaggatgagaagggcacagctgggggcctgctgagcagcctggagggcctgaagatgaggcccagcctgctgatgacccgctacctggagagctggggcgccgccaagccctttgcccacctgagccacggggacagccctgtgtccaccagcacccccctgcctgagaagaccctggccagcttcagcacccagtggagcctggacaggagcaggaccccccggggcctggatgatgagctggacacaggagatgccaagttcttccaggtgattgagcagctgaacagccagaagcagtggaagcagagcaaggacttcaaccccctgaccctgtacttccgggagaaggagatggagaaggagtaccgcctgagcgccatcccagccttcaagtactatgaggcctgcaccttcctggtgttcctgagcaacttcatcatccagatgctggtgaccaacagacctccagccctggccatcacctacagcatcaccttcctgctcttcctgctgatcctgtttgtgtgcttcagcgaggacctgatgagatgtgtgctgaagggccccaagatgctgcactggctgcctgccctgagcggcctggtggccacccggcccggcctgcgcatcgccctgggcacagccaccatcctgctggtgtttgccatggccatcaccagcctcttcttcttccccaccagcagtgactgccccttccaggccccaaatgtgtcctccatgatcagcaacctgtcctgggagctgcccggcagcctgcccctcatctctgtgccctacagcatgcactgctgcaccctgggcttcctgagctgcagcctcttcctgcacatgagctttgagctgaagctgctgctgctgctgctgtggctggccgccagctgcagcctcttcctgcacagccacgcctggctgtctgaatgtctcatcgtgcggctgtacctgggccccctggacagcaggcctggggtgctgaaggagcccaagctgatgggcgccatctccttcttcatcttcttcttcaccctgctggtgctggcccggcagaatgagtactactgccgcctggacttcctgtggaagaagaagctgcggcaggagcgggaggagacagagaccatggagaacctgacccggctgctgctggagaatgtgctgcctgcccacgtggccccccagttcatcggccagaacagaagaaatgaagacctgtaccaccagagctatgaatgtgtgtgtgtgctgtttgcctctgtgcctgacttcaaggagttctacagcgagagcaacatcaaccacgagggcctggagtgcctgcggctgctgaatgagatcatcgctgactttgatgagctgctgagcaagcccaagttctctggagtggagaagatcaagaccatcggcagcacctacatggccgccaccggcctgaatgccaccagcggccaggatgcccagcaggatgctgagaggagctgcagccacctgggcaccatggtggagtttgctgtggccctgggcagcaagctggatgtgatcaacaagcacagcttcaacaacttccggctgcgggtgggcctgaaccacggccctgtggtggccggcgtgattggagcccagaagccccagtatgacatctggggcaacacagtgaatgtggccagcaggatggagagcactggagtgctgggcaagatccaggtgacagaggagacagcctgggccctgcagagcctgggctacacctgctacagcagaggagtcatcaaggtgaagggcaagggccagctgtgcacctacttcctgaacacagacctgaccaggactggacctccttctgccaccctgggctag

SEQ ID NO: 142885 - DNA, 1260 bp, Artificial Sequence
  Description of Artificial Sequence: Synthetic coding sequence
atgagccggggcacccgggagagcgcctgctgcatgctgacctcctgggccagccggggctggccagcctctgtgcccctgcgctcctggtgcagctgcagcatgagcagcctggccagcagcacccggctgcccaggaagctgcgggccgccaccggggtggacatcaacatgagggtgggcgtgcacagcggctctgtgctgtgtggggtcatcggcctgcagaagtggcagtatgatgtgtggagccatgatgtgaccctggccaaccacatggaggccggcggcgtgcccggccgggtgcacatcaccggggccaccctggccctgctggccggggcctatgctgtggaggatgctggcatggagcaccgggacccctacctgcgggagctgggggagcccacctacctggtgattgaccccagggctgaggaggaggatgagaagggcacagctgggggcctgctgagcagcctggagggcctgaagatgaggcccagcctgctgatgacccgctacctggagagctggggcgccgccaagccctttgcccacctgagccatggagacagccctgtgtccaccagcacccccctgcctgagaagaccctggccagcttcagcacccagtggagcctggacaggagcaggaccccccggggcctggatgatgagctggacacaggagatgccaagttcttccaggtgattgagcagctgaacagccagaagcagtggaagcagagcaaggacttcaaccccctgaccctgtacttccgggagaaggagatggagaaggagtaccgcctgagcgccatcccagccttcaagtactatgaggcctgcaccttcctggtgttcctgagcaacttcatcatccagatgctggtgaccaaccggcccccagccctggccatcacctacagcatcaccttcctgctcttcctgctgatcctgtttgtgtgcttcagcgaggacctgatgagatgtgtgctgaagggccccaagatgctgcactggctgcctgccctgagcggcctggtggccaccaggcctggcctgagaattgccctgggcacagccaccatcctgctggtgtttgccatggccatcaccagcctcttcttcttccccaccagcagtgactgccccttccaggcccccaacgtgtcctccatgatcagcaacctgtcctgggagctgcccggcagcctgcccctcatctctgtgcctgtgtctgtgcccacctgcccctag

SEQ ID NO: 142886 - DNA, 3234 bp, Artificial Sequence; identical to SEQ ID NO: 142884
  Description of Artificial Sequence: Synthetic coding sequence

SEQ ID NO: 142887 - DNA, 3234 bp, Artificial Sequence; identical to SEQ ID NO: 142884
  Description of Artificial Sequence: Synthetic coding sequence

SEQ ID NO: 142888 - DNA, 348 bp, Artificial Sequence
  Description of Artificial Sequence: Synthetic coding sequence
atggcccggctcttcagcccccggcccccacccagtgaagatctcttctatgagacctactacagcctgagccagcagtaccccctgctgctgctgctgctgggcatcgtgctgtgtgccctggccgccctgctggccgtggcctgggccagcggccgggagctgaccagtgaccccagcttcctgaccaccgtgctgtgtgccctgggcggcttcagcctgctgctgggcctggccagccgggagcagaggctgcagcgctggacccggcccctgagcggcctggtgtgggtggccctgctggccctgggccacgccttcctgttcaccggcggcgtggtgtcctag

SEQ ID NO: 142889 - DNA, 2736 bp, Artificial Sequence
  Description of Artificial Sequence: Synthetic coding sequence
atgaagagccagaaggagggctgctgcagcagaggagacctgagcatccagacaggccctggaggagagtgggccccccggcggctggtgtccaatgtgctgatcttcagctgcaccaacatcgtgggcgtgtgcacccactacccagctgaggtgtcccagaggcaggccttccaggagacccgggagtgcatccaggcccggctgcacagccagcgggagaaccagcagcaggagcggctgctgctgtctgtgctgcccaggcatgtggccatggagatgaaggctgacatcaatgccaagcaggaggacatgatgttccacaagatctacatccagaagcatgacaacgtgtccatcctgtttgctgacatcgagggcttcaccagcctggccagccagtgcacagcccaggagctggtgatgaccctgaatgagctgtttgccaggtttgacaagctggccgctgagaaccactgcctgcgcatcaagatcctgggggactgctactactgtgtgtctggcctgcctgaggcccgggctgaccacgcccactgctgcgtggagatgggcatggacatgattgaggccatcagcctggtgcgggaggtgactggagtgaatgtgaacatgagggtgggcatccacagcggccgggtgcactgcggcgtgctgggcctgaggaagtggcagtttgatgtgtggagcaatgatgtgaccctggccaaccacatggaggccggcggcaaggccggccgcatccacatcaccaaggccaccctgaactacctgaatggagactatgaggtggagcccggctgcggcggggagagaaatgcctacctgaaggagcacagcattgagaccttcctgatcctgcgctgcacccagaagaggaaggaggagaaggccatgattgccaagatgaaccggcagaggaccaacagcatcggccacaaccccccccactggggcgctgagcggcccttctacaaccacctgggcggcaaccaggtgtccaaggagatgaagaggatgggctttgaggaccccaaggacaagaatgcccaggagagcgccaacccagaagatgaggtggatgagttcctgggccgggccattgatgcccggagcattgaccggctgcggtctgagcacgtgaggaagttcctgctgaccttccgggagccagacctggagaagaagtacagcaagcaggtggatgacagatttggagcctacgtggcctgtgccagcctggtgttcctgttcatctgctttgtgcagatcaccatcgtgccccacagcatcttcatgctgtccttctacctgacctgcagcctgctgctgaccctggtggtgtttgtgtctgtcatctacagctgtgtgaagctgttccccagccccctgcagaccctgagcaggaagatcgtgcgcagcaagatgaacagcaccctggtgggcgtcttcaccatcaccctggtgttcctggccgcctttgtgaacatgttcacctgcaacagccgggacctgctgggctgcctggcccaggagcacaacatcagcgccagccaggtgaatgcctgccacgtggccgagagcgctgtgaactacagcctgggagatgagcagggcttctgtggcagcccctggcccaactgcaacttccctgagtacttcacctacagcgtgctgctgagcctgctggcctgcagcgtcttcctgcagatcagctgcatcggcaagctggtgctgatgctggccatcgagctgatctacgtgctgattgtggaggtgcctggggtgaccctgtttgacaatgctgacctgctggtgacagccaatgccatcgacttcttcaacaacggcaccagccagtgcccagagcacgccaccaaggtggccctgaaggtggtgacccccatcatcatctctgtgtttgtgctggccctgtacctgcacgcccagcaggtggagagcacagcccggctggacttcctgtggaagctgcaggccacagaggagaaggaggagatggaggagctgcaggcctacaacagaaggctgctgcacaacatcctgcccaaggatgtggccgcccacttcctggcccgggagaggagaaatgatgagctgtactaccagagctgtgaatgtgtggccgtgatgtttgccagcatcgccaacttcagcgagttctacgtggagctggaggccaacaatgaaggagtggagtgcctgcggctgctgaatgagatcatcgctgactttgatgagatcatcagtgaagatcgcttccggcagctggagaagatcaagaccatcggcagcacctacatggccgccagcggcctgaatgacagcacctatgacaaggtgggcaagacccacatcaaggccctggccgactttgccatgaagctgatggaccagatgaagtacatcaatgagcacagcttcaacaacttccagatgaagattggcctgaacatcggccctgtggtggccggcgtgattggagccaggaagccccagtatgacatctggggcaacacagtgaatgtggccagcaggatggacagcactggagtgcctgaccgcatccaggtgaccacagacatgtaccaggtgctggccgccaacacctaccagctggagtgccggggcgtggtgaaggtgaagggcaagggggagatgatgacctacttcctgaatggaggcccccccctgtcctag

SEQ ID NO: 142890 - DNA, 3786 bp, Artificial Sequence
  Description of Artificial Sequence: Synthetic coding sequence
atgagcggcagcaagtctgtgtccccacctggctatgctgcccagaagacagctgccccagccccccggggcggccctgagcacaggtctgcctggggcgaggccgacagccgggccaacggctacccccacgcccctgggggcagcgcccggggcagcaccaagaagccaggaggagctgtgaccccccagcagcagcagaggctggccagccgctggaggagtgatgatgatgatgatcctcccctgtctggagatgaccccctggccggcggcttcggcttctccttccgcagcaagagcgcctggcaggagagaggaggagatgactgtggccggggcagccggcggcagaggagaggagctgccagcggcggcagcacccgggcccctcctgctgggggcggcggcggcagcgctgctgctgctgccagcgctgggggcacagaggtgcggcccaggtctgtggaggtgggcctggaggagcggcggggcaagggccgggcagcagatgagctggaggccggggctgtggagggcggggagggcagcggagatggcggcagcagcgctgacagcggcagcggggccggccctggagctgtgctgagcctgggcgcctgctgcctggccctgctgcagatcttccgcagcaagaagttccccagcgacaagctggagcggctgtaccagcgctacttcttccggctgaaccagagcagcctgaccatgctgatggctgtgctggtgctggtgtgcctggtgatgctggccttccacgccgcccggccccccctgcagctgccctacctggccgtgctggccgctgctgtgggcgtcatcctgatcatggctgtgctgtgcaacagagctgccttccaccaggaccacatgggcctggcctgctacgccctgattgctgtggtgctggccgtgcaggtggtgggcctgctgctgccccagcccaggtctgccagcgagggcatctggtggacagtgttcttcatctacaccatctacaccctgctgcctgtgaggatgagagctgctgtgctgtctggagtgctgctgagcgccctgcacctggccatcgccctgcggaccaatgcccaggaccagttcctgctgaagcagctggtgtccaatgtgctgatcttcagctgcaccaacatcgtgggcgtgtgcacccactacccagctgaggtgtcccagaggcaggccttccaggagacccgggagtgcatccaggcccggctgcacagccagcgggagaaccagcagcaggagcggctgctgctgtctgtgctgcccaggcatgtggccatggagatgaaggctgacatcaatgccaagcaggaggacatgatgttccacaagatctacatccagaagcatgacaacgtgtccatcctgtttgctgacatcgagggcttcaccagcctggccagccagtgcacagcccaggagctggtgatgaccctgaatgagctgtttgccaggtttgacaagctggccgctgagaaccactgcctgcgcatcaagatcctgggggactgctactactgtgtgtctggcctgcctgaggcccgggctgaccacgcccactgctgcgtggagatgggcatggacatgattgaggccatcagcctggtgcgggaggtgactggagtgaatgtgaacatgagggtgggcatccacagcggccgggtgcactgcggcgtgctgggcctgaggaagtggcagtttgatgtgtggagcaatgatgtgaccctggccaaccacatggaggccggcggcaaggccggccgcatccacatcaccaaggccaccctgaactacctgaatggagactatgaggtggagcccggctgcggcggggagagaaatgcctacctgaaggagcacagcattgagaccttcctgatcctgcgctgcacccagaagaggaaggaggagaaggccatgattgccaagatgaaccggcagaggaccaacagcatcggccacaaccccccccactggggcgctgagcggcccttctacaaccacctgggcggcaaccaggtgtccaaggagatgaagaggatgggctttgaggaccccaaggacaagaatgcccaggagagcgccaacccagaagatgaggtggatgagttcctgggccgggccattgatgcccggagcattgaccggctgcggtctgagcacgtgaggaagttcctgctgaccttccgggagccagacctggagaagaagtacagcaagcaggtggatgacagatttggagcctacgtggcctgtgccagcctggtgttcctgttcatctgctttgtgcagatcaccatcgtgccccacagcatcttcatgctgtccttctacctgacctgcagcctgctgctgaccctggtggtgtttgtgtctgtcatctacagctgtgtgaagctgttccccagccccctgcagaccctgagcaggaagatcgtgcgcagcaagatgaacagcaccctggtgggcgtcttcaccatcaccctggtgttcctggccgcctttgtgaacatgttcacctgcaacagccgggacctgctgggctgcctggcccaggagcacaacatcagcgccagccaggtgaatgcctgccacgtggccgagagcgctgtgaactacagcctgggagatgagcagggcttctgtggcagcccctggcccaactgcaacttccctgagtacttcacctacagcgtgctgctgagcctgctggcctgcagcgtcttcctgcagatcagctgcatcggcaagctggtgctgatgctggccatcgagctgatctacgtgctgattgtggaggtgcctggggtgaccctgtttgacaatgctgacctgctggtgacagccaatgccatcgacttcttcaacaacggcaccagccagtgcccagagcacgccaccaaggtggccctgaaggtggtgacccccatcatcatctctgtgtttgtgctggccctgtacctgcacgcccagcaggtggagagcacagcccggctggacttcctgtggaagctgcaggccacagaggagaaggaggagatggaggagctgcaggcctacaacagaaggctgctgcacaacatcctgcccaaggatgtggccgcccacttcctggcccgggagaggagaaatgatgagctgtactaccagagctgtgaatgtgtggccgtgatgtttgccagcatcgccaacttcagcgagttctacgtggagctggaggccaacaatgaaggagtggagtgcctgcggctgctgaatgagatcatcgctgactttgatgagatcatcagtgaagatcgcttccggcagctggagaagatcaagaccatcggcagcacctacatggccgccagcggcctgaatgacagcacctatgacaaggtgggcaagacccacatcaaggccctggccgactttgccatgaagctgatggaccagatgaagtacatcaatgagcacagcttcaacaacttccagatgaagattggcctgaacatcggccctgtggtggccggcgtgattggagccaggaagccccagtatgacatctggggcaacacagtgaatgtggccagcaggatggacagcactggagtgcctgaccgcatccaggtgaccacagacatgtaccaggtgctggccgccaacacctaccagctggagtgccggggcgtggtgaaggtgaagggcaagggggagatgatgacctacttcctgaatggaggcccccccctgtcctag

SEQ ID NO: 142891 - DNA, 2760 bp, Artificial Sequence
  Description of Artificial Sequence: Synthetic coding sequence
atggcccccagccgcttccgcacccagctggagctggtgtccaatgtgctgatcttcagctgcaccaacatcgtgggcgtgtgcacccactacccagctgaggtgtcccagaggcaggccttccaggagacccgggagtgcatccaggcccggctgcacagccagcgggagaaccagcagcaggagcggctgctgctgtctgtgctgcccaggcatgtggccatggagatgaaggctgacatcaatgccaagcaggaggacatgatgttccacaagatctacatccagaagcatgacaacgtgtccatcctgtttgctgacatcgagggcttcaccagcctggccagccagtgcacagcccaggagctggtgatgaccctgaatgagctgtttgccaggtttgacaagctggccgctgagaaccactgcctgcgcatcaagatcctgggggactgctactactgtgtgtctggcctgcctgaggcccgggctgaccacgcccactgctgcgtggagatgggcatggacatgattgaggccatcagcctggtgcgggaggtgactggagtgaatgtgaacatgagggtgggcatccacagcggccgggtgcactgcggcgtgctgggcctgaggaagtggcagtttgatgtgtggagcaatgatgtgaccctggccaaccacatggaggccggcggcaaggccggccgcatccacatcaccaaggccaccctgaactacctgaatggagactatgaggtggagcccggctgcggcggggagagaaatgcctacctgaaggagcacagcattgagaccttcctgatcctgcgctgcacccagaagaggaaggaggagaaggccatgattgccaagatgaaccggcagaggaccaacagcatcggccacaaccccccccactggggcgctgagcggcccttctacaaccacctgggcggcaaccaggtgtccaaggagatgaagaggatgggctttgaggaccccaaggacaagaatgcccaggagagcgccaacccagaagatgaggtggatgagttcctgggccgggccattgatgcccggagcattgaccggctgcggagtgaacatgtgaggaagttcctgctgaccttccgggagccagacctggagaagaagtacagcaagcaggtggatgacagatttggagcctacgtggcctgtgccagcctggtgttcctgttcatctgctttgtgcagatcaccatcgtgccccacagcatcttcatgctgtccttctacctgacctgcagcctgctgctgaccctggtggtgtttgtgtctgtcatctacagctgtgtgaagctgttccccagccccctgcagaccctgagcaggaagatcgtgcgcagcaagatgaacagcaccctggtgggcgtcttcaccatcaccctggtgttcctggccgcctttgtgaacatgttcacctgcaacagccgggacctgctgggctgcctggcccaggagcacaacatcagcgccagccaggtgaatgcctgccacgtggccgagagcgctgtgaactacagcctgggagatgagcagggcttctgtggcagcccctggcccaactgcaacttccctgagtacttcacctacagcgtgctgctgagcctgctggcctgcagcgtcttcctgcagatcagctgcatcggcaagctggtgctgatgctggccatcgagctgatctacgtgctgattgtggaggtgcctggggtgaccctgtttgacaatgctgacctgctggtgacagccaatgccatcgacttcttcaacaacggcaccagccagtggagcctgtgtgagaacctgcggcacaggaggatggaggccggcacctacttccccagcggcgtgaaggagcagagccctgagcacgccaccaaggtggccctgaaggtggtgacccccatcatcatctctgtgtttgtgctggccctgtacctgcacgcccagcaggtggagagcacagcccggctggacttcctgtggaagctgcaggccacagaggagaaggaggagatggaggagctgcaggcctacaacagaaggctgctgcacaacatcctgcccaaggatgtggccgcccacttcctggcccgggagaggagaaatgatgagctgtactaccagagctgtgaatgtgtggccgtgatgtttgccagcatcgccaacttcagcgagttctacgtggagctggaggccaacaatgaaggagtggagtgcctgcggctgctgaatgagatcatcgctgactttgatgagatcatcagtgaagatcgcttccggcagctggagaagatcaagaccatcggcagcacctacatggccgccagcggcctgaatgacagcacctatgacaaggtgggcaagacccacatcaaggccctggccgactttgccatgaagctgatggaccagatgaagtacatcaatgagcacagcttcaacaacttccagatgaagattggcctgaacatcggccctgtggtggccggcgtgattggagccaggaagccccagtatgacatctggggcaacacagtgaatgtggccagcaggatggacagcactggagtgcctgaccgcatccaggtgaccacagacatgtaccaggtgctggccgccaacacctaccagctggagtgccggggcgtggtgaaggtgaagggcaagggggagatgatgacctacttcctgaatggaggcccccccctgtcctag

SEQ ID NO: 142892 - DNA, 3507 bp, Artificial Sequence
  Description of Artificial Sequence: Synthetic coding sequence
atgtcctggttcagcggcctgctggtgcccaaggtggatgagaggaagacagcctggggcgagagaaatggccagaagaggagcagaagaagaggcaccagggctgggggcttctgcaccccccgctacatgagctgcctgagagatgctgagccccccagccccaccccagctggccccccacgctgcccctggcaggatgatgccttcatccggcggggcggccctgggaagggcaaggagctgggcctgcgggctgtggccctgggctttgaggacacagaggtgaccaccacagctgggggcacagctgaggtggccccagatgctgtgcccaggagcggccgcagctgctggaggcggctggtgcaggtgttccagagcaagcagttccgcagcgccaagctggagcggctgtaccagcgctacttcttccagatgaaccagagcagcctgaccctgctgatggctgtgctggtgctgctgacagctgtgctgctggccttccacgccgccccagcccggccccagcctgcctacgtggccctgctggcctgtgccgccgccctgtttgtgggcctgatggtggtgtgcaacagacacagcttccggcaggacagcatgtgggtggtgtcctatgtggtgctgggcatcctggccgctgtgcaggtgggcggggccctggccgctgaccccaggagccccagcgctggcctgtggtgccctgtgttctttgtgtacatcgcctacaccctgctgcccatccgcatgagagctgctgtgctgagcggcctgggcctgagcaccctgcacctgatcctggcctggcagctgaacagaggagatgccttcctgtggaagcagctgggcgccaacgtgctgctcttcctgtgcaccaacgtcatcggcatctgcacccactacccagctgaggtgtcccagaggcaggccttccaggagacccggggctacatccaggcccggctgcacctgcagcacgagaaccggcagcaggagcggctgctgctgtctgtgctgccccagcacgtggccatggagatgaaggaggacatcaacaccaagaaggaggacatgatgttccacaagatctacatccagaagcatgacaacgtgtccatcctgtttgctgacatcgagggcttcaccagcctggccagccagtgcacagcccaggagctggtgatgaccctgaatgagctgtttgccaggtttgacaagctggccgctgagaaccactgcctgcgcatcaagatcctgggggactgctactactgtgtgtctggcctgcctgaggcccgggctgaccacgcccactgctgcgtggagatgggcgtggacatgattgaggccatcagcctggtgcgggaggtgactggagtgaatgtgaacatgagggtgggcatccacagcggccgggtgcactgcggcgtgctgggcctgaggaagtggcagtttgatgtgtggagcaatgatgtgaccctggccaaccacatggaggccggcggccgggccggccgcatccacatcacccgggccaccctgcagtacctgaatggagactatgaggtggagcccggccggggcggggagagaaatgcctacctgaaggagcagcacatcgagaccttcctgatcctgggcgccagccagaagaggaaggaggagaaggccatgctggccaagctgcagaggacccgggccaacagcatggagggcctgatgccccgctgggtgcctgaccgggccttcagcaggaccaaggacagcaaggccttccggcagatgggcattgatgacagcagcaaggacaacagaggcacccaggatgccctgaacccagaagatgaggtggatgagttcctgagccgggccattgatgcccggagcattgaccagctgaggaaggaccacgtgcggcgcttcctgctgaccttccagcgggaggacctggagaagaagtacagcaggaaggtggaccccaggtttggagcctacgtggcctgtgccctgctggtgttctgcttcatctgcttcatccagctgctgatcttcccccacagcaccctgatgctgggcatctatgccagcatcttcctgctgctgctgatcaccgtgctgatctgtgctgtgtacagctgtggcagcctcttccccaaggccctgcagaggctgagccgcagcatcgtgcgcagccgggcccacagcacagctgtgggcatcttctctgtgctgctggtgttcaccagcgccatcgccaacatgttcacctgcaaccacacccccatccgcagctgtgccgccaggatgctgaacctgaccccagctgacatcacagcctgccacctgcagcagctgaactacagcctgggcctggatgcccccctgtgtgagggcaccatgcccacctgcagcttccctgagtacttcatcggcaacatgctgctgagcctgctggccagcagcgtcttcctgcacatcagcagcatcggcaagctggccatgatctttgtgctgggcctcatctacctggtgctgctgctgctgggccccccagccaccatctttgacaactatgacctgctgctgggcgtgcacggcctggccagcagcaatgagacctttgatggcctggactgcccagctgctggccgggtggccctgaagtacatgacccctgtgatcctgctggtgtttgccctggccctgtacctgcacgcccagcaggtggagagcacagcccggctggacttcctgtggaagctgcaggccactggagagaaggaggagatggaggagctgcaggcctacaacagaaggctgctgcacaacatcctgcccaaggatgtggccgcccacttcctggcccgggagaggagaaatgatgagctgtactaccagagctgtgaatgtgtggccgtgatgtttgccagcatcgccaacttcagcgagttctacgtggagctggaggccaacaatgaaggagtggagtgcctgcggctgctgaatgagatcatcgctgactttgatgagatcatcagcgaggagcgcttccggcagctggagaagatcaagaccatcggcagcacctacatggccgccagcggcctgaatgccagcacctatgaccaggtgggccgcagccacatcacagccctggccgactatgccatgaggctgatggagcagatgaagcacatcaatgagcacagcttcaacaacttccagatgaagattggcctgaacatgggccctgtggtggccggcgtgattggagccaggaagccccagtatgacatctggggcaacacagtgaatgtgagcagcaggatggacagcactggagtgcctgaccgcatccaggtgaccacagacctgtaccaggtgctggccgccaagggctaccagctggagtgccggggcgtggtgaaggtgaagggcaagggggagatgaccacctacttcctgaatggaggccccagcagctag

SEQ ID NO: 142893 - DNA, 3348 bp, Artificial Sequence
  Description of Artificial Sequence: Synthetic coding sequence
atgtcctggttcagcggcctgctggtgcccaaggtggatgagaggaagacagcctggggcgagagaaatggccagaagaggagcagaagaagaggcaccagggctgggggcttctgcaccccccgctacatgagctgcctgagagatgctgagccccccagccccaccccagctggccccccacgctgcccctggcaggatgatgccttcatccggcggggcggccctgggaagggcaaggagctgggcctgcgggctgtggccctgggctttgaggacacagaggtgaccaccacagctgggggcacagctgaggtggccccagatgctgtgcccaggagcggccgcagctgctggaggcggctggtgcaggtgttccagagcaagcagttccgcagcgccaagctggagcggctgtaccagcgctacttcttccagatgaaccagagcagcctgaccctgctgatggctgtgctggtgctgctgacagctgtgctgctggccttccacgccgccccagcccggccccagcctgcctacgtggccctgctggcctgtgccgccgccctgtttgtgggcctgatggtggtgtgcaacagacacagcttccggcaggacagcatgtgggtggtgtcctatgtggtgctgggcatcctggccgctgtgcaggtgggcggggccctggccgctgaccccaggagccccagcgctggcctgtggtgccctgtgttctttgtgtacatcgcctacaccctgctgcccatccgcatgagagctgctgtgctgagcggcctgggcctgagcaccctgcacctgatcctggcctggcagctgaacagaggagatgccttcctgtggaagcagctgggcgccaacgtgctgctcttcctgtgcaccaacgtcatcggcatctgcacccactacccagctgaggtgtcccagaggcaggccttccaggagacccggggctacatccaggcccggctgcacctgcagcacgagaaccggcagcaggagcggctgctgctgtctgtgctgccccagcacgtggccatggagatgaaggaggacatcaacaccaagaaggaggacatgatgttccacaagatctacatccagaagcatgacaacgtgtccatcctgtttgctgacatcgagggcttcaccagcctggccagccagtgcacagcccaggagctggtgatgaccctgaatgagctgtttgccaggtttgacaagctggccgctgagaaccactgcctgcgcatcaagatcctgggggactgctactactgtgtgtctggcctgcctgaggcccgggctgaccacgcccactgctgcgtggagatgggcgtggacatgattgaggccatcagcctggtgcgggaggtgactggagtgaatgtgaacatgagggtgggcatccacagcggccgggtgcactgcggcgtgctgggcctgaggaagtggcagtttgatgtgtggagcaatgatgtgaccctggccaaccacatggaggccggcggccgggccggccgcatccacatcacccgggccaccctgcagtacctgaatggagactatgaggtggagcccggccggggcggggagagaaatgcctacctgaaggagcagcacatcgagaccttcctgatcctgggcgccagccagaagaggaaggaggagaaggccatgctggccaagctgcagaggacccgggccaacagcatggagggcctgatgccccgctgggtgcctgaccgggccttcagcaggaccaaggacagcaaggccttccggcagatgggcattgatgacagcagcaaggacaacagaggcacccaggatgccctgaacccagaagatgaggtggatgagttcctgagccgggccattgatgcccggagcattgaccagctgaggaaggaccacgtgcggcgcttcctgctgaccttccagcgggaggacctggagaagaagtacagcaggaaggtggaccccaggtttggagcctacgtggcctgtgccctgctggtgttctgcttcatctgcttcatccagctgctgatcttcccccacagcaccctgatgctgggcatctatgccagcatcttcctgctgctgctgatcaccgtgctgatctgtgctgtgtacagctgtggcagcctcttccccaaggccctgcagaggctgagccgcagcatcgtgcgcagccgggcccacagcacagctgtgggcatcttctctgtgctgctggtgttcaccagcgccatcgccaacatgtacttcatcggcaacatgctgctgagcctgctggccagctctgtgttcctgcacatcagcagcatcggcaagctggccatgatctttgtgctgggcctcatctacctggtgctgctgctgctgggccccccagccaccatctttgacaactatgacctgctgctgggcgtgcacggcctggccagcagcaatgagacctttgatggcctggactgcccagctgctggccgggtggccctgaagtacatgacccctgtgatcctgctggtgtttgccctggccctgtacctgcacgcccagcaggtggagagcacagcccggctggacttcctgtggaagctgcaggccaccggggagaaggaggagatggaggagctgcaggcctacaacagaaggctgctgcacaacatcctgcccaaggatgtggccgcccacttcctggcccgggagaggagaaatgatgagctgtactaccagagctgtgaatgtgtggccgtgatgtttgccagcatcgccaacttcagcgagttctacgtggagctggaggccaacaatgaaggagtggagtgcctgcggctgctgaatgagatcatcgctgactttgatgagatcatcagcgaggagcgcttccggcagctggagaagatcaagaccatcggcagcacctacatggccgccagcggcctgaatgccagcacctatgaccaggtgggccgcagccacatcacagccctggccgactatgccatgaggctgatggagcagatgaagcacatcaatgagcacagcttcaacaacttccagatgaagattggcctgaacatgggccctgtggtggccggggtcatcggggccaggaagccccagtatgacatctggggcaacacagtgaatgtgagcagcaggatggacagcactggagtgcctgaccgcatccaggtgaccacagacctgtaccaggtgctggccgccaagggctaccagctggagtgccggggcgtggtgaaggtgaagggcaaaggagagatgaccacctacttcctgaatggaggccccagcagctag

SEQ ID NO: 142894 - DNA, 3348 bp, Artificial Sequence; identical to SEQ ID NO: 142893
  Description of Artificial Sequence: Synthetic coding sequence

SEQ ID NO: 142895 - DNA, 3243 bp, Artificial Sequence
  Description of Artificial Sequence: Synthetic coding sequence
atgcctgccaagggccgctacttcctgaatgaaggagaggagggccctgaccaggatgccctgtatgagaagtaccagctgaccagccagcacggccccctgctgctgaccctgctgctggtggccgccacagcctgtgtggccctgatcatcatcgccttcagccagggcgaccccagccgccaccaggccatcctgggcatggccttcctggtgctggccgtgtttgctgccctgtctgtgctgatgtatgtggagtgcctgctgcggcgctggctgcgggccctggccctgctgacctgggcctgcctggtggccctgggctacgtgctggtgtttgatgcctggaccaaggccgcctgtgcctgggagcaggtgcccttcttcctgttcatcgtgtttgtggtgtacaccctgctgcccttctccatgagaggagctgtggccgtgggcgctgtgtccacagccagccacctgctggtgctgggcagcctgatgggcggcttcaccaccccatctgtgcgggtgggcctgcagctgctggccaatgctgtgatcttcctgtgtggcaacctgactggagccttccacaagcaccagatgcaggatgccagccgggacctcttcacctacacagtgaagtgcatccagatccggaggaagctgcgcatcgagaagaggcagcaggagaacctgctgctgtctgtgctgcctgcccacatctccatgggcatgaagctggccatcatcgagcggctgaaggagcacggggaccggcgctgcatgccagacaacaacttccacagcctgtatgtgaagaggcaccagaatgtgtccatcctgtatgctgacatcgtgggcttcacccagctggccagtgactgcagccccaaggagctggtggtggtgctgaatgagctgtttgggaagtttgaccagatcgccaaggccaatgaatgcatgaggatcaagatcctgggggactgctactactgtgtgtctggcctgcctgtgtccctgcccacccacgccaggaactgtgtgaagatgggcctggacatgtgccaggccatcaagcaggtgcgggaggccactggagtggacatcaacatgagggtgggcatccacagcggaaatgtgctgtgtggggtgattggcctgaggaagtggcagtatgatgtgtggagccatgatgtgtccctggccaacaggatggaggccgccggcgtgcccggccgggtgcacatcacagaggccaccctgaagcacctggacaaggcctatgaggtggaggatggccacggccagcagagggacccctacctgaaggagatgaacatccgcacctacctggtgattgaccccaggagccagcagcccccaccacccagccagcacctgccccggcccaagggagatgctgccctgaagatgagggcctctgtgaggatgacccgctacctggagagctggggcgccgcccggccctttgcccacctgaaccaccgggagagcgtgagcagcggggagacccacgtgcccaatggaagaagacccaagtctgtgccccagaggcacaggaggaccccagaccgctccatgagccccaagggccgctcagaagatgacagctatgatgatgagatgctgagcgccatcgagggcctgagcagcacccggccctgctgcagcaagagtgatgacttctacaccttcggcagcatcttcctggagaagggctttgagcgggagtaccgcctggcccccatcccccgggcccggcatgactttgcctgtgccagcctcatctttgtgtgcatcctgctggtgcacgtgctgctgatgcccaggacagctgccctgggcgtgtcctttggcctggtggcctgtgtgctgggcctggtgctgggcctgtgctttgccaccaagttcagccgctgctgcccagcccggggcaccctgtgcaccatcagcgagcgggtggagacccagcccctgctgcggctgaccctggccgtgctgaccatcggcagcctgctgactgtggccatcatcaacctgcccctgatgcccttccaggtgcctgagctgcctgtgggcaatgaaacaggcctgctggccgccagcagcaagacccgggccctgtgtgagcccctgccctactacacctgcagctgtgtgctgggcttcatcgcctgcagcgtcttcctgaggatgagcctggagcccaaggtggtgctgctgactgtggccctggtggcctacctggtgctcttcaacctgagcccctgctggcagtgggactgctgcggccagggcctgggcaacctgaccaagcccaacggcaccaccagcggcacccccagctgctcctggaaggacctgaagaccatgaccaacttctacctggtgctcttctacatcaccctgctgaccctgagccggcagattgactactactgccgcctggactgcctgtggaagaagaagttcaagaaggagcacgaggagtttgagaccatggagaatgtgaaccggctgctgctggagaatgtgctgcctgcccacgtggccgcccacttcatcggggacaagctgaatgaagactggtaccaccagagctatgactgtgtgtgtgtgatgtttgcctctgtgcctgacttcaaggtgttctacacagaatgtgatgtgaacaaggagggcctggagtgcctgcggctgctgaatgagatcatcgctgactttgatgagctgctgctgaagcccaagttctctggagtggagaagatcaagaccatcggcagcacctacatggctgctgctggcctgtctgtggccagcggccacgagaaccaggagctggagcggcagcacgcccacatcggcgtgatggtggagttcagcatcgccctgatgagcaagctggatggcatcaacagacacagcttcaacagcttccggctgcgggtgggcatcaaccacggccctgtgattgctggggtcatcggggccaggaagccccagtatgacatctggggcaacacagtgaatgtggccagcaggatggagagcactggagagctgggcaagatccaggtgacagaggagacctgcaccatcctgcagggcctgggctacagctgtgaatgtcggggcctcatcaacgtgaagggcaaaggagagctgcggacctactttgtgtgcacagacacagccaagttccagggcctgggcctgaactag

SEQ ID NO: 142896 - DNA, 3243 bp, Artificial Sequence; identical to SEQ ID NO: 142895
  Description of Artificial Sequence: Synthetic coding sequence

SEQ ID NO: 142897 - DNA, 1302 bp, Artificial Sequence
  Description of Artificial Sequence: Synthetic coding sequence
atgcctgccaagggccgctacttcctgaatgaaggagaggagggccctgaccaggatgccctgtatgagaagtaccagctgaccagccagcacggccccctgctgctgaccctgctgctggtggccgccacagcctgtgtggccctgatcatcatcgccttcagccagggcgaccccagccgccaccaggccatcctgggcatggccttcctggtgctggccgtgtttgctgccctgtctgtgctgatgtatgtggagtgcctgctgcggcgctggctgcgggccctggccctgctgacctgggcctgcctggtggccctgggctacgtgctggtgtttgatgcctggaccaaggccgcctgtgcctgggagcaggtgcccttcttcctgttcatcgtgtttgtggtgtacaccctgctgcccttctccatgagaggagctgtggccgtgggcgctgtgtccacagccagccacctgctggtgctgggcagcctgatgggcggcttcaccaccccatctgtgcgggtgggcctgcagctgctggccaatgctgtgatcttcctgtgtggcaacctgactggagccttccacaagcaccagatgcaggatgccagccgggacctcttcacctacacagtgaagtgcatccagatccggaggaagctgcgcatcgagaagaggcagcaggagaacctgctgctgtctgtgctgcctgcccacatctccatgggcatgaagctggccatcatcgagcggctgaaggagcacggggaccggcgctgcatgccagacaacaacttccacagcctgtatgtgaagaggcaccagaatgtgtccatcctgtatgctgacatcgtgggcttcacccagctggccagtgactgcagccccaaggagctggtggtggtgctgaatgagctgtttgggaagtttgaccagatcgccaaggccaatgaatgcatgaggatcaagatcctgggggactgctactactgtgtgtctggcctgcctgtgtccctgcccacccacgccaggaactgtgtgaagatgggcctggacatgtgccaggccatcaagcaggtgcgggaggccactggagtggacatcaacatgagggtgggcatccacagcggaaatgtgctgtgtggggtgattggcctgaggaagtggcagtatgatgtgtggagccatgatgtgtccctggccaacaggatggaggccgccggcgtgcccggccgggtgcacatcacagaggccaccctgaagcacctggacaaggccctgctgctgcaggtgaggtag

SEQ ID NO: 142898 - DNA, 2205 bp, Artificial Sequence
  Description of Artificial Sequence: Synthetic coding sequence
atgcctgccaagggccgctacttcctgaatgaaggagaggagggccctgaccaggatgccctgtatgagaagtaccagctgaccagccagcacggccccctgctgctgaccctgctgctggtggccgccacagcctgtgtggccctgatcatcatcgccttcagccagggcgaccccagccgccaccaggccatcctgggcatggccttcctggtgctggccgtgtttgctgccctgtctgtgctgatgtatgtggagtgcctgctgcggcgctggctgcgggccctggccctgctgacctgggcctgcctggtggccctgggctacgtgctggtgtttgatgcctggaccaaggccgcctgtgcctgggagcaggtgcccttcttcctgttcatcgtgtttgtggtgtacaccctgctgcccttctccatgagaggagctgtggccgtgggcgctgtgtccacagccagccacctgctggtgctgggcagcctgatgggcggcttcaccaccccatctgtgcgggtgggcctgcagctgctggccaatgctgtgatcttcctgtgtggcaacctgactggagccttccacaagcaccagatgcaggatgccagccgggacctcttcacctacacagtgaagtgcatccagatccggaggaagctgcgcatcgagaagaggcagcaggagaacctgctgctgtctgtgctgcctgcccacatctccatgggcatgaagctggccatcatcgagcggctgaaggagcacggggaccggcgctgcatgccagacaacaacttccacagcctgtatgtgaagaggcaccagaatgtgtccatcctgtatgctgacatcgtgggcttcacccagctggccagtgactgcagccccaaggagctggtggtggtgctgaatgagctgtttgggaagtttgaccagatcgccaaggccaatgaatgcatgaggatcaagatcctgggggactgctactactgtgtgtctggcctgcctgtgtccctgcccacccacgccaggaactgtgtgaagatgggcctggacatgtgccaggccatcaagcaggtgcgggaggccactggagtggacatcaacatgagggtgggcatccacagcggaaatgtgctgtgtggggtgattggcctgaggaagtggcagtatgatgtgtggagccatgatgtgtccctggccaacaggatggaggccgccggcgtgcccggccgggtgcacatcacagaggccaccctgaagcacctggacaaggcctatgaggtggaggatggccacggccagcagagggacccctacctgaaggagatgaacatccgcacctacctggtgattgaccccaggagccagcagcccccaccacccagccagcacctgccccggcccaagggagatgctgccctgaagatgagggcctctgtgaggatgacccgctacctggagagctggggcgccgcccggccctttgcccacctgaaccaccgggagagcgtgagcagcggggagacccacgtgcccaatggaagaagacccaagtctgtgccccagaggcacaggaggaccccagaccgctccatgagccccaagggccgctcagaagatgacagctatgatgatgagatgctgagcgccatcgagggcctgagcagcacccggccctgctgcagcaagagtgatgacttctacaccttcggcagcatcttcctggagaagggctttgagcgggagtaccgcctggcccccatcccccgggcccggcatgactttgcctgtgccagcctcatctttgtgtgcatcctgctggtgcacgtgctgctgatgcccaggacagctgccctgggcgtgtcctttggcctggtggcctgtgtgctgggcctggtgctgggcctgtgctttgccaccaagttcagccgctgctgcccagcccggggcaccctgtgcaccatcagcgagcgggtggagacccagcccctgctgcggctgaccctggccgtgctgaccatcggcagcctgctgactgtggccatcatcaacctgcccctgatgcccttccaggtgcctgagctgcctgtgggcaatgaaacaggcctgctggccgccagcagcaagacccgggccctgtgtgagcccctgccccacctgcacacagtgttcagccggctgaatgagctgaccagctag

SEQ ID NO: 142899 - DNA, 3756 bp, Artificial Sequence
  Description of Artificial Sequence: Synthetic coding sequence
atggagctgagtgatgtgcgctgcctgaccggcagcgaggagctgtacaccatccaccccaccccacctgctggagatggccgcagcgccagccggccccagaggctgctgtggcagacagctgtgcgccacatcacagagcagcgcttcatccacggccaccggggcggcagcggcagcggcagcggcggcagcggcaaggccagtgaccctgctgggggcggccccaaccaccacgccccccagctgagcggggacagcgccctgcccctgtacagcctgggccctggagagcgggcccacagcacctgtggcaccaaggtgtttcctgagaggagcggcagcggcagcgccagcggcagcggcggcggcggggacctgggcttcctgcacctggactgtgcccccagcaacagcgacttcttcctgaatggaggctacagctacagaggagtcatcttccccaccctgaggaacagcttcaagagccgggacctggagcggctgtaccagcgctacttcctgggccagaggaggaagtctgaggtggtgatgaatgtgctggatgtgctgaccaagctgaccctgctggtgctgcacctgagcctggccagcgcccccatggaccccctgaagggcatcctgctgggcttcttcaccggcatcgaggtggtgatctgtgccctggtggtggtgaggaaggacaccaccagccacacctacctgcagtacagcggcgtggtgacctgggtggccatgaccacccagatcctggccgccggcctgggctacggcctgctgggagatggcatcggctacgtgctcttcaccctgtttgccacctacagcatgctgcccctgcccctgacctgggccatcctggccggcctgggcaccagcctgctgcaggtgatcctgcaggtggtgatcccccggctggccgtcatcagcatcaaccaggtggtggcccaggccgtgctcttcatgtgcatgaacacagctggcatcttcatctcctacctgagtgaccgggcccagaggcaggccttcctggagacccggcgctgtgtggaggcccggctgcggctggagacagagaaccagaggcaggagcggctggtgctgtctgtgctgcccaggtttgtggtgctggagatgatcaatgacatgaccaacgtggaggatgagcacctgcagcaccagttccaccgcatctacatccacagatatgaaaatgtgtccatcctgtttgctgatgtgaagggcttcaccaacctgagcaccaccctgagcgcccaggagctggtgaggatgctgaatgagctgtttgccaggtttgaccggctggcccacgagcaccactgcctgcgcatcaagatcctgggggactgctactactgtgtgtctggcctgcctgagccccggcaggaccacgcccactgctgcgtggagatgggcctgtccatgatcaagaccatccgctacgtgcgcagcaggaccaagcatgatgtggacatgagaattggcatccacagcggctctgtgctgtgtggggtgctgggcctgaggaagtggcagtttgatgtgtggagctgggatgtggacatcgccaacaagctggagagcggcggcatccctggccgcatccacatcagcaaggccaccctggactgcctgaatggagactacaacgtggaggagggccacggcaaggagagaaatgagttcctgaggaagcacaacatcgagacctacctgatcaagcagcctgaggacagcctgctgagcctgcctgaagatattgtgaaggagagcgtgagcagcagtgacagaagaaacagcggggccaccttcacagagggctcctggagccctgagctgccctttgacaacatcgtgggcaagcagaacaccctggccgccctgaccaggaacagcatcaacctgctgcccaaccacctggcccaggccctgcacgtgcagagcggccctgaggagatcaacaagagaattgagcacaccatcgacctgcggagcggggacaagctgcggcgggagcacatcaagcccttcagcctgatgttcaaggacagcagcctggagcacaagtacagccagatgagagatgaggtgttcaagagcaacctggtgtgtgccttcatcgtgctgctcttcatcacagccatccagagcctgctgcccagcagccgggtgatgcccatgaccatccagttcagcatcctgatcatgctgcacagcgccctggtgctgatcaccacagctgaggactacaagtgcctgcccctcatcctgaggaagacctgctgctggatcaatgagacctacctggccagaaatgtcatcatctttgccagcatcctgatcaacttcctgggcgccatcctgaacatcctgtggtgtgactttgacaagagcatccccctgaagaacctgaccttcaacagcagcgctgtgttcacagacatctgcagctacccagagtactttgtgttcaccggggtgctggccatggtgacctgtgctgtgttcctgcggctgaacagcgtgctgaagctggccgtgctgctgatcatgattgccatctatgccctgctgacagaaacagtgtatgccggcctcttcctgcgctatgacaacctgaaccacagcggggaggacttcctgggcaccaaggaggtgtccctgctgctgatggccatgttcctgctggccgtgttctaccacggccagcagctggagtacacagcccggctggacttcctgtggagggtgcaggccaaggaggagatcaatgagatgaaggagctgcgggagcacaatgaaaacatgctgaggaacatcctgcccagccacgtggcccggcacttcctggagaaggaccgggacaatgaggagctgtacagccagagctatgatgctgtgggcgtgatgtttgccagcatccctggctttgctgacttctacagccagacagagatgaacaaccagggcgtggagtgcctgcggctgctgaatgagatcatcgctgactttgatgagctgctgggggaggaccgcttccaggacatcgagaagatcaagaccatcggcagcacctacatggctgtgtctggcctgagccctgagaagcagcagtgtgaggacaagtggggccacctgtgtgccctggccgacttcagcctggccctgacagagagcatccaggagatcaacaagcacagcttcaacaactttgagctgagaattggcatcagccacggctctgtggtggccggcgtgattggagccaagaagccccagtatgacatctggggcaagacagtgaacctggccagcaggatggacagcactggagtgtctggccgcatccaggtgcctgaggagacctacctgatcctgaaggaccagggctttgcctttgactacagaggagagatctacgtgaagggcatcagcgagcaggagggcaagatcaagacctacttcctgctgggccgggtgcagcccaaccccttcatcctgcccccccggcggctgcccggccagtacagcctggccgctgtggtgctgggcctggtgcagagcctgaaccggcagaggcagaagcagctgctgaatgaaaacaacaacacaggcatcatcaagggccactacaacagaaggaccctgctgagccccagcggcacagagcccggggcccaggccgagggcacagacaagagtgacctgccctag

SEQ ID NO: 142900 - DNA, 4062 bp, Artificial Sequence
  Description of Artificial Sequence: Synthetic coding sequence
atggccagccccccccaccagcagctgctgcaccaccacagcacagaggtgtcctgtgacagcagcggggacagcaacagcgtgcgggtgaagatcaaccccaagcagctgagcagcaacagccaccccaagcactgcaagtacagcatcagcagcagctgcagcagcagcggggacagcggcggcgtgcccaggagagtgggcggcggcggccgcctgcggcggcagaagaagctgccccagctgtttgagcgggccagcagccgctggtgggaccccaagtttgattctgtgaacctggaggaggcctgcctggagcgctgcttcccccagacccagaggcgcttccgctatgccctcttctacatcggctttgcctgcctgctgtggagcatctactttgctgtgcacatgaggagccggctgattgtgatggtggccccagccctgtgcttcctgctggtgtgtgtgggcttcttcctgttcaccttcaccaagctgtatgcccggcactacgcctggaccagcctggccctgaccctgctggtgtttgccctgaccctggccgcccagttccaggtgctgacccctgtgtctggccgcggggacagcagcaacctgacagccacagcccggcccacagacacctgcctgagccaggtgggcagcttctccatgtgcatcgaggtgctcttcctgctgtacacagtgatgcacctgcccctgtacctgagcctgtgcctgggcgtggcctacagcgtgctgtttgagaccttcggctaccacttcagagatgaggcctgcttccccagccctggggccggggccctgcactgggagctgctgagccggggcctgctgcacggctgcatccacgccatcggcgtgcacctgtttgtgatgagccaggtgcgcagccgcagcaccttcctgaaggtgggccagagcatcatgcacggcaaggacctggaggtggagaaggccctgaaggagaggatgatccacagcgtgatgccccgcatcatcgcagatgacctgatgaagcagggagatgaggagagtgaaaattctgtgaagagacatgccaccagcagccccaagaacaggaagaagaagagcagcatccagaaggcccccatcgccttccggcccttcaagatgcagcagatcgaggaggtgtccatcctgtttgctgacatcgtgggcttcaccaagatgtctgccaacaagagcgcccacgccctggtgggcctgctgaatgacctgtttggccgctttgaccggctgtgtgaggagaccaagtgtgagaagatcagcaccctgggggactgctactactgtgtggccggctgcccagagcccagggctgaccacgcctactgctgcatcgagatgggcctgggcatgatcaaggccatcgagcagttctgccaggagaagaaggagatggtgaacatgagggtgggcgtgcacacaggcaccgtgctgtgtggcatcctgggcatgaggcgcttcaagtttgatgtgtggagcaatgatgtgaacctggccaacctgatggagcagctgggcgtggccggcaaggtgcacatcagcgaggccacagccaagtacctggatgacagatatgagatggaggatggcaaggtgattgagcggctgggccagagcgtggtggccgaccagctgaagggcctgaagacctacctgatcagcggccagagggccaaggagagccgctgcagctgtgccgaggccctgctgagcggctttgaggtgattgatggcagccaggtgagcagcggcccccggggccagggcacagccagcagtggaaatgtgtctgacctggcccagacagtgaagacctttgacaacctgaagacctgccccagctgtggcatcacctttgcccccaagtctgaggccggggctgagggcggggccccccagaatggctgccaggatgagcacaagaacagcaccaaggccagcggcggccccaaccccaagacccagaatggcctgctgagccccccccaggaggagaagctgaccaacagccagaccagcctgtgtgagatcctgcaggagaagggccgctgggccggcgtgtccctggaccagagcgccctgctgcccctgcgcttcaagaacatccgggagaagacagatgcccactttgtggatgtgatcaaggaggacagcctgatgaaggactacttcttcaagccacccatcaaccagttcagcctgaacttcctggaccaggagctggagaggagctaccgcaccagctaccaggaggaggtgatcaagaacagccctgtgaagacctttgccagccccaccttcagcagcctgctggatgtgttcctgagcaccaccgtcttcctgaccctgagcaccacctgcttcctgaagtatgaagctgccaccgtgcccccacctcctgctgccctggccgtgttttctgctgccctgctgctggaggtgctgagcctggccgtgtccatccgcatggtgttcttcctggaggatgtgatggcctgcaccaagaggctgctggagtggattgctggctggctgcccaggcactgcatcggggccatcctggtgtccctgcctgccctggccgtgtacagccacgtgaccagtgaatatgagaccaacatccacttccctgtgttcaccggcagcgctgccctgattgctgtggtgcactactgcaacttctgccagctgagctcctggatgaggagcagcctggccaccgtggtgggcgccggccccctgctgctgctgtatgtgtccctgtgcccagacagctctgtgctgaccagccccctggatgctgtgcagaacttcagcagcgagaggaacccctgcaacagctctgtgccccgggacctgcggcggcctgccagcctcatcggccaggaggtggtgctggtgttcttcctgctgctgctgctggtgtggttcctgaaccgggagtttgaggtgtcctaccgcctgcactaccatggagatgtggaggccgacctgcacaggaccaagatccagagcatgagggaccaggccgactggctgctgaggaacatcatcccctaccacgtggccgagcagctgaaggtgtcccagacctacagcaagaaccacgacagcggcggcgtcatctttgccagcatcgtgaacttcagcgagttctatgaagaaaattatgaaggaggcaaggagtgctacagagtgctgaatgagctgattggagactttgatgagctgctgagcaagccagactacagcagcattgagaagatcaagaccatcggggccacctacatggccgccagcggcctgaacacagcccaggcccaggacggcagccacccccaggagcacctgcagatcctgtttgaatttgccaaggagatgatgagggtggtggatgacttcaacaacaacatgctgtggttcaacttcaagctgcgggtgggcttcaaccacggccccctgacagctggggtgattggcaccaccaagctgctgtatgacatctggggagacacagtgaacatcgccagcaggatggacaccaccggggtggagtgccgcatccaggtgtctgaggagagctacagagtgctgagcaagatgggctatgactttgactaccggggcaccgtgaatgtgaagggcaagggccagatgaagacctacctgtaccccaagtgcacagaccacagggtcatcccccagcaccagctgagcatcagcccagacatccgggtgcaggtggatggcagcatcggccgcagccccacagatgagatcgccaacctggtgcccagcgtgcagtatgtggacaagaccagcctgggcagtgacagcagcacccaggccaaggatgcccacctgagccccaagaggccctggaaggagcctgtgaaggccgaggagcggggccgctttgggaaggccatcgagaaggatgactgtgatgagaccggcatcgaggaggccaatgagctgaccaagctgaatgtgtccaagtctgtgtag

SEQ ID NO: 142901 - DNA, 531 bp, Artificial Sequence
  Description of Artificial Sequence: Synthetic coding sequence
atgaccatgtgcagcggggcccggctggccctgctggtgtatggcatcatcatgcacagctctgtgtacagcagccctgctgctgctggcctgcgcttccctggcatccggcctgaggaggaggcctatggagaagatggcaaccccctgcctgactttgatggcagcgagcccccaggagctggcagccctgccagcgcccccagggctgctgctgcctggtacagacctgctggaagaagagatgtggcccacggcatcctgaatgaggcctacaggaaggtgctggaccagctgtctgctgggaagcacctgcagagcctggtggcccggggcgtgggcggcagcctgggcggcggcgctggagatgatgctgagcccctgagcaagaggcacagtgatggcatcttcacagacagctacagccgctacaggaagcagatggctgtgaagaagtacctggccgctgtgctgggcaagcgctacaagcagagggtgaagaacaagggcagaagaattgcctacctgtag

SEQ ID NO: 142902 - DNA, 531 bp, Artificial Sequence; identical to SEQ ID NO: 142901
  Description of Artificial Sequence: Synthetic coding sequence

SEQ ID NO: 142903 - DNA, 948 bp, Artificial Sequence
  Description of Artificial Sequence: Synthetic coding sequence
atgctgaccaagagggccctgcagaagccctgcagcgaccgcttcctgaggacagcccagatcaacagaagcagaagacctgtgacctctgtgaccagcggcagcagcagccgcagccgggccagcccccaccggcccctcttcctgagcagcgccagcctgagcgccccacccagcctgcgggtgaccctgcccccaggcagcgcccggctgcagacctttgagcagaacaccagcctgggcaagagggtgccccagctgctgctgctgctgcccctggtgcctgctgccagcgcccagacccccaccccagatggagatgccagccgggtggtgaccccagcccaggagctggaggaggccctgtgcccccccagctacctggccgccctgctggccgccggcggcgtggagggcatgaccatgtgcagcggggcccggctggccctgctggtgtatggcatcatcatgcacagctctgtgtacagcagccctgctgctgctggcctgcgcttccctggcatccggcctgaggaggaggcctacggggaggatggcaaccccctgcctgactttgatggcagcgagcccccaggggccggcagccctgccagcgcccccagggctgctgctgcctggtacagacctgctggaagaagagatgtggcccacggcatcctgaatgaggcctacaggaaggtgctggaccagctgtctgctgggaagcacctgcagagcctggtggcccggggcgtgggcggcagcctgggcggcggcgctggagatgatgctgagcccctgagcaagaggcacagtgatggcatcttcacagacagctacagccgctacaggaagcagatggctgtgaagaagtacctggccgctgtgctgggcaagcgctacaagcagagggtgaagaacaagggccgccgcatcgcctacctgtag

SEQ ID NO: 142904 - DNA, 531 bp, Artificial Sequence; identical to SEQ ID NO: 142901
  Description of Artificial Sequence: Synthetic coding sequence

SEQ ID NO: 142905 - DNA, 1407 bp, Artificial Sequence
  Description of Artificial Sequence: Synthetic coding sequence
atggccggcgtggtgcacgtgtccctggccgccctgctgctgctgcccatggccccagccatgcacagcgactgcatcttcaagaaggagcaggccatgtgcctggagaagatccagagggccaatgagctgatgggcttcaatgacagcagccctggctgccccggcatgtgggacaacatcacctgctggaagccagcccacgtgggggagatggtgctggtgtcctgcccagagctgttccgcatcttcaacccagaccaggtgtgggagacagagaccatcggggagagtgactttggagacagcaacagcctggacctgagtgacatgggcgtggtgtccaggaactgcacagaagatggctggagcgagcccttcccccactactttgatgcctgtggctttgatgaatatgaaagtgaaacaggagaccaggactactactacctgtctgtgaaggccctgtacacagtgggctacagcaccagcctggtgaccctgaccacagccatggtgatcctgtgccgcttcaggaagctgcactgcaccaggaacttcatccacatgaacctgtttgtgtccttcatgctgcgggccatcagcgtcttcatcaaggactggatcctgtatgcagagcaggacagcaaccactgcttcatcagcacagtggagtgcaaggctgtgatggtgttcttccactactgtgtggtgagcaactacttctggctgttcatcgagggcctgtacctgttcaccctgctggtggagaccttcttccctgagcggcgctacttctactggtacaccatcatcggctggggcacccccaccgtgtgtgtgacagtgtgggccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacctgcggctggcccggagcaccctgctgctgatccccctgtttggcatccactacacagtgtttgccttctccccagaaaatgtgtccaagcgggagcggctggtgtttgagctgggcctgggcagcttccagggctttgtggtggccgtgctgtactgcttcctgaatggagaggtgcaggccgagatcaagaggaagtggaggtcctggaaggtgaaccgctactttgctgtggacttcaagcaccgccaccccagcctggccagcagcggcgtgaatggaggcacccagctgagcatcctgagcaagagcagcagccagatccgcatgagcggcctgcctgctgacaacctggccacctag

SEQ ID NO: 142906 - DNA, 594 bp, Artificial Sequence
  Description of Artificial Sequence: Synthetic coding sequence
atggtgttcttccactactgtgtggtgagcaactacttctggctgttcatcgagggcctgtacctgttcaccctgctggtggagaccttcttccctgagcggcgctacttctactggtacaccatcatcggctggggcacccccaccgtgtgtgtgacagtgtgggccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacctgaccaacctgagcccccgggtgcccaagaaggcccgggaggaccccctgcctgtgcccagcgaccagcacagcctgcccttcctgagctgtgtgcagaagtgctactgcaagccccagagggcccagcagcacagctgcaagatgtctgagctgagcaccatcaccctgcggctggcccggagcaccctgctgctgatccccctgtttggcatccactacacagtgtttgcctag

SEQ ID NO: 142907 - DNA, 1491 bp, Artificial Sequence
  Description of Artificial Sequence: Synthetic coding sequence
atggccggcgtggtgcacgtgtccctggccgccctgctgctgctgcccatggccccagccatgcacagcgactgcatcttcaagaaggagcaggccatgtgcctggagaagatccagagggccaatgagctgatgggcttcaatgacagcagccctggctgccccggcatgtgggacaacatcacctgctggaagccagcccacgtgggggagatggtgctggtgtcctgcccagagctgttccgcatcttcaacccagaccaggtgtgggagacagagaccatcggggagagtgactttggagacagcaacagcctggacctgagtgacatgggcgtggtgtccaggaactgcacagaagatggctggagcgagcccttcccccactactttgatgcctgtggctttgatgaatatgaaagtgaaacaggagaccaggactactactacctgtctgtgaaggccctgtacacagtgggctacagcaccagcctggtgaccctgaccacagccatggtgatcctgtgccgcttcaggaagctgcactgcaccaggaacttcatccacatgaacctgtttgtgtccttcatgctgcgggccatcagcgtcttcatcaaggactggatcctgtatgcagagcaggacagcaaccactgcttcatcagcacagtggagtgcaaggctgtgatggtgttcttccactactgtgtggtgagcaactacttctggctgttcatcgagggcctgtacctgttcaccctgctggtggagaccttcttccctgagcggcgctacttctactggtacaccatcatcggctggggcacccccaccgtgtgtgtgacagtgtgggccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacttcagctgtgtgcagaagtgctactgcaagccccagagggcccagcagcacagctgcaagatgtctgagctgagcaccatcaccctgcggctggcccggagcaccctgctgctgatccccctgtttggcatccactacacagtgtttgccttctccccagaaaatgtgtccaagcgggagcggctggtgtttgagctgggcctgggcagcttccagggctttgtggtggccgtgctgtactgcttcctgaatggagaggtgcaggccgagatcaagaggaagtggaggtcctggaaggtgaaccgctactttgctgtggacttcaagcaccgccaccccagcctggccagcagcggcgtgaatggaggcacccagctgagcatcctgagcaagagcagcagccagatccgcatgagcggcctgcctgctgacaacctggccacctag

SEQ ID NO: 142908 - DNA, 1575 bp, Artificial Sequence
  Description of Artificial Sequence: Synthetic coding sequence
atggccggcgtggtgcacgtgtccctggccgccctgctgctgctgcccatggccccagccatgcacagcgactgcatcttcaagaaggagcaggccatgtgcctggagaagatccagagggccaatgagctgatgggcttcaatgacagcagccctggctgccccggcatgtgggacaacatcacctgctggaagccagcccacgtgggggagatggtgctggtgtcctgcccagagctgttccgcatcttcaacccagaccaggtgtgggagacagagaccatcggggagagtgactttggagacagcaacagcctggacctgagtgacatgggcgtggtgtccaggaactgcacagaagatggctggagcgagcccttcccccactactttgatgcctgtggctttgatgaatatgaaagtgaaacaggagaccaggactactactacctgtctgtgaaggccctgtacacagtgggctacagcaccagcctggtgaccctgaccacagccatggtgatcctgtgccgcttcaggaagctgcactgcaccaggaacttcatccacatgaacctgtttgtgtccttcatgctgcgggccatcagcgtcttcatcaaggactggatcctgtatgcagagcaggacagcaaccactgcttcatcagcacagtggagtgcaaggctgtgatggtgttcttccactactgtgtggtgagcaactacttctggctgttcatcgagggcctgtacctgttcaccctgctggtggagaccttcttccctgagcggcgctacttctactggtacaccatcatcggctggggcacccccaccgtgtgtgtgacagtgtgggccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacctgaccaacctgagcccccgggtgcccaagaaggcccgggaggaccccctgcctgtgcccagcgaccagcacagcctgcccttcctgagctgtgtgcagaagtgctactgcaagccccagagggcccagcagcacagctgcaagatgtctgagctgagcaccatcaccctgcggctggcccggagcaccctgctgctgatccccctgtttggcatccactacacagtgtttgccttctccccagaaaatgtgtccaagcgggagcggctggtgtttgagctgggcctgggcagcttccagggctttgtggtggccgtgctgtactgcttcctgaatggagaggtgcaggccgagatcaagaggaagtggaggtcctggaaggtgaaccgctactttgctgtggacttcaagcaccgccaccccagcctggccagcagcggcgtgaatggaggcacccagctgagcatcctgagcaagagcagcagccagatccgcatgagcggcctgcctgctgacaacctggccacctag

SEQ ID NO: 142909 - DNA, 225 bp, Artificial Sequence
  Description of Artificial Sequence: Synthetic coding sequence
atggccggcgtggtgcacgtgtccctggccgccctgctgctgctgcccatggccccagccatgcacagcgactgcatcttcaagaaggagcaggccatgtgcctggagaagatccagagggccaatgagctgatgggcttcaatgacagcagccctggctgccccggcatgtgggacaacatcacctgctggaagccagcccacgtgggggagatggtgctgtag

SEQ ID NO: 142910 - DNA, 447 bp, Artificial Sequence
  Description of Artificial Sequence: Synthetic coding sequence
tgagccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacctgaccaacctgagcccccgggtgcccaagaaggcccgggaggaccccctgcctgtgcccagcgaccagcacagcctgcccttcctgcggctggcccggagcaccctgctgctgatccccctgtttggcatccactacacagtgtttgccttctccccagaaaatgtgtccaagcgggagcggctggtgtttgagctgggcctgggcagcttccagggctttgtggtggccgtgctgtactgcttcctgtag

SEQ ID NO: 142911 - DNA, 1344 bp, Artificial Sequence
  Description of Artificial Sequence: Synthetic coding sequence
atggccggcgtggtgcacgtgtccctggccgccctgctgctgctgcccatggccccagccatgcacagcgactgcatcttcaagaaggagcaggccatgtgcctggagaagatccagagggccaatgagctgatgggcttcaatgacagcagccctggctgccccggcatgtgggacaacatcacctgctggaagccagcccacgtgggggagatggtgctggtgtcctgcccagagctgttccgcatcttcaacccagaccaggacatgggcgtggtgtccaggaactgcacagaagatggctggagcgagcccttcccccactactttgatgcctgtggctttgatgaatatgagagcgagaccggggaccaggactactactacctgtctgtgaaggccctgtacacagtgggctacagcaccagcctggtgaccctgaccacagccatggtgatcctgtgccgcttcaggaagctgcactgcaccaggaacttcatccacatgaacctgtttgtgtccttcatgctgcgggccatctctgtgttcatcaaggactggatcctgtatgcagagcaggacagcaaccactgcttcatcagcacagtggagtgcaaggctgtgatggtgttcttccactactgtgtggtgagcaactacttctggctgttcatcgagggcctgtacctgttcaccctgctggtggagaccttcttccctgagcggcgctacttctactggtacaccatcatcggctggggcacccccaccgtgtgtgtgacagtgtgggccaccctgcggctgtactttgatgacaccggctgctgggacatgaatgacagcacagccctgtggtgggtgatcaagggccctgtggtgggcagcatcatggtgaactttgtgctcttcatcggcatcatcgtcatcctggtgcagaagctgcagagcccagacatgggcggcaatgaaagcagcatctacctgcggctggcccggagcaccctgctgctgatccccctgtttggcatccactacacagtgtttgccttctccccagaaaatgtgtccaagcgggagcggctggtgtttgagctgggcctgggcagcttccagggctttgtggtggccgtgctgtactgcttcctgaatggagaggtgcaggccgagatcaagaggaagtggaggtcctggaaggtgaaccgctactttgctgtggacttcaagcaccgccaccccagcctggccagcagtggagtgaatggaggcacccagctgagcatcctgagcaagagcagcagccagatccgcatgagcggcctgcctgctgacaacctggccacctag

SEQ ID NO: 142912 - DNA, 705 bp, Artificial Sequence
  Description of Artificial Sequence: Synthetic coding sequence
atggaccccggcctgcagcaggccctgaatggcatggcccctcctggggacacagccatgcacgtgcctgctggctctgtggccagccacctgggcaccaccagccgcagctacttctacctgaccacagccaccctggccctgtgcctggtgttcaccgtggccaccatcatggtgctggtggtgcagaggacagacagcatccccaacagcccagacaacgtgcccctgaagggcggcaactgcagcgaggacctgctgtgcatcctgaagagggcccccttcaagaagtcctgggcctacctgcaggtggccaagcacctgaacaagaccaagctgtcctggaacaaggatggcatcctgcacggcgtgcgctaccaggacggcaacctggtgatccagtttcctggcctgtacttcatcatctgccagctgcagttcctggtgcagtgccccaacaacagcgtggacctgaagctggagctgctgatcaacaagcacatcaagaagcaggccctggtgacagtgtgtgagagcggcatgcagaccaagcacgtgtaccagaacctgagccagttcctgctggactacctgcaggtgaacaccaccatctctgtgaatgtggacaccttccagtacatcgacaccagcaccttccccctggagaatgtgctgagcatcttcctgtacagcaacagcgactag

SEQ ID NO: 142913 - DNA, 585 bp, Artificial Sequence
  Description of Artificial Sequence: Synthetic coding sequence
atggaggagaagctgaagaagaccaagatcatctttgtggtgggcggccctggcagcggcaagggcacccagtgtgagaagatcgtgcagaagtatggctacacccacctgagcactggagacctgctgcggtctgaggtgagcagcggcagcgcccggggcaagaagctgtctgagatcatggagaagggccagctggtgcccctggagaccgtgctggacatgctgagagatgccatggtggccaaggtgaacaccagcaagggcttcctgattgatggctacccccgggaggtgcagcagggcgaggagtttgaaagaagaattggccagcccaccctgctgctgtatgtggatgctggccctgagaccatgacccagaggctgctgaagagaggagagaccagcggccgggtggatgacaatgaggagaccatcaagaagaggctggagacctactacaaggccacagagcctgtgattgccttctatgagaagaggggcatcgtgaggaaggtgaatgctgagggctctgtggacagcgtcttcagccaggtgtgcacccacctggatgccctgaagtag

SEQ ID NO: 142914 - DNA, 585 bp, Artificial Sequence; identical to SEQ ID NO: 142913
  Description of Artificial Sequence: Synthetic coding sequence

SEQ ID NO: 142915 - DNA, 720 bp, Artificial Sequence
  Description of Artificial Sequence: Synthetic coding sequence
atggcccccagcgtgcctgctgctgagcctgagtaccccaagggcatccgggctgtgctgctgggccccccaggggccggcaagggcacccaggccccccggctggccgagaacttctgtgtgtgccacctggccaccggggacatgctgcgggccatggtggccagcggcagcgagctgggcaagaagctgaaggccaccatggatgctgggaagctggtgtctgatgagatggtggtggagctgattgagaagaacctggagacccccctgtgcaagaatggcttcctgctggatggcttccccaggacagtgcggcaggccgagatgctggatgacctgatggagaagaggaaggagaagctggacagcgtcatcgagttcagcatcccagacagcctgctgatccgccgcatcaccggccgcctcatccaccccaagagcggccgcagctaccacgaggagttcaacccccccaaggagcccatgaaggatgacatcaccggggagcccctcatccgccgcagtgatgacaatgagaaggccctgaagatccggctgcaggcctaccacacccagaccacccccctcatcgagtactacaggaagaggggcatccacagcgccattgatgccagccagaccccagatgtggtgtttgccagcatcctggccgccttcagcaaggccacctgcaaggacctggtgatgttcatctag

SEQ ID NO: 142916 - DNA, 699 bp, Artificial Sequence
  Description of Artificial Sequence: Synthetic coding sequence
atggcccccagcgtgcctgctgctgagcctgagtaccccaagggcatccgggctgtgctgctgggccccccaggggccggcaagggcacccaggccccccggctggccgagaacttctgtgtgtgccacctggccaccggggacatgctgcgggccatggtggccagcggcagcgagctgggcaagaagctgaaggccaccatggatgctgggaagctggtgtctgatgagatggtggtggagctgattgagaagaacctggagacccccctgtgcaagaatggcttcctgctggatggcttccccaggacagtgcggcaggccgagatgctggatgacctgatggagaagaggaaggagaagctggacagcgtcatcgagttcagcatcccagacagcctgctgatccgccgcatcaccggccgcctcatccaccccaagagcggccgcagctaccacgaggagttcaacccccccaaggagcccatgaaggatgacatcaccggggagcccctcatccgccgcagtgatgacaatgagaaggccctgaagatccggctgcaggcctaccacacccagaccacccccctcatcgagtactacaggaagaggggcatccacagcgccattgatgccagccagaccccagatgtggtgtttgccagcatcctggccgccttcagcaaggccaccagctag

SEQ ID NO: 142917 - DNA, 609 bp, Artificial Sequence
  Description of Artificial Sequence: Synthetic coding sequence
atggcccccagcgtgcctgctgctgagcctgagtaccccaagggcatccgggctgtgctgctgggccccccaggggccggcaagggcacccaggccccccggctggccgagaacttctgtgtgtgccacctggccaccggggacatgctgcgggccatggtggccagcggcagcgagctgggcaagaagctgaaggccaccatggatgctgggaagctggtgtctgatgagatggtggtggagctgattgagaagaacctggagacccccctgtgcaagaatggcttcctgctggatggcttccccaggacagtgcggcaggccgagatgctggatgacctgatggagaagaggaaggagaagctggacagcgtcatcgagttcagcatcccagacagcctgctgatccgccgcatcaccggccgcctcatccaccccaagagcggccgcagctaccacgaggagttcaacccccccaaggagcccatgaaggatgacatcaccggggagcccctcatccgccgcagcgtcatcggccaggccaagaggagcttcctgcggctggccaagatcagctttgatgtgctgatcaagaaggccctggcctag

SEQ ID NO: 142918 - DNA, 474 bp, Artificial Sequence
  Description of Artificial Sequence: Synthetic coding sequence
atgacccggctggccctgcacgagctgaagaacctgacccagtacagctggctgctggatggcttccccaggaccctgccccaggccgaggccctggaccgggcctaccagattgacaccgtcatcaacctgaatgtgccctttgaggtgatcaagcagaggctgacagcccgctggatccacccagccagcggccgggtgtacaacatcgagttcaacccccccaagacagtgggcattgatgacctgaccggggagcccctcatccagcgggaggatgacaagccagagaccgtcatcaagaggctgaaggcctatgaggaccagaccaagcctgtgctggagtactaccagaagaagggcgtgctggagaccttctctggaacagagaccaacaagatctggccctacgtgtatgccttcctgcagaccaaggtgccccagaggagccagaaggcctctgtgaccccctag

SEQ ID NO: 142919 - DNA, 684 bp, Artificial Sequence
  Description of Artificial Sequence: Synthetic coding sequence
atgggcgccagcgcccggctgctgcgggccgtcatcatgggcgcccctggcagcggcaagggcaccgtgagcagccgcatcaccacccactttgagctgaagcacctgagcagcggggacctgctgcgggacaacatgctgcggggcacagaaattggagtgctggccaaggccttcatcgaccagggcaagctgatcccagatgatgtgatgacccggctggccctgcacgagctgaagaacctgacccagtacagctggctgctggatggcttccccaggaccctgccccaggccgaggccctggaccgggcctaccagattgacaccgtcatcaacctgaatgtgccctttgaggtgatcaagcagaggctgacagcccgctggatccacccagccagcggccgggtgtacaacatcgagttcaacccccccaagacagtgggcattgatgacctgaccggggagcccctcatccagcgggaggatgacaagccagagaccgtcatcaagaggctgaaggcctatgaggaccagaccaagcctgtgctggagtactaccagaagaagggcgtgctggagaccttctctggaacagagaccaacaagatctggccctacgtgtatgccttcctgcagaccaaggtgccccagaggagccagaaggcctctgtgaccccctag

SEQ ID NO: 142920 - DNA, 564 bp, Artificial Sequence
  Description of Artificial Sequence: Synthetic coding sequence
atgggcgccagcgcccggctgctgcgggccgtcatcatgggcgcccctggcagcggcaagggcaccgtgagcagccgcatcaccacccactttgagctgaagcacctgagcagcggggacctgctgcgggacaacatgctgcggggcaccggcttccccaggaccctgccccaggccgaggccctggaccgggcctaccagattgacaccgtcatcaacctgaatgtgccctttgaggtgatcaagcagaggctgacagcccgctggatccacccagccagcggccgggtgtacaacatcgagttcaacccccccaagacagtgggcattgatgacctgaccggggagcccctcatccagcgggaggatgacaagccagagaccgtcatcaagaggctgaaggcctatgaggaccagaccaagcctgtgctggagtactaccagaagaagggcgtgctggagaccttctctggaacagagaccaacaagatctggccctacgtgtatgccttcctgcagaccaaggtgccccagaggagccagaaggcctctgtgaccccctag

SEQ ID NO: 142921 - DNA, 474 bp, Artificial Sequence; identical to SEQ ID NO: 142918
  Description of Artificial Sequence: Synthetic coding sequence

SEQ ID NO: 142922 - DNA, 1611 bp, Artificial Sequence
  Description of Artificial Sequence: Synthetic coding sequence
atgtgcagcaagccagaggaccctgtggagtacctggagagctgcctgcagaaggtgaaggagctgggcggctgtgacaaggtgaagtgggacacctttgtgtcccaggagaagaagaccctgccccccctgaatggaggccagagccgccgctccttcctgagaaatgtgatgcctgagaacagcaacttcccctacagaagatatgaccggctgccccccatccaccagttcagcattgaaagtgacacagacctgtctgaaacagctgagctgattgaggagtatgaggtgtttgaccccacccggccccggcccaagatcatcctggtgattggaggccctggcagcggcaagggcacccagagcctgaagattgctgagagatatggcttccagtacatctctgtgggggagctgctgaggaagaagatccacagcaccagcagcaacaggaagtggagcctgattgccaagatcatcaccactggagagctggccccccaggagaccaccatcacagagatcaagcagaagctgatgcagatcccagatgaggagggcatcgtgattgatggcttccccagagatgtggcccaggccctgagctttgaggaccagatctgcaccccagacctggtggtgttcctggcctgtgccaaccagaggctgaaggagcggctgctgaagagagctgagcagcagggccgcccagatgacaacgtgaaggccacccagaggcggctgatgaacttcaagcagaatgctgcccccctggtgaagtacttccaggagaagggcctcatcatgacctttgatgctgacagagatgaagatgaggtgttctatgacatctccatggctgtggacaacaagctgttccccaacaaggaggccgctgctggcagcagtgacctggaccccagcatgatcctggacaccggggagatcatcgacaccggcagtgactatgaggaccagggagatgaccagctgaatgtgtttggagaggacaccatgggcggcttcatggaggacctgaggaagtgcaagatcatcttcatcatcggcggccctggcagcggcaagggcacccagtgtgagaagctggtggagaagtatggcttcacccacctgagcactggagagctgctgcgggaggagctggccagcgagagcgagaggagcaagctgatccgggacatcatggagcggggggacctggtgcccagcggcatcgtgctggagctgctgaaggaggccatggtggccagcctgggggacacccggggcttcctgattgatggctacccccgggaggtgaagcagggcgaggagtttggaagaagaattggagacccccagctggtgatctgcatggactgcagcgctgacaccatgaccaaccggctgctgcagaggagccgcagcagcctgcctgtggatgacaccaccaagaccatcgccaagaggctggaggcctactaccgggccagcatccctgtgattgcctactatgagaccaagacccagctgcacaagatcaatgctgagggcaccccagaagatgtgttcctgcagctgtgcacagccatcgacagcatcttctag

SEQ ID NO: 142923 - DNA, 1689 bp, Artificial Sequence
  Description of Artificial Sequence: Synthetic coding sequence
atgaacaccaatgatgccaaggagtacctggcccggcgggagatcccccagctgtttgagagcctgctgaatggcctgatgtgcagcaagccagaggaccctgtggagtacctggagagctgcctgcagaaggtgaaggagctgggcggctgtgacaaggtgaagtgggacacctttgtgtcccaggagaagaagaccctgccccccctgaatggaggccagagccgccgctccttcctgagaaatgtgatgcctgagaacagcaacttcccctacagaagatatgaccggctgccccccatccaccagttcagcattgaaagtgacacagacctgtctgaaacagctgagctgattgaggagtatgaggtgtttgaccccacccggccccggcccaagatcatcctggtgattggaggccctggcagcggcaagggcacccagagcctgaagattgctgagagatatggcttccagtacatctctgtgggggagctgctgaggaagaagatccacagcaccagcagcaacaggaagtggagcctgattgccaagatcatcaccactggagagctggccccccaggagaccaccatcacagagatcaagcagaagctgatgcagatcccagatgaggagggcatcgtgattgatggcttccccagagatgtggcccaggccctgagctttgaggaccagatctgcaccccagacctggtggtgttcctggcctgtgccaaccagaggctgaaggagcggctgctgaagagagctgagcagcagggccgcccagatgacaacgtgaaggccacccagaggcggctgatgaacttcaagcagaatgctgcccccctggtgaagtacttccaggagaagggcctcatcatgacctttgatgctgacagagatgaagatgaggtgttctatgacatctccatggctgtggacaacaagctgttccccaacaaggaggccgctgctggcagcagtgacctggaccccagcatgatcctggacaccggggagatcatcgacaccggcagtgactatgaggaccagggagatgaccagctgaatgtgtttggagaggacaccatgggcggcttcatggaggacctgaggaagtgcaagatcatcttcatcatcggcggccctggcagcggcaagggcacccagtgtgagaagctggtggagaagtatggcttcacccacctgagcactggagagctgctgcgggaggagctggccagcgagagcgagaggagcaagctgatccgggacatcatggagcggggggacctggtgcccagcggcatcgtgctggagctgctgaaggaggccatggtggccagcctgggggacacccggggcttcctgattgatggctacccccgggaggtgaagcagggcgaggagtttggaagaagaattggagacccccagctggtgatctgcatggactgcagcgctgacaccatgaccaaccggctgctgcagaggagccgcagcagcctgcctgtggatgacaccaccaagaccatcgccaagaggctggaggcctactaccgggccagcatccctgtgattgcctactatgagaccaagacccagctgcacaagatcaatgctgagggcaccccagaagatgtgttcctgcagctgtgcacagccatcgacagcatcttctag

SEQ ID NO: 142924 - DNA, 531 bp, Artificial Sequence
  Description of Artificial Sequence: Synthetic coding sequence
atgtgcagcaagccagaggaccctgtggagtacctggagagctgcctgcagaaggtgaaggagctgggcggctgtgacaaggtgaagtgggacacctttgtgtcccaggagaagaagaccctgccccccctgaatggaggccagagccgccgctccttcctgagaaatgtgatgcctgagaacagcaacttcccctacagaagatatgaccggctgccccccatccaccagttcagcattgaaagtgacacagacctgtctgaaacagctgagctgattgaggagtatgaggtgtttgaccccacccggccccggcccaagatcatcctggtgattggaggccctggcagcggcaagggcacccagagcctgaagattgctgagagatatggcttccagtacatctctgtgggggagctgctgaggaagaagatccacagcaccagcagcaacaggaagtggagcctgattgccaagatcatcaccactggagagctggccccccaggagaccaccatcacagagatctag

SEQ ID NO: 142925 - DNA, 1647 bp, Artificial Sequence
  Description of Artificial Sequence: Synthetic coding sequence
atggccaagttcatgacccctgtgatccaggacaaccccagcggctggggcccctgtgctgtgcctgagcagttccgggacatgccctaccagcccttcagcaaaggagaccggctgggcaaggtggccgactggacaggagccacctaccaggacaagcgctacaccaacaagtacagcagccagtttggaggcggcagccagtatgcctacttccatgaagaagatgagagcagcttccagctggtggacacagcccggacccagaagacagcctaccagaggaacaggatgagatttgcccagaggaacctgcggcgggacaaggacagaagaaacatgctgcagttcaacctgcagatcctgcccaagagcgccaagcagaaggagcgggagcgcatccggctgcagaagaagttccagaagcagtttggagtgcggcagaagtgggaccagaagagccagaagccccgggacagctctgtggaggtgcggagtgactgggaggtgaaggaggagatggacttcccccagctgatgaagatgagatacctggaggtgtctgagccccaggacatcgagtgctgcggggccctggagtactatgacaaggcctttgaccgcatcaccaccaggtctgagaagcccctgcggagcatcaagaggatcttccacacagtgaccaccacagatgatcctgtgatcaggaagctggccaagacccagggcaatgtgtttgccacagatgccatcctggccaccctgatgagctgcaccaggtctgtgtacagctgggacatcgtggtgcagagggtgggcagcaagctgttctttgacaagagggacaacagcgactttgacctgctgactgtgtctgaaacagccaatgagcccccccaggatgagggcaacagcttcaacagccccaggaacctggccatggaggccacctacatcaaccacaacttcagccagcagtgcctgaggatgggcaaggagcgctacaacttccccaaccccaacccctttgtggaggatgacatggacaagaatgaaattgcctctgtggcctaccgctaccgccgctggaagctgggagatgacatcgacctgattgtgcgctgtgaacatgatggagtgatgaccggggccaatggagaggtgtccttcatcaacatcaagaccctgaatgagtgggacagccgccactgcaatggagtggactggaggcagaagctggacagccagagaggagctgtgattgccacagagctgaagaacaacagctacaagctggcccgctggacctgctgtgccctgctggccggcagcgagtacctgaagctgggctacgtgagccgctaccacgtgaaggacagcagcagacatgtgatcctgggcacccagcagttcaagcccaatgaatttgccagccagatcaacctgtctgtggagaatgcctggggcatcctgcgctgtgtgattgacatctgcatgaagctggaggagggcaagtacctgatcctgaaggaccccaacaagcaggtgatccgggtgtacagcctgcctgatggcaccttcagcagtgatgaagatgaggaggaggaggaggaggaggaggaggaggaggaggaggaggagacctag

SEQ ID NO: 142926 - DNA, 1278 bp, Artificial Sequence
  Description of Artificial Sequence: Synthetic coding sequence
atggctgctggaggagaccacggcagcccagacagctaccgcagccccctggccagccgctatgccagccctgagatgtgctttgtgttcagtgaccgctacaagttccgcacctggaggcagctgtggctgtggctggccgaggccgagcagaccctgggcctgcccatcacagatgagcagatccaggagatgaagagcaacctggagaacatcgacttcaagatggctgctgaggaggagaagaggctgcggcatgatgtgatggcccacgtgcacaccttcggccactgctgccccaaggctgctggcatcatccacctgggcgccaccagctgctacgtgggggacaacacagacctgatcatcctgagaaatgccctggacctgctgctgcccaagctggcccgggtcatcagccggctggccgactttgccaaggagcgggccagcctgcccaccctgggcttcacccacttccagcctgcccagctgaccaccgtgggcaagcgctgctgcctgtggatccaggacctgtgcatggacctgcagaacctgaagagggtgagagatgacctgcgcttccggggcgtgaagggcaccaccggcacccaggccagcttcctgcagctgtttgaaggagatgaccacaaggtggagcagctggacaagatggtgacagagaaggccggcttcaagagggccttcatcatcaccggccagacctacaccaggaaggtggacatcgaggtgctgtctgtgctggccagcctgggcgcctctgtgcacaagatctgcacagacatccggctgctggccaacctgaaggagatggaggagccctttgagaagcagcagatcggcagcagcgccatgccctacaagaggaaccccatgaggtctgagcgctgctgcagcctggcccggcacctgatgaccctggtgatggaccccctgcagacagcctctgtgcagtggtttgagaggaccctggatgacagcgccaacagacgcatctgcctggccgaggccttcctgacagctgacaccatcctgaacaccctgcagaacatcagcgagggcctggtggtgtaccccaaggtgattgaaagacgcatccggcaggagctgcccttcatggccacagagaacatcatcatggccatggtgaaggccggcggcagccggcaggtgcagcgcttcctggaggaggaggtgtaccccctgctgaagccctatgaatctgtgatgaaggtgaaggccgagctgtgcctgtag

SEQ ID NO: 142927 - DNA, 1497 bp, Artificial Sequence
  Description of Artificial Sequence: Synthetic coding sequence
atggctgctggaggagaccacggcagcccagacagctaccgcagccccctggccagccgctatgccagccctgagatgtgctttgtgttcagtgaccgctacaagttccgcacctggaggcagctgtggctgtggctggccgaggccgagcagaccctgggcctgcccatcacagatgagcagatccaggagatgaagagcaacctggagaacatcgacttcaagatggctgctgaggaggagaagaggctgcggcatgatgtgatggcccacgtgcacaccttcggccactgctgccccaaggctgctggcatcatccacctgggcgccaccagctgctacgtgggggacaacaccagcctcatcctgagccggggcgtcatcaaggcctactgcaacctgcggctgcccggcagtgacagcagccctgtgtctgtgtcccagctggcccgggtcatcagccggctggccgactttgccaaggagcgggccagcctgcccaccctgggcttcacccacttccagcctgcccagctgaccaccgtgggcaagcgctgctgcctgtggatccaggacctgtgcatggacctgcagaacctgaagagggtgagagatgacctgcgcttccggggcgtgaagggcaccaccggcacccaggccagcttcctgcagctgtttgaaggagatgaccacaaggtggagcagctggacaagatggtgacagagaaggccggcttcaagagggccttcatcatcaccggccagacctacaccaggaaggtggacatcgaggtgctgtctgtgctggccagcctgggcgcctctgtgcacaagatctgcacagacatccggctgctggccaacctgaaggagatggaggagccctttgagaagcagcagatcggcagcagcgccatgccctacaagaggaaccccatgaggtctgagcgctgctgcagcctggcccggcacctgatgaccctggtgatggaccccctgcagacagcctctgtgcagtggtttgagaggaccctggatgacagcgccaacagacgcatctgcctggccgaggccttcctgacagctgacaccatcctgaacaccctgcagaacatcagcgagggcctggtggtgtaccccaaggtgattgaaagacgcatccggcaggagctgcccttcatggccacagagaacatcatcatggccatggtgaaggccggcggcagccggcaggactgccacgagaagatccgggtgctgagccagcaggccgcctctgtggtgaagcaggagggcggggacaatgacctgattgaaagaatccaggtggatgcctacttcagccccatccacagccagctggaccacctgctggaccccagcagcttcaccggccgggccagccagcaggtgcagcgcttcctggaggaggaggtgtaccccctgctgaagccctatgagagcgtgatgaaggtgaaggccgagctgtgcctgtag

SEQ ID NO: 142928 - DNA, 915 bp, Artificial Sequence
  Description of Artificial Sequence: Synthetic coding sequence
atggacctgcagaacctgaagagggtgagagatgacctgcgcttccggggcgtgaagggcaccaccggcacccaggccagcttcctgcagctgtttgaaggagatgaccacaaggtggagcagctggacaagatggtgacagagaaggccggcttcaagagggccttcatcatcaccggccagacctacaccaggaaggtggacatcgaggtgctgtctgtgctggccagcctgggcgcctctgtgcacaagatctgcacagacatccggctgctggccaacctgaaggagatggaggagccctttgagaagcagcagatcggcagcagcgccatgccctacaagaggaaccccatgaggtctgagcgctgctgcagcctggcccggcacctgatgaccctggtgatggaccccctgcagacagcctctgtgcagtggtttgagaggaccctggatgacagcgccaacagacgcatctgcctggccgaggccttcctgacagctgacaccatcctgaacaccctgcagaacatcagcgagggcctggtggtgtaccccaaggtgattgaaagacgcatccggcaggagctgcccttcatggccacagagaacatcatcatggccatggtgaaggccggcggcagccggcaggactgccacgagaagatccgggtgctgagccagcaggccgcctctgtggtgaagcaggagggcggggacaatgacctgattgaaagaatccaggtggatgcctacttcagccccatccacagccagctggaccacctgctggaccccagcagcttcaccggccgggccagccagcaggtgcagcgcttcctggaggaggaggtgtaccccctgctgaagccctatgagagcgtgatgaaggtgaaggccgagctgtgcctgtag

SEQ ID NO: 142929 - DNA, 384 bp, Artificial Sequence
  Description of Artificial Sequence: Synthetic coding sequence
atggctgctggaggagaccacggcagcccagacagctaccgcagccccctggccagccgctatgccagccctgagatgtgctttgtgttcagtgaccgctacaagttccgcacctggaggcagctgtggctgtggctggccgaggccgagcagaccctgggcctgcccatcacagatgagcagatccaggagatgaagagcaacctggagaacatcgacttcaagatggctgctgaggaggagaagaggctgcggcatgatgtgatggcccacgtgcacaccttcggccactgctgccccaaggctgctggcatcatccacctgggcgccaccagctgctacgtgggggacaacacagtgggcgcctgtgtggtgtacacctag

SEQ ID NO: 142930 - DNA, 1371 bp, Artificial Sequence
  Description of Artificial Sequence: Synthetic coding sequence
atggcctttgctgagacctacccagctgccagcagcctgcccaatggagactgtggccggccccgggcccggcctgggggcaacagagtgacagtggtgctgggcgcccagtggggagatgagggcaagggcaaggtggtggacctgctggcccaggatgctgacatcgtgtgccgctgccagggcggcaacaatgccggccacacagtggtggtggacagcgtggagtatgacttccacctgctgcccagcggcatcatcaaccccaacgtgacagccttcatcggaaatggagtggtgatccacctgcccggcctgtttgaggaggccgagaagaatgtgcagaagggcaagggcctggagggctgggagaagaggctcatcatcagtgaccgggcccacatcgtgtttgacttccaccaggccgcagatggcatccaggagcagcagaggcaggagcaggccggcaagaacctgggcaccaccaagaagggcatcggccctgtgtacagcagcaaggccgcccggagcggcctgaggatgtgtgacctggtgtctgactttgatggcttcagcgagcgcttcaaggtgctggccaaccagtacaagagcatctaccccaccctggagattgatattgaaggagagctgcagaagctgaagggctacatggagaagatcaagcccatggtgagagatggagtgtacttcctgtatgaggccctgcacggcccccccaagaagatcctggtggagggcgccaatgctgccctgctggacatcgactttggcacctacccctttgtgaccagcagcaactgcaccgtgggcggcgtgtgcaccggcctgggcatgccaccccagaatgtgggggaggtgtatggagtggtgaaggcctacaccaccagggtgggcatcggggccttccccacagagcaggacaatgaaattggagagctgctgcagacccggggccgggagtttggagtgaccaccggcaggaagaggcgctgtggctggctggacctggtgctgctgaagtatgcccacatgatcaatggcttcaccgccctggccctgaccaagctggacatcctggacatgttcacagagatcaaggtgggcgtggcctacaagctggatggagagatcatcccccacatcccagccaaccaggaggtgctgaacaaggtggaggtgcagtacaagaccctgcccggctggaacacagacatcagcaatgcccgggccttcaaggagctgcctgtgaatgcccagaactacgtgcgcttcattgaagatgagctgcagatccctgtgaagtggattggagtgggcaagagccgggagagcatgatccagctgttctag

SEQ ID NO: 142931 - DNA, 1308 bp, Artificial Sequence
  Description of Artificial Sequence: Synthetic coding sequence
atggcctttgctgagacctacccagctgccagcagcctgcccaatggagactgtgatgagggcaagggcaaggtggtggacctgctggcccaggatgctgacatcgtgtgccgctgccagggcggcaacaatgccggccacacagtggtggtggacagcgtggagtatgacttccacctgctgcccagcggcatcatcaaccccaacgtgacagccttcatcggaaatggagtggtgatccacctgcccggcctgtttgaggaggccgagaagaatgtgcagaagggcaagggcctggagggctgggagaagaggctcatcatcagtgaccgggcccacatcgtgtttgacttccaccaggccgcagatggcatccaggagcagcagaggcaggagcaggccggcaagaacctgggcaccaccaagaagggcatcggccctgtgtacagcagcaaggccgcccggagcggcctgaggatgtgtgacctggtgtctgactttgatggcttcagcgagcgcttcaaggtgctggccaaccagtacaagagcatctaccccaccctggagattgacatcgagggggagctgcagaagctgaagggctacatggagaagatcaagcccatggtgagagatggagtgtacttcctgtatgaggccctgcacggcccccccaagaagatcctggtggagggcgccaatgctgccctgctggacatcgactttggcacctacccctttgtgaccagcagcaactgcaccgtgggcggcgtgtgcaccggcctgggcatgccaccccagaatgtgggggaggtgtatggagtggtgaaggcctacaccaccagggtgggcattggagccttccccacagagcaggacaatgagatcggggagctgctgcagacccggggccgggagtttggagtgaccactggaaggaagagaagatgtggctggctggacctggtgctgctgaagtatgcccacatgatcaatggcttcaccgccctggccctgaccaagctggacatcctggacatgttcacagagatcaaggtgggcgtggcctacaagctggatggagagatcatcccccacatcccagccaaccaggaggtgctgaacaaggtggaggtgcagtacaagaccctgcccggctggaacacagacatcagcaatgcccgggccttcaaggagctgcctgtgaatgcccagaactacgtgcgcttcattgaagatgagctgcagatccctgtgaagtggattggagtgggcaagagccgggagagcatgatccagctgttctag

SEQ ID NO: 142932 - DNA, 1236 bp, Artificial Sequence
  Description of Artificial Sequence: Synthetic coding sequence
atgtggatccagcagctgctgggcctgagctccatgagcatccgctggccaggccggcccctgggcagccacgcctggatcctgattgccatgttccagctggccgtggacctgcctgcctgtgaggccctgggccctggccctgagttctggctgctgcccaggagccccccccggcccccccggctgtggagcttccgcagcggccagcctgcccgggtgcctgcccctgtgtggagccccaggcctccccgggtggagcgcatccacggccagatgcagatgccccgggcccggcgggcccaccggccccgggaccaggccgccgccctggtgcccaaggccggcctggccaagcccccagctgctgccaagagcagccccagcctggccagcagcagcagcagcagcagcagcgctgtggccggcggggcccctgagcagcaggccctgctgcggcggggcaagaggcacctgcagggagatggcctgagcagctttgacagccggggcagccggcccaccacagaaacagagttcatcgcctggggccccactggagatgaggaggccctggagagcaacaccttccctggggtgtatggccccaccaccgtgtccatcctgcagaccaggaagaccaccgtggccgccaccaccaccaccaccaccacagccacccccatgaccctgcagaccaagggcttcacagagagcctggacccccggcggcgcatccctggaggagtgtccaccacagagcccagcaccagccccagcaacaacggggaggtgacccagcccccacgcatcctgggggaggccagcggcctggccgtgcaccagatcatcaccatcaccgtgtccctcatcatggtgattgctgccctgatcaccaccctggtgctgaagaactgctgtgcccagagcggcaacaccaggaggaacagccaccagaggaagaccaaccagcaggaggagagctgccagaacctgacagacttccccagcgcccgggtgcccagcagcctggacatcttcaccgcctacaatgagaccctgcagtgcagccatgaatgtgtgcgggcctctgtgcctgtgtacacagatgagaccctgcacagcaccactggagagtacaagagcaccttcaatggaaaccggcccagcagcagtgacagacacctgatccctgtggcctttgtgtctgagaagtggtttgagatcagctgctag

SEQ ID NO: 142933 - DNA, 1236 bp, Artificial Sequence; identical to SEQ ID NO: 142932
  Description of Artificial Sequence: Synthetic coding sequence

SEQ ID NO: 142934 - DNA, 1155 bp, Artificial Sequence
  Description of Artificial Sequence: Synthetic coding sequence
atggtgtctggggactacagcctgggcctgaatgacctgaatgtgtccccacctgagctgactgtgcacgtgggggacagcgccctgatgggctgtgtgttccagagcacagaggacaagtgcatcttcaagattgactggaccctgagccctggagagcacgccaaggatgaatatgtgctgtactactacagcaacctgtctgtgcccatcggccgcttccagaacagagtgcacctgatgggagacatcctgtgcaatgatggcagcctgctgctgcaggatgtgcaggaggccgaccagggcacctacatctgtgagatccggctgaagggggagagccaggtgttcaagaaggctgtggtgctgcacgtgctgcctgaggagcccaaggagctgatggtgcacgtgggcggcctcatccagatgggctgtgtgttccagagcacagaggtgaagcacgtgaccaaggtggagtggatcttctctggaagaagagccaaggaggagatcgtgttccgctactaccacaagctgaggatgtctgtggagtacagccagagctggggccacttccagaacagagtgaacctggtgggggacatcttcagaaatgatggcagcatcatgctgcagggcgtgcgggagagtgatggcggcaactacacctgcagcatccacctgggcaacctggtgttcaagaagaccatcgtgctgcacgtgtccccagaggagcccaggaccctggtgaccccagctgccctgcggcccctggtgctgggcggcaaccagctggtgatcatcgtgggcatcgtgtgtgccaccatcctgctgctgcctgtgctgatcctgattgtgaagaagacctgtggcaacaagagctctgtgaacagcacagtgctggtgaagaacaccaagaagaccaaccctgagatcaaggagaagccctgccactttgagcgctgtgagggggagaagcacatctacagccccatcatcgtgcgggaggtgattgaggaggaggagcccagcgagaagtctgaggccacctacatgaccatgcaccctgtgtggcccagcctgcggagtgacaggaacaacagcctggagaagaagagcggcggcggcatgcccaagacccagcaggccttctag

SEQ ID NO: 142935 - DNA, 1185 bp, Artificial Sequence
  Description of Artificial Sequence: Synthetic coding sequence
atgttctgccccctgaagctgatcctgctgcctgtgctgctggactacagcctgggcctgaatgacctgaatgtgtccccacctgagctgactgtgcacgtgggggacagcgccctgatgggctgtgtgttccagagcacagaggacaagtgcatcttcaagattgactggaccctgagccctggagagcacgccaaggatgaatatgtgctgtactactacagcaacctgtctgtgcccatcggccgcttccagaacagagtgcacctgatgggagacatcctgtgcaatgatggcagcctgctgctgcaggatgtgcaggaggccgaccagggcacctacatctgtgagatccggctgaagggggagagccaggtgttcaagaaggctgtggtgctgcacgtgctgcctgaggagcccaaggagctgatggtgcacgtgggcggcctcatccagatgggctgtgtgttccagagcacagaggtgaagcacgtgaccaaggtggagtggatcttctctggaagaagagccaaggaggagatcgtgttccgctactaccacaagctgaggatgtctgtggagtacagccagagctggggccacttccagaacagagtgaacctggtgggggacatcttcagaaatgatggcagcatcatgctgcagggcgtgcgggagagtgatggcggcaactacacctgcagcatccacctgggcaacctggtgttcaagaagaccatcgtgctgcacgtgtccccagaggagcccaggaccctggtgaccccagctgccctgcggcccctggtgctgggcggcaaccagctggtgatcatcgtgggcatcgtgtgtgccaccatcctgctgctgcctgtgctgatcctgattgtgaagaagacctgtggcaacaagagctctgtgaacagcacagtgctggtgaagaacaccaagaagaccaaccctgagatcaaggagaagccctgccactttgagcgctgtgagggggagaagcacatctacagccccatcatcgtgcgggaggtgattgaggaggaggagcccagcgagaagtctgaggccacctacatgaccatgcaccctgtgtggcccagcctgcggagtgacaggaacaacagcctggagaagaagagcggcggcggcatgcccaagacccagcaggccttctag

SEQ ID NO: 142936 - DNA, 468 bp, Artificial Sequence
  Description of Artificial Sequence: Synthetic coding sequence
atgttctgccccctgaagctgatcctgctgcctgtgctgctggactacagcctgggcctgaatgacctgaatgtgtccccacctgagctgactgtgcacgtgggggacagcgccctgatgggctgtgtgttccagagcacagaggacaagtgcatcttcaagattgactggaccctgagccctggagagcacgccaaggatgaatatgtgctgtactactacagcaacctgtctgtgcccatcggccgcttccagaacagagtgcacctgatgggagacatcctgtgcaatgatggcagcctgctgctgcaggatgtgcaggaggccgaccagggcacctacatctgtgagatccggctgaagggggagagccaggtgttcaagaaggctgtggtgctgcacgtgctgcctgaggagcccaaggagctgatggtgcacgtgggcggcctcatccagatgggctgctag

SEQ ID NO: 142937 - DNA, 663 bp, Artificial Sequence
  Description of Artificial Sequence: Synthetic coding sequence
atgggctgtgtgttccagagcacagaggacaagtgcatcttcaagattgactggaccctgagccctggagaacatgccaaggatgaatatgtgctgtactactacagcaacctgtctgtgcccatcggccgcttccagaacagagtgcacctgatgggagacatcctgtgcaatgatggcagcctgctgctgcaggatgtgcaggaggccgaccagggcacctacatctgtgagatccggctgaagggggagagccaggtgttcaagaaggctgtggtgctgcacgtgctgcctgaggagcccaaggagctgatggtgcacgtgggcggcctcatccagatgggctgtgtgttccagagcacagaggtgaagcacgtgaccaaggtggagtggatcttcagcggccggcgggccaaggaggagatcgtgttccgctactaccacaagctgaggatgtctgtggagtacagccagagctggggccacttccagaacagagtgaacctggtgggggacatcttcagaaatgatggcagcatcatgctgcagggcgtgcgggagagtgatggcggcaactacacctgcagcatccacctgggcaacctggtgttcaagaagaccatcgtgctgcacgtgtccccagaggagcccaggaagtggtag

SEQ ID NO: 142938 - DNA, 1128 bp, Artificial Sequence
  Description of Artificial Sequence: Synthetic coding sequence
atgagcagccacaagggctctgtggtggcccagggcaatggagccccagccagcaaccgggaggccgacacagtggagctggccgagctgggccccctgctggaggagaagggcaagagggtcatcgccaacccccccaaggccgaggaggagcagacctgccctgtgccccaggaggaggaggaggaggtgcgggtgctgaccctgcccctgcaggcccaccacgccatggagaagatggaggagtttgtgtacaaggtgtgggagggccgctggagggtcatcccctatgatgtgctgcctgactggctgaaggacaatgactacctgctgcacggccaccggccccccatgcccagcttccgggcctgcttcaagagcatcttccgcatccacacagaaacaggcaacatctggacccacctgctgggctttgtgctcttcctgttcctgggcatcctgaccatgctgcggcccaacatgtacttcatggcccccctgcaggagaaggtggtgtttggcatgttcttcctgggcgctgtgctgtgcctgtccttctcctggctgttccacacagtgtactgccacagcgagaaggtgtccaggaccttcagcaagctggactacagcggcatcgccctgctgatcatgggcagctttgtgccctggctgtactacagcttctactgcagcccccagcccaggctcatctacctgagcatcgtgtgtgtgctgggcatcagcgccatcatcgtggcccagtgggacagatttgccacccccaagcaccggcagacccgggccggggtcttcctgggcctgggcctgtctggagtggtgcccaccatgcacttcaccatcgccgagggctttgtgaaggccaccaccgtgggccagatgggctggttcttcctgatggctgtgatgtacatcaccggggccggcctgtatgctgcccgcatccctgagcgcttcttccctgggaagtttgacatctggttccagagccaccagatcttccacgtgctggtggtggccgccgcctttgtgcacttctatggagtgagcaacctgcaggagttccgctatggcctggagggcggctgcacagatgacaccctgctgtag

SEQ ID NO: 142939 - DNA, 516 bp, Artificial Sequence
  Description of Artificial Sequence: Synthetic coding sequence
atgagcagccacaagggctctgtggtggcccagggcaatggagccccagccagcaaccgggaggccgacacagtggagctggccgagctgggccccctgctggaggagaagggcaagagggtcatcgccaacccccccaaggccgaggaggagcagacctgccctgtgccccaggaggaggaggaggaggtgcgggtgctgaccctgcccctgcaggcccaccacgccatggagaagatggaggagtttgtgtacaaggtgtgggagggccgctggagggtcatcccctatgatgtgctgcctgactggctgaaggacaatgactacctgctgcacggccaccggccccccatgcccagcttccgggcctgcttcaagagcatcttccgcatccacacagaaacaggcaacatctggacccacctgctggccacagcccacctgcccctgcaccggctgtgccccggccacttctgccaccactgtggggctgtgggccctgtgtgccacagctag

SEQ ID NO: 142940 - DNA, 801 bp, Artificial Sequence
  Description of Artificial Sequence: Synthetic coding sequence
atgagcagccacaagggctctgtggtggcccagggcaatggagccccagccagcaaccgggaggccgacacagtggagctggccgagctgggccccctgctggaggagaagggcaagagggtcatcgccaacccccccaaggccgaggaggagcagacctgccctgtgccccaggaggaggaggaggaggtgcgggtgctgaccctgcccctgcaggcccaccacgccatggagaagatggaggagtttgtgtacaaggtgtgggagggccgctggagggtcatcccctatgatgtgctgcctgactggctgaaggacaatgactacctgctgcacggccaccggccccccatgcccagcttccgggcctgcttcaagagcatcttccgcatccacacagaaacaggcaacatctggacccacctgctgggctttgtgctcttcctgttcctgggcatcctgaccatgctgcggcccaacatgtacttcatggcccccctgcaggagaaggtggtgtttggcatgttcttcctgggcgctgtgctgtgcctgtccttctcctggctgttccacacagtgtactgccacagcgagaaggtgtccaggaccttcagcaagctggactacagcggcatcgccctgctgatcatgggcagctttgtgccctggctgtactacagcttctactgcagcccccagcccaggctcatctacctgagcatcgtgtgtgtgctgggcatcagcgccatcatcgtggcccagtgggacagatttgccacccccaagcaccggcagacctag

SEQ ID NO: 142941 - DNA, 618 bp, Artificial Sequence
  Description of Artificial Sequence: Synthetic coding sequence
atgagcagccacaagggctctgtggtggcccagggcaatggagccccagccagcaaccgggaggccgacacagtggagctggccgagctgggccccctgctggaggagaagggcaagagggtcatcgccaacccccccaaggccgaggaggagcagacctgccctgtgccccaggaggaggaggaggaggtgcgggtgctgaccctgcccctgcaggcccaccacgccatggagaagatggaggagtttgtgtacaaggtgtgggagggccgctggagggtcatcccctatgatgtgctgcctgactggctgaaggacaatgactacctgctgcacggccaccggccccccatgcccagcttccgggcctgcttcaagagcatcttccgcatccacacagaaacaggcaacatctggacccacctgctgggctttgtgctcttcctgttcctgggcatcctgaccatgctgcggcccaacatgtacttcatggcccccctgcaggagaaggtggtgtttggcatgttcttcctgggcgctgtgctgtgcctgtccttctcctggctgttccacacagtgtactgccacagcgagaaggtgtccaggaccttctcctag

SEQ ID NO: 142942 - DNA, 1128 bp, Artificial Sequence; identical to SEQ ID NO: 142938
  Description of Artificial Sequence: Synthetic coding sequence

SEQ ID NO: 142943 - DNA, 1161 bp, Artificial Sequence
  Description of Artificial Sequence: Synthetic coding sequence
atgaatgagcccacagagaaccggctgggctgcagcaggaccccagagccagacatccggctgaggaagggccaccagctggatggcaccaggagaggagacaatgacagccaccagggcgacctggagcccatcctggaggcctctgtgctgagcagccaccacaagaagagcagcgaggagcacgagtacagtgatgaggccccccaggaggatgagggcttcatgggcatgagccccctgctgcaggcccaccacgccatggagaagatggaggagtttgtgtgcaaggtgtgggagggccgctggagggtcatcccccatgatgtgctgcctgactggctgaaggacaatgacttcctgctgcacggccacaggcctcccatgcccagcttccgggcctgcttcaagagcatcttccgcatccacacagagaccggcaacatctggacccacctgctgggctgtgtgttcttcctgtgcctgggcatcttctacatgttccggcccaacatcagctttgtggcccccctgcaggagaaggtggtgtttggcctcttcttcctgggcgccatcctgtgcctgtccttctcctggctgttccacacagtgtactgccacagcgagggcgtgtcccggctcttcagcaagctggactacagcggcatcgccctgctgatcatgggcagctttgtgccctggctgtactacagcttctactgcaacccccagccctgcttcatctacctgattgtcatctgtgtgctgggcattgctgccatcatcgtgtcccagtgggacatgtttgccaccccccagtaccggggcgtgcgggccggggtcttcctgggcctgggcctgagcggcatcatccccaccctgcactacgtgatcagcgagggcttcctgaaggccgccaccatcggccagatcggctggctgatgctgatggccagcctgtacatcactggagctgccctgtatgctgcccgcatccctgagcgcttcttccctggaaaatgtgacatctggttccacagccaccagctgttccacatctttgtggtggccggggcctttgtgcacttccacggcgtgagcaacctgcaggagttccgcttcatgattggaggcggctgcagtgaagaagatgccctgtag

SEQ ID NO: 142944 - DNA, 735 bp, Artificial Sequence
  Description of Artificial Sequence: Synthetic coding sequence
atgctgctgctgggcgctgtgctgctgctgctggccctgcccggccatgaccaggagaccaccacccagggccctggggtgctgctgcccctgcccaagggggcctgcaccggctggatggccggcatccctggccaccctggccacaacggggcccctggaagagatggaagagatggcaccccaggagagaagggggagaagggggaccccggcctcatcggccccaagggggacatcggggagactggagtgcctggagctgagggcccccggggcttccctggcatccagggcaggaaaggagagcccggggagggcgcctacgtgtacagaagtgccttctctgtgggcctggagacctacgtgaccatccccaacatgcccatccgcttcaccaagatcttctacaaccagcagaaccactatgatggcagcacaggcaagttccactgcaacatccctggcctgtactactttgcctaccacatcaccgtgtacatgaaggatgtgaaggtgtccctcttcaagaaggacaaggccatgctgttcacctatgaccagtaccaggagaacaacgtggaccaggccagcggctctgtgctgctgcacctggaggtgggggaccaggtgtggctgcaggtgtatggagagggggagagaaatggcctgtatgctgacaatgacaatgacagcaccttcaccggcttcctgctgtaccatgacaccaactag

SEQ ID NO: 142945 - DNA, 735 bp, Artificial Sequence; identical to SEQ ID NO: 142944
  Description of Artificial Sequence: Synthetic coding sequence

SEQ ID NO: 142946 - DNA, 735 bp, Artificial Sequence; identical to SEQ ID NO: 142944
  Description of Artificial Sequence: Synthetic coding sequence

SEQ ID NO: 142947 - DNA, 1491 bp, Artificial Sequence
  Description of Artificial Sequence: Synthetic coding sequence
atggccctgtggaggggcagcgcctatgccggcttcctggccctggccgtgggctgtgtgttcctgctggagcctgagctgcccggcagcgccctgcggagcctgtggagcagcctgtgcctgggccctgccccagcccctcctggccctgtgtccccagagggccgcctggccgccgcctgggatgccctgattgtgcggcctgtgcggcgctggaggagagtggccgtgggcgtgaatgcctgtgtggatgtggtgctgagcggcgtgaagctgctgcaggccctgggcctgagccctggaaatggcaaggaccacagcatcctgcacagcagaaatgacctggaggaggccttcatccacttcatgggcaaaggagctgctgctgagcgcttcttcagtgacaaggagaccttccatgacatcgcccaggtggccagcgagttccctggggcccagcactacgtgggcggcaatgctgccctgattggccagaagtttgctgccaacagcgacctgaaggtgctgctgtgtggccctgtgggccccaagctgcacgagctgctggatgacaacgtgtttgtgcccccagagagcctgcaggaggtggatgagttccacctgatcctggagtaccaggccggggaggagtggggccagctgaaggcccctcatgccaaccgcttcatcttcagccatgacctgagcaatggagccatgaacatgctggaggtgtttgtgagcagcctggaggagttccagcctgacctggtggtgctgagcggcctgcacatgatggagggccagagcaaggagctgcagaggaagaggctgctggaggtggtgaccagcatcagtgacatccccaccggcatccctgtgcacctggagctggcctccatgaccaaccgggagctgatgagcagcatcgtgcaccaggtgtttcctgctgtgaccagcctgggcctgaatgagcaggagctgctcttcctgacccagagcgccagcggcccccacagcagcctgagctcctggaatggagtgcctgatgtgggcatggtgtctgacatcctcttctggatcctgaaggagcacggccgcagcaagagccgggccagtgacctgacccgcatccacttccacaccctggtgtaccacatcctggccaccgtggatggccactgggccaaccagctggccgctgtggccgccggggcccgggtggccggcacccaggcctgtgccacagagaccatcgacaccagccgggtgtccctgcgggccccccaggagttcatgaccagccacagcgaggccggcagcagaattgtgctgaaccccaacaagcctgtggtggagtggcaccgggagggcatctccttccacttcacccctgtgctggtgtgcaaggaccccatcagaacagtgggcctgggagatgccatctctgctgagggcctcttctacagcgaggtgcacccccactactag

SEQ ID NO: 142948 - DNA, 1041 bp, Artificial Sequence
  Description of Artificial Sequence: Synthetic coding sequence
atgggcaaaggagctgctgctgagcgcttcttcagtgacaaggagaccttccatgacatcgcccaggtggccagcgagttccctggggcccagcactacgtgggcggcaatgctgccctgattggccagaagtttgctgccaacagcgacctgaaggtgctgctgtgtggccctgtgggccccaagctgcacgagctgctggatgacaacgtgtttgtgcccccagagagcctgcaggaggtggatgagttccacctgatcctggagtaccaggccggggaggagtggggccagctgaaggcccctcatgccaaccgcttcatcttcagccatgacctgagcaatggagccatgaacatgctggaggtgtttgtgagcagcctggaggagttccagcctgacctggtggtgctgagcggcctgcacatgatggagggccagagcaaggagctgcagaggaagaggctgctggaggtggtgaccagcatcagtgacatccccaccggcatccctgtgcacctggagctggcctccatgaccaaccgggagctgatgagcagcatcgtgcaccagcaggtgtttcctgctgtgaccagcctgggcctgaatgagcaggagctgctcttcctgacccagagcgccagcggcccccacagcagcctgagctcctggaatggagtgcctgatgtgggcatggtgtctgacatcctcttctggatcctgaaggagcacggccgcagcaagagccgggccagtgacctgacccgcatccacttccacaccctggtgtaccacatcctggccaccgtggatggccactgggccaaccagctggccgctgtggccagcagctgtggctgggacaccggcctgcggcacaggaaccaccgccaccagcccagcgtgtctgagggcaccccccgggtgcatgacttcccctttggaggccgcctgcaggactgcatcaagcccaagcaggccagcagcaggatggcccagaggggcaacatcctgcccctgcacaccagcattggagtgtag

SEQ ID NO: 142949 - DNA, 1251 bp, Artificial Sequence
  Description of Artificial Sequence: Synthetic coding sequence
atggccctgtggaggggcagcgcctatgccggcttcctggccctgggcctgagccctggaaatggcaaggaccacagcatcctgcacagcagaaatgacctggaggaggccttcatccacttcatgggcaaaggagctgctgctgagcgcttcttcagtgacaaggagaccttccatgacatcgcccaggtggccagcgagttccctggggcccagcactacgtgggcggcaatgctgccctgattggccagaagtttgctgccaacagcgacctgaaggtgctgctgtgtggccctgtgggccccaagctgcacgagctgctggatgacaacgtgtttgtgcccccagagagcctgcaggaggtggatgagttccacctgatcctggagtaccaggccggggaggagtggggccagctgaaggccccccacgccaaccgcttcatcttcagccatgacctgagcaatggagccatgaacatgctggaggtgtttgtgagcagcctggaggagttccagcctgacctggtggtgctgagcggcctgcacatgatggagggccagagcaaggagctgcagaggaagaggctgctggaggtggtgaccagcatcagtgacatccccaccggcatccctgtgcacctggagctggcctccatgaccaaccgggagctgatgagcagcatcgtgcaccagcaggtgtttcctgctgtgaccagcctgggcctgaatgagcaggagctgctcttcctgacccagagcgccagcggcccccacagcagcctgagctcctggaatggagtgcctgatgtgggcatggtgtctgacatcctcttctggatcctgaaggagcacggccgcagcaagagccgggccagtgacctgacccgcatccacttccacaccctggtgtaccacatcctggccaccgtggatggccactgggccaaccagctggccgctgtggccgccggggcccgggtggccggcacccaggcctgtgccacagagaccatcgacaccagccgggtgtccctgcgggccccccaggagttcatgaccagccacagcgaggccggcagcagaattgtgctgaaccccaacaagcctgtggtggagtggcaccgggagggcatctccttccacttcacccctgtgctggtgtgcaaggaccccatcagaacagtgggcctgggagatgccatctctgctgagggcctcttctacagcgaggtgcacccccactactag

SEQ ID NO: 142950 - DNA, 669 bp, Artificial Sequence
  Description of Artificial Sequence: Synthetic coding sequence
atggccgccagctgccgggtggtgaccagcatcagtgacatccccaccggcatccctgtgcacctggagctggcctccatgaccaaccgggagctgatgagcagcatcgtgcaccaggtgtttcctgctgtgaccagcctgggcctgaatgagcaggagctgctcttcctgacccagagcgccagcggcccccacagcagcctgagctcctggaatggagtgcctgatgtgggcatggtgtctgacatcctcttctggatcctgaaggagcacggccgcagcaagagccgggccagtgacctgacccgcatccacttccacaccctggtgtaccacatcctggccaccgtggatggccactgggccaaccagctggccgctgtggccgccggggcccgggtggccggcacccaggcctgtgccacagagaccatcgacaccagccgggtgtccctgcgggccccccaggagttcatgaccagccacagcgaggccggcagcagaattgtgctgaaccccaacaagcctgtggtggagtggcaccgggagggcatctccttccacttcacccctgtgctggtgtgcaaggaccccatcagaacagtgggcctgggagatgccatctctgctgagggcctcttctacagcgaggtgcacccccactactag

SEQ ID NO: 142951 - DNA, 546 bp, Artificial Sequence
  Description of Artificial Sequence: Synthetic coding sequence
atgggcaacatctttgccaacctcttcaagggcctgtttgggaagaaggagatgaggatcctgatggtgggcctggatgctgctgggaagaccaccatcctgtacaagctgaagctgggggagatcgtgaccaccatccccaccatcggcttcaacgtggagaccgtggagtacaagaacatctccttcaccgtgtgggatgtgggcggccaggacaagatccggcccctgtggaggcactacttccagaacacccagggcctcatctttgtggtggacagcaatgaccgggagcgggtgaatgaggcccgggaggagctgatgaggatgctggctgaagatgagctgagagatgctgtgctgctggtgtttgccaacaagcaggacctgcccaatgccatgaatgctgctgagatcacagacaagctgggcctgcacagcctgcggcacaggaactggtacatccaggccacctgtgccaccagcggagatggcctgtatgagggcctggactggctgagcaaccagctgaggaaccagaagtag

SEQ ID NO: 142952 - DNA, 546 bp, Artificial Sequence; identical to SEQ ID NO: 142951
  Description of Artificial Sequence: Synthetic coding sequence

SEQ ID NO: 142953 - DNA, 546 bp, Artificial Sequence; identical to SEQ ID NO: 142951
  Description of Artificial Sequence: Synthetic coding sequence

SEQ ID NO: 142954 - DNA, 519 bp, Artificial Sequence
  Description of Artificial Sequence: Synthetic coding sequence
atgggcaacatctttgccaacctcttcaagggcctgtttgggaagaaggagatgaggatcctgatggtgggcctggatgctgctgggaagaccaccatcctgtacaagctgaagctgggggagatcgtgaccaccatccccaccatcggcttcaacgtggagaccgtggagtacaagaacatctccttcaccgtgtgggatgtgggcggccaggacaagatccggcccctgtggaggcactacttccagaacacccagggcctcatctttgtggtggacagcaatgaccgggagcgggtgaatgaggcccaggatgagctgagagatgctgtgctgctggtgtttgccaacaagcaggacctgcccaatgccatgaatgctgctgagatcacagacaagctgggcctgcacagcctgcggcacaggaactggtacatccaggccacctgtgccaccagcggagatggcctgtatgagggcctggactggctgagcaaccagctgaggaaccagaagtag

SEQ ID NO: 142955 - DNA, 546 bp, Artificial Sequence
  Description of Artificial Sequence: Synthetic coding sequence
atgggcaacatctttggaaacctgctgaagagcctgattggcaagaaggagatgaggatcctgatggtgggcctggatgctgctgggaagaccaccatcctgtacaagctgaagctgggggagatcgtgaccaccatccccaccatcggcttcaacgtggagaccgtggagtacaagaacatctccttcaccgtgtgggatgtgggcggccaggacaagatccggcccctgtggaggcactacttccagaacacccagggcctcatctttgtggtggacagcaatgaccgggagcgggtgaatgaggcccgggaggagctgatgaggatgctggctgaagatgagctgagagatgctgtgctgctggtgtttgccaacaagcaggacctgcccaatgccatgaatgctgctgagatcacagacaagctgggcctgcacagcctgcggcacaggaactggtacatccaggccacctgtgccaccagcggagatggcctgtatgagggcctggactggctggccaaccagctgaagaacaagaagtag

SEQ ID NO: 142956 - DNA, 435 bp, Artificial Sequence
  Description of Artificial Sequence: Synthetic coding sequence
atgggcaacatctttggaaacctgctgaagagcctgattggcaagaaggagatgaggatcctgatggtgggcctggatgctgctgggaagaccaccatcctgtacaagctgaagctgggggagatcgtgaccaccatccccaccatcggcctcatctttgtggtggacagcaatgaccgggagcgggtgaatgaggcccgggaggagctgatgaggatgctggccgaggatgagctgagagatgctgtgctgctggtgtttgccaacaagcaggacctgcccaatgccatgaatgctgctgagatcacagacaagctgggcctgcacagcctgcggcacaggaactggtacatccaggccacctgtgccaccagcggagatggcctgtatgagggcctggactggctggccaaccagctgaagaacaagaagtag

SEQ ID NO: 142957 - DNA, 153 bp, Artificial Sequence
  Description of Artificial Sequence: Synthetic coding sequence
atgggcaacatctttggaaacctgctgaagagcctgattggcaagaaggagatgaggatcctgatggtgggcctggatgctgctgggaagaccaccatcctgtacaagctgaagctgggggagatcgtgaccaccatccccaccatcggctag

SEQ ID NO: 142958 - DNA, 309 bp, Artificial Sequence
  Description of Artificial Sequence: Synthetic coding sequence
atgggcaacatctttggaaacctgctgaagagcctgattggcaagaaggagatgaggatcctgatggtgggcctggatgctgctgggaagaccaccatcctgtacaagctgaagctgggggagatcgtgaccaccatccccaccatcggcttcaacgtggagaccgtggagtacaagaacatctccttcaccgtgtgggatgtgggcggccaggacaagatccggcccctgtggaggcactacttccagaacacccagggcctcatctttgtggtggacagcaatgaccgggagcgggtgaatgaatag

SEQ ID NO: 142959 - DNA, 546 bp, Artificial Sequence; identical to SEQ ID NO: 142955
  Description of Artificial Sequence: Synthetic coding sequence

SEQ ID NO: 142960 - DNA, 123 bp, Artificial Sequence
  Description of Artificial Sequence: Synthetic coding sequence
atgggcaacatctttggaaacctgctgaagagcctgattggcaagaaggagatgaggatcctgatggtgggcctggatgctgctgggaagaccaccatcctgtacaagctgaagctgggctag

SEQ ID NO: 142961 - DNA, 543 bp, Artificial Sequence
  Description of Artificial Sequence: Synthetic coding sequence
atgggcctgaccatcagcagcctcttcagccggctgtttgggaagaagcagatgaggatcctgatggtgggcctggatgctgctgggaagaccaccatcctgtacaagctgaagctgggggagatcgtgaccaccatccccaccatcggcttcaacgtggagaccgtggagtacaagaacatctgcttcaccgtgtgggatgtgggcggccaggaccgcatccggcccctgtggaagcactacttccagaacacccagggcctcatctttgtggtggacagcaatgaccgggagcgcatccaggaggtggctgatgagctgcagaagatgctgctggtggatgagctgagagatgctgtgctgctgctgtttgccaacaagcaggacctgcccaatgccatggccatcagcgagatgacagacaagctgggcctgcagagcctgaggaacagaacctggtacgtgcaggccacctgtgccacccagggcaccggcctgtatgagggcctggactggctgagcaatgagctgagcaagaggtag

SEQ ID NO: 142962 - DNA, 384 bp, Artificial Sequence
  Description of Artificial Sequence: Synthetic coding sequence
atgggcctgaccatcagcagcctcttcagccggctgtttgggaagaagcagatgaggatcctgatggtgggcctggatgctgctgggaagaccaccatcctgtacaagctgaagctgggggagatcgtgaccaccatccccaccatcggcttcaacgtggagaccgtggagtacaagaacatctgcttcaccgtgtgggatgtgggcggccaggaccgcatccggcccctgtggaagcactacttccagaacacccagggcctcatctttgtggtggacagcaatgaccgggagcgcatccaggaggtggctgatgagctgcagaagatgctgctggtggatgagctgagagatgctgtgctgctgctgtttgccaacaagtag

SEQ ID NO: 142963 - DNA, 69 bp, Artificial Sequence
  Description of Artificial Sequence: Synthetic coding sequence
atgggcctgaccatcagcagcctcttcagccggctgtttgggaagaagcagatgaggatcctgatgtag

SEQ ID NO: 142964 - DNA, 543 bp, Artificial Sequence
  Description of Artificial Sequence: Synthetic coding sequence
atgggcctgactgtgtctgccctcttcagccgcatctttgggaagaagcagatgaggatcctgatggtgggcctggatgctgctgggaagaccaccatcctgtacaagctgaagctgggggagatcgtgaccaccatccccaccatcggcttcaacgtggagaccgtggagtacaagaacatctgcttcaccgtgtgggatgtgggcggccaggacaagatccggcccctgtggaggcactacttccagaacacccagggcctcatctttgtggtggacagcaatgaccgggagcgggtgcaggagagcgcagatgagctgcagaagatgctgcaggaggatgagctgagagatgctgtgctgctggtgtttgccaacaagcaggacatgcccaatgccatgcctgtgtctgagctgacagacaagctgggcctgcagcacctgcggagcaggacctggtacgtgcaggccacctgtgccacccagggcaccggcctgtatgatggcctggactggctgagccatgagctgagcaagaggtag

SEQ ID NO: 142965 - DNA, 1245 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgggagtggagcctggagagcagccctgcccagaactggaccccaccccagcccaggaccctgcccagcatggtgcaccgggtgtctggccagccccagagcgtgacagccagcagtgacaaggcctttgaggactggctgaatgatgacctgggcagctaccagggcgcccagggcaacagatatgtgggcttcggcaacaccccaccaccccagaagaaggaggatgacttcctgaacaatgccatgagcagcctgtacagcggctggagcagcttcaccaccggggccagcagatttgccagcgctgccaaggagggcgccaccaagtttggcagccaggccagccagaagttctggggccacaagcagcagcctgagcccgccagcgagctgggccacagcctgaatgaaaatgtgctgaagccagcccaggagaaggtgaaggagggcaagatctttgatgatgtgagcagcggcgtgtcccagctggccagcaagggcgtgggcagcaagggctggagagatgtgaccaccttcttcagcggcaaggccgagggccccctggacagccccagcgagggccacagctaccagaacagcggcctggaccacttccagaacagcaacatcgaccagagcttctgggagaccttcggcagcgctgagcccaccaagaccaggaagagccccagcagtgacagctggacctgtgccgacaccagcacagagcggcgcagcagtgacagctgggaggtgtggggcagcgccagcaccaacagaaacagcaacagtgatggaggagagggcggggagggcaccaagaaggctgtgcccccagctgtgcccacagatgatggctgggacaaccagaactggtag

SEQ ID NO: 142966 - DNA, 1212 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgggagtggagcctggagagcagccctgcccagaactggaccccaccccagcccaggaccctgcccagcatggtgcaccgggtgtctggccagccccagagcgtgacagccagcagtgacaaggcctttgaggactggctgaatgatgacctgggcagctaccagggcgcccagggcaacagatatgtgggcttcggcaacaccccaccaccccagaagaaggaggatgacttcctgaacaatgccatgagcagcctgtacagcggctggagcagcttcaccaccggggccagcagatttgccagcgctgccaaggagggcgccaccaagtttggcagccaggccagccagaaggccagcgagctgggccacagcctgaatgaaaatgtgctgaagccagcccaggagaaggtgaaggagggcaagatctttgatgatgtgagcagcggcgtgtcccagctggccagcaagtgccagaggcggctgtgctgccaccagagccactgcagcgctggccacctgggccgggccttctgccctgtgtcctggcatgaggccctgtgtggccagacaggccgggaggagcaggccagcctgctgccccccaagcacgtggtgggcgccctggaggtgtgtgcccggggctgcccccgctgccacgtgccccacaccccaggcacagctgctgagtggccaggccgcctgtgcctgagccgggagagcgtggtgagagatggcggcaccagcccccccttcttccggggcaagcagagggccccctggacagccccccggcgggccaccgtcatcagaacagctgtgtggaccaccagcaagacagccacctag

SEQ ID NO: 142967 - DNA, 1221 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgggagtggagcctggagagcagccctgcccagaactggaccccaccccagcccaggaccctgcccagcatggtgcaccgggtgtctggccagccccagagcgtgacagccagcagtgacaaggcctttgaggactggctgaatgatgacctgggcagctaccagggcgcccagggcaacagatatgtgggcttcggcaacaccccaccaccccagaagaaggaggatgacttcctgaacaatgccatgagcagcctgtacagcggctggagcagcttcaccaccggggccagcagatttgccagcgctgccaaggagggcgccaccaagtttggcagccaggccagccagaaggccagcgagctgggccacagcctgaatgaaaatgtgctgaagccagcccaggagaaggtgaaggagggcaagatctttgatgatgtgagcagcggcgtgtcccagctggccagcaaggtgcagggcgtgggcagcaagggctggagagatgtgaccaccttcttcagcggcaaggccgagggccccctggacagccccagcgagggccacagctaccagaacagcggcctggaccacttccagaacagcaacatcgaccagagcttctgggagaccttcggcagcgctgagcccaccaagaccaggaagagccccagcagtgacagctggacctgtgccgacaccagcacagagcggcgcagcagtgacagctgggaggtgtggggcagcgccagcaccaacagaaacagcaacagtgatggaggagagggcggggagggcaccaagaaggctgtgcccccagctgtgcccacagatgatggctgggacaaccagaactggtag

SEQ ID NO: 142968 - DNA, 882 bp, Artificial Sequence
  Description of Artificial Sequence: Synthetic coding sequence
atgctgagcagcgagagctcctggagcctgcggcgcatcaccatcctggccggcccctgcagaagaagcaccacagctgagccccggcccagcctgggcatccgggtgtctggccagccccagagcgtgacagccagcagtgacaaggcctttgaggactggctgaatgatgacctgggcagctaccagggcgcccagggcaaccgctacgtgggctttggaaacaccccaccaccccagaagaaggaggatgacttcctgaacaatgccatgagcagcctgtacagcggctggagcagcttcaccactggagccagcagatttgccagcgctgccaaggagggcgccaccaagtttggcagccaggccagccagaaggccagcgagctgggccacagcctgaatgaaaatgtgctgaagccagcccaggagaaggtgaaggagggcaagatctttgatgatgtgtcctctggagtgtcccagctggccagcaaggtgcagggcgtgggcagcaagggctggagagatgtgaccaccttcttcagcggcaaggccgagggccccctggacagccccagcgagggccacagctaccagaacagcggcctggaccacttccagaacagcaacatcgaccagagcttctgggagacctttggatctgctgagcccaccaagaccaggaagagccccagcagtgacagctggacctgtgccgacaccagcacagaaagaagaagcagtgacagctgggaggtgtggggcagcgccagcaccaacagaaacagcaacagtgatggaggagagggcggggagggcaccaagaaggctgtgcccccagctgtgcccacagatgatggctgggacaaccagaactggtag

SEQ ID NO: 142969 - DNA, 1086 bp, Artificial Sequence
  Description of Artificial Sequence: Synthetic coding sequence
atgaggaccacctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgggagtggagcctggagagcagccctgcccagaactggaccccaccccagcccaggaccctgcccagcatggtgcaccgggtgtctggccagccccagagcgtgacagccagcagtgacaaggcctttgaggactggctgaatgatgacctgggcagctaccagggcgcccagggcaaccgctacgtgggctttggaaacaccccaccaccccagaagaaggaggatgacttcctgaacaatgccatgagcagcctgtacagcggctggagcagcttcaccactggagccagcagatttgccagcgctgccaaggagggcgccaccaagtttggcagccaggccagccagaagttctggggccacaagcagcagcctgagcccgccagcgagctgggccacagcctgaatgaaaatgtgctgaagccagcccaggagaaggtgaaggagggcaagatctttgatgatgtgtcctctggagtgtcccagctggccagcaaaggagtgggcagcaagggctggagagatgtgaccaccttcttcagcggcaaggccgagggccccctggacagccccagcgagggccacagctaccagaacagcggcctggaccacttccagaacagcaacatcgaccagagcttctgggagacctttggatctgctgagcccaccaagaccaggaagagccccagcagtgacagctggacctgtgccgacaccagcacagaaagaagaagcagtgacagctgggaggtgtggggcagcgccagcaccaacagaaacagcaacagtgatggaggagagggcggggagggcaccaagaaggctgtgcccccagctgtgcccacagatgatggctgggacaaccagaactggtag

SEQ ID NO: 142970 - DNA, 786 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgggagtggagcctggagagcagccctgcccagaactggaccccaccccagcccaggaccctgcccagcatggtgcaccgggtgtctggccagccccagagcgtgacagccagcagtgacaaggcctttgaggactggctgaatgatgacctgggcagctaccagggcgcccagggcaacagatatgtgggcttcggcaacaccccaccaccccagaagaaggaggatgacttcctgaacaatgccatgagcagcctgtacagcggctggagcagcttcaccaccggggccagcagatttgccagcgctgccaaggagggcgccaccaagtttggcagccaggccagccagaaggccagcgagctgggccacagcctgaatgaaaatgtgctgaagccagcccaggagaaggtgaaggagtag

SEQ ID NO: 142971 - DNA, 240 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggctag

SEQ ID NO: 142972 - DNA, 369 bp, Artificial Sequence
  Description of Artificial Sequence: Synthetic coding sequence
atggccagccccaggaccaggaaggtgctgaaggaggtgcgggtgcaggatgagaacaacgtgtgctttgaatgtggggccttcaacccccagtgggtgtctgtgacctacggcatctggatctgcctggagtgcagcggccgccaccggggcctgggcgtgcacctgagctttgtgcgctctgtgaccatggacaagtggaaggacatcgagctggagaagatgaaggccggcggcaatgccaagttccgggagttcctggagagccaggaggactatgacccctgctggagcctgcaggagaagtacaacagcagagctgctgccctcttccgggacaaggtggtggccctggccgagggccgctag

SEQ ID NO: 142973 - DNA, 759 bp, Artificial Sequence
  Description of Artificial Sequence: Synthetic coding sequence
atggtggcctccatgaggctggcctaccaggagctgcagattgacaggaagaaggaggagaagaagctgcagaacctggagggcaagaagcgggagcaggccgagcggctgggcatgggcctggtgagccgcagctctgtgagccacagcgtgctgtctgagatgcaggtgattgagcaggagacccctgtgtctgccaagagcagccgcagccagctggacctgtttgatgatgtgggcacctttgccagcggcccccccaagtacaaggacaaccccttcagcctgggggagagctttggcagccgctgggacacagatgctgcctggggcatggacagagtggaggagaaggagcctgaggtgaccatcagcagcatccggcccatcagcgagcgggccaccaacagaagagaggtggagagccgcagcagcggcctggagagcagcgaggcccggcagaagtttgctggggccaaggccatcagcagtgacatgttcttcggccgggaggtggatgctgaatatgaggcccggagccggctgcagcagctgagcggcagcagcgccatcagcagcagtgacctgtttggagacatggatggagcccacggggccggctctgtgtccctgggcaatgtgctgcccacagctgacatcgcccagttcaagcagggcgtgaagtctgtggccggcaagatggctgtgctggccaatggagtgatgaacagcctgcaggacagatatggcagctactag

SEQ ID NO: 142974 - DNA, 1245 bp, Artificial Sequence
  Description of Artificial Sequence: Synthetic coding sequence
atgcaggtgggcggcaatgccaatgccacagccttcttccggcagcacggctgcacagccaatgatgccaacaccaagtacaacagcagagctgcccagatgtaccgggagaagatccggcagctgggcagcgctgccctggcccggcacggcacagaccccccagcctgggatgccccagccacagagcccagcggcacccagcagcctgcccccagcacagagagcagcggcctggcccagcctgagcacggccccaacacagacctgctgggcaccagccccaaggccagcctggagctgaagagcagcatcatcggcaagaagaagccagctgctgccaagaagggcctgggcgccaagaagggcctgggcgcccagaaggtgagcagccagagcttcagcgagattgagcggcaggcccaggtggccgagaagctgcgggagcagcaggccgcagatgccaagaagcaggccgaggagagcatggtggcctccatgaggctggcctaccaggagctgcagattgacaggaagaaggaggagaagaagctgcagaacctggagggcaagaagcgggagcaggccgagcggctgggcatgggcctggtgagccgcagctctgtgagccacagcgtgctgtctgagatgcaggtgattgagcaggagacccctgtgtctgccaagagcagccgcagccagctggacctgtttgatgatgtgggcacctttgccagcggcccccccaagtacaaggacaaccccttcagcctgggggagagctttggcagccgctgggacacagatgctgcctggggcatggacagagtggaggagaaggagcctgaggtgaccatcagcagcatccggcccatcagcgagcgggccaccaacagaagagaggtggagagccgcagcagcggcctggagagcagcgaggcccggcagaagtttgctggggccaaggccatcagcagtgacatgttcttcggccgggaggtggatgctgaatatgaggcccggagccggctgcagcagctgagcggcagcagcgccatcagcagcagtgacctgtttggagacatggatggagcccacggggccggctctgtgtccctgggcaatgtgctgcccacagctgacatcgcccagttcaagcagggcgtgaagtctgtggccggcaagatggctgtgctggccaatggagtgatgaacagcctgcaggacagatatggcagctactag

SEQ ID NO: 142975 - DNA, 1158 bp, Artificial Sequence
  Description of Artificial Sequence: Synthetic coding sequence
atggctgctgagcccaacaagacagagatccagaccctcttcaagaggctgcgggctgtgcccaccaacaaggcctgctttgactgtggggccaagaaccccagctgggccagcatcacctatggagtcttcctgtgcatcgactgcagcggcgtgcacaggagcctgggcgtgcacctgtccttcatccgcagcacagagctggacagcaactggaactggttccagctgcgctgcatgcaggtgggcggcaatgccaatgccctgggcgccaagaagggcctgggcgcccagaaggtgagcagccagagcttcagcgagattgaaaggcaggcccaggtggccgagaagctgcgggagcagcaggccgcagatgccaagaagcaggccgaggagagcatggtggcctccatgaggctggcctaccaggagctgcagattgacaggaagaaggaggagaagaagctgcagaacctggagggcaagaagcgggagcaggccgagcggctgggcatgggcctggtgagccgcagctctgtgagccacagcgtgctgtctgagatgcaggtgattgagcaggagacccctgtgtctgccaagagcagccgcagccagctggacctgtttgatgatgtgggcacctttgccagcggcccccccaagtacaaggacaaccccttcagcctgggggagagctttggcagccgctgggacacagatgctgcctggggcatggacagagtggaggagaaggagcctgaggtgaccatcagcagcatccggcccatcagcgagcgggccaccaacagaagagaggtggagagccgcagcagcggcctggagagcagcgaggcccggcagaagtttgctggggccaaggccatcagcagtgacatgttcttcggccgggaggtggatgctgaatatgaggcccggagccggctgcagcagctgagcggcagcagcgccatcagcagcagtgacctgtttggagacatggatggagcccatggagctggctctgtgtccctgggcaatgtgctgcccacagctgacatcgcccagttcaagcagggcgtgaagtctgtggccggcaagatggctgtgctggccaacggggtgatgaacagcctgcaggacagatatggcagctactag

SEQ ID NO: 142976 - DNA, 1566 bp, Artificial Sequence
  Description of Artificial Sequence: Synthetic coding sequence
atggctgctgagcccaacaagacagagatccagaccctcttcaagaggctgcgggctgtgcccaccaacaaggcctgctttgactgtggggccaagaaccccagctgggccagcatcacctatggagtcttcctgtgcatcgactgcagcggcgtgcacaggagcctgggcgtgcacctgtccttcatccgcagcacagagctggacagcaactggaactggttccagctgcgctgcatgcaggtgggcggcaatgccaatgccacagccttcttccggcagcacggctgcacagccaatgatgccaacaccaagtacaacagccgggccgcccagatgtaccgggagaagatccggcagctgggcagcgctgccctggcccggcatggaacagacctgtggattgacaacatgagcagcgctgtgcccaaccacagccctgagaagaaggacagcgacttcttcacagagcacacccagcccccagcctgggatgccccagccacagagcccagcggcacccagcagcctgcccccagcacagagagcagcggcctggcccagcctgagcacggccccaacacagacctgctgggcaccagccccaaggccagcctggagctgaagagcagcatcatcggcaagaagaagccagctgctgccaagaagggcctgggcgccaagaagggcctgggcgcccagaaggtgagcagccagagcttcagcgagattgaaaggcaggcccaggtggccgagaagctgcgggagcagcaggccgcagatgccaagaagcaggccgaggagagcatggtggcctccatgaggctggcctaccaggagctgcagattgacaggaagaaggaggagaagaagctgcagaacctggagggcaagaagcgggagcaggccgagcggctgggcatgggcctggtgagccgcagctctgtgagccacagcgtgctgtctgagatgcaggtgattgagcaggagacccctgtgtctgccaagagcagccgcagccagctggacctgtttgatgatgtgggcacctttgccagcggcccccccaagtacaaggacaaccccttcagcctgggggagagctttggcagccgctgggacacagatgctgcctggggcatggacagagtggaggagaaggagcctgaggtgaccatcagcagcatccggcccatcagcgagcgggccaccaacagaagagaggtggagagccgcagcagcggcctggagagcagcgaggcccggcagaagtttgctggggccaaggccatcagcagtgacatgttcttcggccgggaggtggatgctgaatatgaggcccggagccggctgcagcagctgagcggcagcagcgccatcagcagcagtgacctgtttggagacatggatggagcccatggagctggctctgtgtccctgggcaatgtgctgcccacagctgacatcgcccagttcaagcagggcgtgaagtctgtggccggcaagatggctgtgctggccaacggggtgatgaacagcctgcaggacagatatggcagctactag

SEQ ID NO: 142977 - DNA, 1551 bp, Artificial Sequence
  Description of Artificial Sequence: Synthetic coding sequence
atgggagaccccagcaagcaggacatcctgaccatcttcaagaggctgcggtctgtgcccaccaacaaggtgtgctttgactgtggggccaagaaccccagctgggccagcatcacctacggcgtcttcctgtgcatcgactgcagcggcagccacaggagcctgggcgtgcacctgtccttcatccgcagcacagagctggacagcaactggagctggttccagctgcgctgcatgcaggtgggcggcaatgccagcgccagcagcttcttccaccagcacggctgcagcaccaatgacaccaatgccaagtacaacagcagagctgcccagctgtaccgggagaagatcaagagcctggccagccaggccaccaggaagcacggcacagacctgtggctggacagctgtgtggtgccccccctgagccccccacccaaggaggaggacttctttgccagccacgtgtccccagaggtgtctgacacagcctgggccagcgccatcgccgagcccagcagcctgaccagcaggcctgtggagaccaccctggagaacaatgaaggaggccaggagcagggccccagcgtggagggcctgaatgtgcccaccaaggccaccctggaggtgagcagcatcatcaagaagaagcccaaccaggccaagaagggcctgggcgccaagaagggcagcctgggcgcccagaagctggccaacacctgcttcaatgaaattgagaagcaggcccaggccgctgacaagatgaaggagcaggaggacctggccaaggtggtgtccaaggaggagagcatcgtgagcagcctgcggctggcctacaaggacctggagatccagatgaagaaggatgagaagatgaacatcagcggcaagaagaatgtggacagcgaccggctgggcatgggctttggaaactgccgcagcgtcatcagccacagcgtgaccagtgacatgcagaccatcgagcaggagagccccatcatggccaagcccaggaagaagtacaatgatgacagtgatgacagctacttcaccagcagcagcagctactttgatgagcctgtggagctgcggagcagcagcttcagctcctgggatgacagcagtgacagctactggaagaaggagaccagcaaggacacagaaacagtgctgaagaccaccggctacagcgaccggcccacagcccggaggaagccagactatgagcctgtggagaacacagatgaggcccagaagaagtttggaaatgtgaaggccatcagcagtgacatgtacttcggccggcagagccaggccgactatgagacccgggcccggctggagcggctgagcgccagcagcagcatcagcagcgctgacctgtttgaggagcccaggaagcagcctgctggcaactacagcctgagctctgtgctgcccaatgccccagacatggcccagttcaagcagggcgtgcgctctgtggccggcaagctgtctgtgtttgccaacggggtggtgaccagcatccaggacagatatggcagctag

SEQ ID NO: 142978 - DNA, 1335 bp, Artificial Sequence
  Description of Artificial Sequence: Synthetic coding sequence
atgggagaccccagcaagcaggacatcctgaccatcttcaagaggctgcggtctgtgcccaccaacaaggtgtgctttgactgtggggccaagaaccccagctgggccagcatcacctacggcgtcttcctgtgcatcgactgcagcggcagccacaggagcctgggcgtgcacctgtccttcatccgcagcacagagctggacagcaactggagctggttccagctgcgctgcatgcaggtgggcggcaatgccagcgctgtgtctgacacagcctgggccagcgccatcgccgagcccagcagcctgaccagcaggcctgtggagaccaccctggagaacaatgaaggaggccaggagcagggccccagcgtggagggcctgaatgtgcccaccaaggccaccctggaggtgagcagcatcatcaagaagaagcccaaccaggccaagaagggcctgggcgccaagaagggcagcctgggcgcccagaagctggccaacacctgcttcaatgaaattgagaagcaggcccaggccgctgacaagatgaaggagcaggaggacctggccaaggtggtgtccaaggaggagagcatcgtgagcagcctgcggctggcctacaaggacctggagatccagatgaagaaggatgagaagatgaacatcagcggcaagaagaatgtggacagcgaccggctgggcatgggctttggaaactgccgcagcgtcatcagccacagcgtgaccagtgacatgcagaccatcgagcaggagagccccatcatggccaagcccaggaagaagtacaatgatgacagtgatgacagctacttcaccagcagcagcagctactttgatgagcctgtggagctgcggagcagcagcttcagctcctgggatgacagcagtgacagctactggaagaaggagaccagcaaggacacagaaacagtgctgaagaccaccggctacagcgaccggcccacagcccggaggaagccagactatgagcctgtggagaacacagatgaggcccagaagaagtttggaaatgtgaaggccatcagcagtgacatgtacttcggccggcagagccaggccgactatgagacccgggcccggctggagcggctgagcgccagcagcagcatcagcagcgctgacctgtttgaggagcccaggaagcagcctgctggcaactacagcctgagctctgtgctgcccaatgccccagacatggcccagttcaagcagggcgtgcgctctgtggccggcaagctgtctgtgtttgccaacggggtggtgaccagcatccaggacagatatggcagctag

SEQ ID NO: 142979 - DNA, 1419 bp, Artificial Sequence
  Description of Artificial Sequence: Synthetic coding sequence
atgggagaccccagcaagcaggacatcctgaccatcttcaagaggctgcggtctgtgcccaccaacaaggtgtgctttgactgtggggccaagaaccccagctgggccagcatcacctacggcgtcttcctgtgcatcgactgcagcggcagccacaggagcctgggcgtgcacctgtccttcatccgcagcacagagctggacagcaactggagctggttccagctgcgctgcatgcaggtgggcggcaatgccagcgccctgtggctggacagctgtgtggtgccccccctgagccccccacccaaggaggaggacttctttgccagccacgtgtccccagaggtgtctgacacagcctgggccagcgccatcgccgagcccagcagcctgaccagcaggcctgtggagaccaccctggagaacaatgaaggaggccaggagcagggccccagcgtggagggcctgaatgtgcccaccaaggccaccctggaggtgagcagcatcatcaagaagaagcccaaccaggccaagaagggcctgggcgccaagaagggcagcctgggcgcccagaagctggccaacacctgcttcaatgaaattgagaagcaggcccaggccgctgacaagatgaaggagcaggaggacctggccaaggtggtgtccaaggaggagagcatcgtgagcagcctgcggctggcctacaaggacctggagatccagatgaagaaggatgagaagatgaacatcagcggcaagaagaatgtggacagcgaccggctgggcatgggctttggaaactgccgcagcgtcatcagccacagcgtgaccagtgacatgcagaccatcgagcaggagagccccatcatggccaagcccaggaagaagtacaatgatgacagtgatgacagctacttcaccagcagcagcagctactttgatgagcctgtggagctgcggagcagcagcttcagctcctgggatgacagcagtgacagctactggaagaaggagaccagcaaggacacagaaacagtgctgaagaccaccggctacagcgaccggcccacagcccggaggaagccagactatgagcctgtggagaacacagatgaggcccagaagaagtttggaaatgtgaaggccatcagcagtgacatgtacttcggccggcagagccaggccgactatgagacccgggcccggctggagcggctgagcgccagcagcagcatcagcagcgctgacctgtttgaggagcccaggaagcagcctgctggcaactacagcctgagctctgtgctgcccaatgccccagacatggcccagttcaagcagggcgtgcgctctgtggccggcaagctgtctgtgtttgccaacggggtggtgaccagcatccaggacagatatggcagctag

SEQ ID NO: 142980 - DNA, 822 bp, Artificial Sequence
  Description of Artificial Sequence: Synthetic coding sequence
tgactggccctcttccaggtgtctgacacagcctgggccagcgccatcgccgagcccagcagcctgaccagcaggcctgtggagaccaccctggagaacaatgaaggaggccaggagcagggccccagcgtggagggcctgaatgtgcccaccaaggccaccctggaggtgagcagcatcatcaagaagaagcccaaccaggccaagaagggcctgggcgccaagaagggcagcctgggcgcccagaagctggccaacacctgcttcaatgaaattgagaagcaggcccaggccgctgacaagatgaaggagcaggaggacctggccaaggtggtgtccaaggaggagagcatcgtgagcagcctgcggctggcctacaaggacctggagatccagatgaagaaggatgagaagatgaacatcagcggcaagaagaatgtggacagcgaccggctgggcatgggcttcggcaactgccgcagcgtcatcagccacagcgtgaccagtgacatgcagaccatcgagcaggagagccccatcatggccaagcccaggaagaagtacaatgatgacagtgatgacagctacttcaccagcagcagccggcccacagcccggaggaagccagactatgagcctgtggagaacacagatgaggcccagaagaagtttggaaatgtgaaggccatcagcagtgacatgtacttcggccggcagagccaggccgactatgagacccgggcccggctggagcggctgagcgccagcagcagcatcagcagcgctgacctgtttgaggagcccaggaagcagcctgcctag

SEQ ID NO: 142981 - DNA, 459 bp, Artificial Sequence
  Description of Artificial Sequence: Synthetic coding sequence
atgggagaccccagcaagcaggacatcctgaccatcttcaagaggctgcggtctgtgcccaccaacaaggtgtgctttgactgtggggccaagaaccccagctgggccagcatcacctacggcgtcttcctgtgcatcgactgcagcggcagccacaggagcctgggcgtgcacctgtccttcatccgcagcacagagctggacagcaactggagctggttccagctgcgctgcatgcaggtgggcggcaatgccagcgctgtgtctgacacagcctgggccagcgccatcgccgagcccagcagcctgaccagcaggcctgtggagaccaccctggagaacaatgaaggaggccaggagcagggccccagcgtggagggcctgaatgtgcccaccaaggccaccctggaggtgagcagcatcatcaagaagaagcccaaccaggccaagaagggctag

SEQ ID NO: 142982 - DNA, 5550 bp, Artificial Sequence
  Description of Artificial Sequence: Synthetic coding sequence
atgtatgagggcaagaagaccaagaacatgttcctgacccgggccctggagaagatcctggccgacaaggaggtgaagaaggcccaccacagccagctgaggaaggcctgtgaggtggccctggaggagatcaaggccgagacagagaagcagagcccccctcatggagaggccaaggccggcagcagcaccctgccccctgtgaagagcaagaccaacttcattgaagctgacaagtacttcctgccctttgagctggcctgccagagcaaatgtcccagaattgtgtccaccagcctggactgcctgcagaagctgattgcctacggccacctgactggaaatgccccagacagcaccacccctgggaagaagctgattgaccgcatcatcgagaccatctgtggctgcttccagggcccccagacagatgagggcgtgcagctgcagatcatcaaggccctgctgacagctgtgaccagccagcacatcgagatccacgagggcaccgtgctgcaggccgtgaggacctgctacaacatctacctggccagcaagaacctgatcaaccagaccacagccaaggccaccctgacccagatgctgaatgtcatctttgccaggatggagaaccaggccctgcaggaggccaagcagatggagaaggagcggcaccggcagcaccaccacctgctgcagagccctgtgagccaccacgagcctgagagcccccagctgcgctacctgcccccccagacagtggaccacatcagccaggagcatgaaggagacctggacctgcacaccaatgatgtggacaagagcctgcaggatgacacagagccagaaaatggaagtgacatcagcagcgcagaaaatgagcagacagaggccgaccaggccacagctgctgagaccctgagcaagaatgaggtgctgtatgatggagaaaatcatgactgtgaggagaagccccaggacatcgtgcagaacatcgtggaggagatggtgaacatcgtggtgggggacatgggagagggcaccaccatcaatgccagcgcagatggcaacatcggcaccattgaagatggcagtgacagcgagaacatccaggccaacggcatccctggcacccccatctctgtggcctacacccccagcctgcctgatgaccggctgtctgtgagcagcaatgacacccaggagagcggcaacagcagcggccccagccctggggccaagttcagccacatcctgcagaaggatgccttcctggtgttccgcagcctgtgcaagctgtccatgaagcccctgagtgatggccccccagaccccaagagccatgagctgcggagcaagatcctgagcctgcagctgctgctgagcatcctgcagaatgccggccccatcttccgcaccaatgagatgttcatcaatgccatcaagcagtacctgtgtgtggccctgagcaagaatggagtgtcctctgtgcctgaggtgtttgagctgagcctgagcatcttcctgaccctgctgagcaacttcaagacccacctgaagatgcagatcgaggtgttcttcaaggagatcttcctgtacatcctggagaccagcaccagcagctttgaccacaagtggatggtgatccagaccctgacccgcatctgtgctgatgcccagagcgtggtggacatctacgtgaactatgactgtgacctgaatgctgccaacatctttgagcggctggtgaatgacctgagcaagatcgcccagggccggggcagccaggagctgggcatgagcaatgtgcaggagctgagcctgaggaagaagggcctggagtgcctggtgtccatcctgaagtgcatggtggagtggagcaaggaccagtatgtgaaccccaacagccagaccaccctgggccaggagaagcccagcgagcaggagatgtctgagatcaagcaccctgagaccatcaacagatatggcagcctgaacagcctggagagcaccagcagcagcggcatcggcagctacagcacccagatgagcggcacagacaaccctgagcagtttgaggtgctgaagcagcagaaggagatcatcgagcagggcatcgacctcttcaacaagaagcccaagaggggcatccagtacctgcaggagcagggcatgctgggcaccaccccagaagatattgcccagttcctgcaccaggaggagcggctggacagcacccaggtgggggagttcctgggggacaatgacaagttcaacaaggaggtgatgtatgcctacgtggaccagcacgacttcagcggcaaggactttgtgtctgccctgaggatgttcctggagggcttccggctgcctggagaggcccagaagattgaccggctgatggagaagtttgctgcccgctacctggagtgcaaccagggccagaccctgtttgccagcgctgacacagcctacgtgctggcctacagcatcatcatgctgaccacagacctgcacagcccccaggtgaagaacaagatgaccaaggagcagtacatcaagatgaacagaggcatcaatgacagcaaggacctgcctgaggagtacctgagcgccatctacaatgaaattgctgggaagaagatctccatgaaggagaccaaggagctgaccatccccaccaagagcagcaagcagaatgtggccagcgagaagcagaggcggctgctgtacaacctggagatggagcagatggccaagacagccaaggccctgatggaggccgtgagccacgtgcaggcccccttcaccagcgccacccacctggagcacgtgcggcccatgttcaagctggcctggacccccttcctggccgccttctctgtgggcctgcaggactgtgatgacacagaggtggccagcctgtgcctggagggcatccgctgtgccatccgcatcgcctgcatcttcagcatccagctggagagagatgcctacgtgcaggccctggcccgcttcaccctgctgactgtgagcagcggcatcacagagatgaagcagaagaacatcgacaccatcaagaccctcatcaccgtggcccacacagatggcaactacctgggcaacagctggcatgagatcctgaagtgcatcagccagctggagctggcccagctgattggcaccggggtgaagccccgctacatcagcggcaccgtgcggggccgggagggcagcctgaccggcaccaaggaccaggccccagatgaatttgtgggcctgggcctggtgggcggcaatgtggactggaagcagatcgccagcatccaggagagcattggagagaccagcagccagagcgtggtggtggccgtggaccgcatcttcaccggcagcacccggctggatggaaatgccatcgtggactttgtgcgctggctgtgtgctgtgtccatggatgagctgctgagcaccacccaccccaggatgttcagcctgcagaagatcgtggagatctcctactacaacatgggccgcatccggctgcagtggagccgcatctgggaggtgattggagaccacttcaacaaggtgggctgcaaccccaatgaagatgtggccatctttgctgtggacagcctgcggcagctgtccatgaagttcctggagaagggggagctggccaacttccgcttccagaaggacttcctgcggccctttgagcacatcatgaagaggaacagaagccccaccatccgggacatggtggtgcgctgcatcgcccagatggtgaacagccaggccgccaacatccgcagcggctggaagaacatcttcagcgtcttccacctggccgccagtgaccaggatgagagcatcgtggagctggccttccagaccaccggccacatcgtgaccctggtgtttgagaagcacttccctgccaccatcgacagcttccaggatgctgtgaagtgcctgtctgaatttgcctgcaatgctgccttcccagacacctccatggaggccatccgcctcatccgccactgtgccaagtatgtgtctgaccggccccaggccttcaaggagtacaccagtgatgacatgaatgtggcccctgaggacagagtgtgggtgcggggctggttccccatcctgtttgagctgagctgcatcatcaaccgctgcaagctggatgtgaggacccggggcctgactgtgatgtttgagatcatgaagacctacggccacacctatgagaagcactggtggcaggacctcttccgcatcgtgttccgcatctttgacaacatgaagctgcctgagcagcagacagagaaggccgagtggatgaccaccacctgcaaccacgccctgtatgccatctgtgatgtgttcacccagtacctggaggtgctgagtgatgtgctgctggatgacatctttgcccagctgtactggtgtgtgcagcaggacaatgagcagctggcccggagcggcaccaactgcctggagaatgtggtgatcctgaatggagagaagttcaccctggagatctgggacaagacctgcaactgcaccctggacatcttcaagaccaccatcccccacgccctgctgacctggaggcccaacagcggggagacagcccctcctccacccagccctgtgtctgagaagcccctggacaccatcagccagaagtctgtggacatccatgacagcatccagcccaggtctgtggacaaccggccccaggcccccctggtgtctgccagcgctgtgaatgaggaggtgtccaagatcaagagcacagccaagtttcctgagcagaagctgtttgctgccctgctgatcaagtgtgtggtgcagctggagctgatccagaccatcgacaacatcgtgttcttccctgccaccagcaagaaggaggatgctgagaacctggccgccgcccagagagatgctgtggactttgatgtgcgggtggacacccaggaccagggcatgtaccgcttcctgaccagccagcagctgttcaagctgctggactgcctgctggagagccacagatttgccaaggccttcaacagcaacaatgagcagaggacagccctgtggaaggccggcttcaagggcaagagcaagcccaacctgctgaagcaggagaccagcagcctggcctgtggcctgcgcatcctcttcaggatgtacatggatgagagccgggtgtctgcctgggaggaggtgcagcagaggctgctgaatgtgtgcagcgaggccctgagctacttcctgaccctgaccagcgagagccaccgggaggcctggaccaacctgctgctgctcttcctgaccaaggtgctgaagatcagtgacaaccgcttcaaggcccacgccagcttctactaccccctgctgtgtgagatcatgcagtttgacctgatccctgagctgcgggctgtgctgcggcgcttcttcctgcgcatcggcgtggtgttccagatcagccagcccccagagcaggagctgggcatcaacaagcagtag

SEQ ID NO: 142983 - DNA, 5358 bp, Artificial Sequence
  Description of Artificial Sequence: Synthetic coding sequence
atgcaggagagccagaccaagtccatgtttgtgtcccgggccctggagaagatcctggccgacaaggaggtgaagaggccccagcacagccagctgcggcgggcctgccaggtggccctggatgagatcaaggccgagattgagaagcagaggctgggcacagctgccccacccaaggccaacttcattgaagctgacaagtacttcctgccctttgagctggcctgccagagcaagagcccccgggtggtgtccaccagcctggactgcctgcagaagctgattgcctacggccacatcactggaaatgccccagattctggggcccctgggaagaggctgattgaccgcatcgtggagaccatctgcagctgcttccagggcccccagacagatgagggcgtgcagctgcagatcatcaaggccctgctgacagctgtgaccagcccccacatcgagatccacgagggcaccatcctgcagacagtgaggacctgctacaacatctacctggccagcaagaacctgatcaaccagaccacagccaaggccaccctgacccagatgctgaatgtcatcttcaccaggatggagaaccaggtgctgcaggaggcccgggagctggagaagcccatccagagcaagccccagagccctgtgatccaggccgctgctgtgagccccaagtttgtgcggctgaagcacagccaggcccagagcaagcccaccaccccagagaagacagacctgaccaacggggagcacgcccggagtgacagcggcaaggtgtccacagaaaatggagatgccccccgggagcggggcagcagcctgtctggaacagatgatggagcccaggaggtggtgaaggacatcctggaggatgtggtgaccagcgccatcaaggaggccgctgagaagcacggcctgacagagcctgagcgggtgctgggggagctggagtgccaggagtgtgccatccccccaggagtggatgagaacagccagaccaacggcattgctgatgaccggcagagcctgagcagcgctgacaacctggagagtgatgcccagggccaccaggtggccgcccgcttcagccacgtgctgcagaaggatgccttcctggtgttccgcagcctgtgcaagctgtccatgaagcccctgggggagggccccccagaccccaagagccatgagctgcggagcaaggtggtgtccctgcagctgctgctgtctgtgctgcagaatgccggccctgtgttccgcacccatgagatgttcatcaatgccatcaagcagtacctgtgtgtggccctgagcaagaatggagtgtcctctgtgcctgatgtgtttgagctgagcctggccatcttcctgaccctgctgagcaacttcaagatgcacctgaagatgcagatcgaggtgttcttcaaggagatcttcctgaacatcctggagaccagcaccagcagctttgagcaccgctggatggtgatccagaccctgacccgcatctgtgctgatgcccagtgtgtggtggacatctacgtgaactatgactgtgacctgaatgctgccaacatctttgagcggctggtgaatgacctgagcaagatcgcccagggccgcagcggccacgagctgggcatgacccccctgcaggagctgagcctgaggaagaagggcctggagtgcctggtgtccatcctgaagtgcatggtggagtggagcaaggacctgtatgtgaaccccaaccaccagaccagcctgggccaggagcggctgacagaccaggagattggagatggcaagggcctggacatggcccggcgctgcagcgtgacctccatggagagcacagtgagcagcggcacccagaccaccgtgcaggatgatcctgagcagtttgaagtcatcaagcagcagaaggagatcattgaacatggaattgagctgttcaacaagaagcccaagaggggcatccagttcctgcaggagcagggcatgctgggcacctctgtggaggacatcgcccagttcctgcaccaggaggagcggctggacagcacccaggtgggggacttcctgggggacagcgcccgcttcaacaaggaggtgatgtatgcctacgtggaccagctggacttctgtgagaaggagtttgtgtctgccctgcggaccttcctggagggcttccggctgcccggggaggcccagaagattgaccggctgatggagaagtttgctgcccgctacatcgagtgcaaccagggccagaccctgtttgccagcgctgacacagcctacgtgctggcctacagcatcatcatgctgaccacagacctgcacagcccccaggtgaagaacaagatgaccaaggagcagtacatcaagatgaacagaggcatcaatgacagcaaggacctgcctgaggagtacctgagcagcatctatgaggagattgagggcaagaagatcgccatgaaggagaccaaggagctgaccatcgccaccaagagcaccaagcagaatgtggccagcgagaagcagaggcggctgctgtacaacctggagatggagcagatggccaagacagccaaggccctgatggaggccgtgagccacgccaaggcccccttcaccagcgccacccacctggaccacgtgcggcccatgttcaagctggtgtggacccccctgctggccgcctacagcatcggcctgcagaactgtgatgacacagaggtggccagcctgtgcctggagggcatccgctgtgccatcagaattgcctgcatcttcggcatgcagctggagagagatgcctacgtgcaggccctggcccgcttcagcctgctgacagccagcagcagcatcacagagatgaagcagaagaacatcgacaccatcaagaccctcatcaccgtggcccacacagatggcaactacctgggcaacagctggcatgagatcctgaagtgcatcagccagctggagctggcccagctgattggaactggagtgaagacccgctacctgagcggcagcggccgggagcgggagggcagcctgaagggccacaccctggccggggaggagttcatgggcctgggcctgggcaacctggtgtctggaggagtggacaagaggcagatggccagcttccaggagagcgtgggggagaccagcagccagagcgtggtggtggccgtggaccgcatcttcaccggcagcacccggctggatggaaatgccatcgtggactttgtgcgctggctgtgtgctgtgtccatggatgagctggccagcccccaccaccccaggatgttcagcctgcagaagatcgtggagatctcctactacaacatgaaccgcatccggctgcagtggagccgcatctggcacgtgattggagaccacttcaacaaggtgggctgcaaccccaatgaagatgtggccatctttgctgtggacagcctgcggcagctgtccatgaagttcctggagaagggggagctggccaacttccgcttccagaaggacttcctgcggccctttgagcacatcatgaagaagaacagaagccccaccatccgggacatggccatccgctgcatcgcccagatggtgaacagccaggccgccaacatccgcagcggctggaagaacatctttgctgtgttccaccaggccgccagtgaccatgatggcaacatcgtggagctggccttccagaccacctgccacatcgtgaccaccatcttccagcaccacttccctgctgccatcgacagcttccaggatgctgtgaagtgcctgtctgaatttgcctgcaatgctgccttcccagacacctccatggaggccatccgcctcatccgcttctgtgggaagtatgtgtctgagcggccccgggtgctgcaggagtacaccagtgatgacatgaatgtggcccctggggacagagtgtgggtgcggggctggttccccatcctgtttgagctgagctgcatcatcaaccgctgcaagctggatgtgaggacccggggcctgactgtgatgtttgagatcatgaagagctatggccacacctttgagaagcactggtggcaggacctcttcagaattgtgttccgcatctttgacaacatgaagctgcctgagcagctgtctgagaagtctgagtggatgaccaccacctgcaaccacgccctgtatgccatctgtgatgtgttcacccagttctatgaggccctgaatgaggtgctgctgagtgatgtgtttgcccagctgcagtggtgtgtgaagcaggacaatgagcagctggcccggagcggcaccaactgcctggagaacctggtgatcagcaatggagagaagttcagccctgaggtgtgggatgagacctgcaactgcatgctggacatcttcaagaccaccatcccccacgtgctgctgacctggaggcctgtgggcatggaggaggacagcagcgagaagcacctggatgtggacctggaccggcagagcctgagcagcattgacaagaaccccagcgagcggggccagagccagctgagcaaccccacagatgacagctggaagggccggccctatgccaaccagaagctgtttgccagcctgctgatcaagtgtgtggtgcagctggagctgatccagaccatcgacaacatcgtgttctacccagccaccagcaagaaggaggatgctgagcacatggtggccgcccagcaggacaccctggatgctgacatccacattgaaacagaggaccagggcatgtacaagtacatgagcagccagcacctgttcaagctgctggactgcctgcaggagagccacagcttcagcaaggccttcaacagcaactatgagcagaggacagtgctgtggagggctggcttcaagggcaagagcaagcccaacctgctgaagcaggagaccagcagcctggcctgctgcctgcgcatcctcttcaggatgtatgtggatgaaaatagaagagacagctgggaggagatccagcagaggctgctgactgtgtgcagcgaggccctggcctacttcatcaccgtgaacagcgagagccaccgggaggcctggaccagcctgctgctgctgctgctgaccaagaccctgaagatcaatgatgagaagttcaaggcccacgcctccatgtactacccctacctgtgtgagatcatgcagtttgacctgatccctgagctgcgggctgtgctgaggaagttcttcctgcgcatcggcgtggtgtacaagatctggatccctgaggagcccagccaggtgcctgctgccctgagccctgtgtggtag

SEQ ID NO: 142984 - DNA, 2499 bp, Artificial Sequence
  Description of Artificial Sequence: Synthetic coding sequence
atgcaggagagccagaccaagtccatgtttgtgtcccgggccctggagaagatcctggccgacaaggaggtgaagaggccccagcacagccagctgcggcgggcctgccaggtggccctggatgagatcaaggccgagattgagaagcagaggctgggcacagctgccccacccaaggccaacttcattgaagctgacaagtacttcctgccctttgagctggcctgccagagcaagagcccccgggtggtgtccaccagcctggactgcctgcagaagctgattgcctacggccacatcactggaaatgccccagattctggggcccctgggaagaggctgattgaccgcatcgtggagaccatctgcagctgcttccagggcccccagacagatgagggcgtgcagctgcagatcatcaaggccctgctgacagctgtgaccagcccccacatcgagatccacgagggcaccatcctgcagacagtgaggacctgctacaacatctacctggccagcaagaacctgatcaaccagaccacagccaaggccaccctgacccagatgctgaatgtcatcttcaccaggatggagaaccaggtgctgcaggaggcccgggagctggagaagcccatccagagcaagccccagagccctgtgatccaggccgctgctgtgagccccaagtttgtgcggctgaagcacagccaggcccagagcaagcccaccaccccagagaagacagacctgaccaacggggagcacgcccggagtgacagcggcaaggtgtccacagaaaatggagatgccccccgggagcggggcagcagcctgtctggaacagatgatggagcccaggaggtggtgaaggacatcctggaggatgtggtgaccagcgccatcaaggaggccgctgagaagcacggcctgacagagcctgagcgggtgctgggggagctggagtgccaggagtgtgccatccccccaggagtggatgagaacagccagaccaacggcattgctgatgaccggcagagcctgagcagcgctgacaacctggagagtgatgcccagggccaccaggtggccgcccgcttcagccacgtgctgcagaaggatgccttcctggtgttccgcagcctgtgcaagctgtccatgaagcccctgggggagggccccccagaccccaagagccatgagctgcggagcaaggtggtgtccctgcagctgctgctgtctgtgctgcagaatgccggccctgtgttccgcacccatgagatgttcatcaatgccatcaagcagtacctgtgtgtggccctgagcaagaatggagtgtcctctgtgcctgatgtgtttgagctgagcctggccatcttcctgaccctgctgagcaacttcaagatgcacctgaagatgcagatcgaggtgttcttcaaggagatcttcctgaacatcctggagaccagcaccagcagctttgagcaccgctggatggtgatccagaccctgacccgcatctgtgctgatgcccagtgtgtggtggacatctacgtgaactatgactgtgacctgaatgctgccaacatctttgagcggctggtgaatgacctgagcaagatcgcccagggccgcagcggccacgagctgggcatgacccccctgcaggagctgagcctgaggaagaagggcctggagtgcctggtgtccatcctgaagtgcatggtggagtggagcaaggacctgtatgtgaaccccaaccaccagaccagcctgggccaggagcggctgacagaccaggagattggagatggcaagggcctggacatggcccggcgctgcagcgtgacctccatggagagcacagtgagcagcggcacccagaccaccgtgcaggatgatcctgagcagtttgaagtcatcaagcagcagaaggagatcattgaacatggaattgagctgttcaacaagaagcccaagaggggcatccagttcctgcaggagcagggcatgctgggcacctctgtggaggacatcgcccagttcctgcaccaggaggagcggctggacagcacccaggtgggggacttcctgggggacagcgcccgcttcaacaaggaggtgatgtatgcctacgtggaccagctggacttctgtgagaaggagtttgtgtctgccctgcggaccttcctggagggcttccggctgcccggggaggcccagaagattgaccggctgatggagaagtttgctgcccgctacatcgagtgcaaccagggccagaccctgtttgccagcgctgacacagcctacgtgctggcctacagcatcatcatgctgaccacagacctgcacagcccccaggtgaagaacaagatgaccaaggagcagtacatcaagatgaacagaggcatcaatgacagcaaggacctgcctgaggagtacctgagcagcatctatgaggagattgagggcaagaagatcgccatcaagaagaactag

SEQ ID NO: 142985 - DNA, 591 bp, Artificial Sequence
  Description of Artificial Sequence: Synthetic coding sequence
atgggctctgtgaacagccggggccacaaggccgaggcccaggtggtgatgatgggcctggacagcgctgggaagaccaccctgctgtacaagctgaagggccaccagctggtggagaccctgcccaccgtgggcttcaacgtggagcccctgaaggcccctggccacgtgtccctgaccctgtgggatgtgggcggccaggcccccctgcgggcctcctggaaggactacctggagggcacagacatcctggtgtatgtgctggacagcacagatgaggcccggctgcctgagagcgctgctgagctgacagaggtgctgaatgaccccaacatggccggcgtgcccttcctggtgctggccaacaagcaggaggccccagatgccctgcccctgctgaagatccggaaccggctgagcctggagcgcttccaggaccactgctgggagctgcggggctgcagcgccctgaccggggagggcctgcctgaggccctgcagagcctgtggagcctgctgaagagccgcagctgcatgtgcctgcaggcccgggcccacggggctgagcggggggacagcaagaggagctag

SEQ ID NO: 142986 - DNA, 966 bp, Artificial Sequence
  Description of Artificial Sequence: Synthetic coding sequence
atgttcagcctgatggccagctgctgcggctggttcaagcgctggagggagcctgtgcggctggccaacaagcaggacaaggagggcgccctgggggaggctgatgtgattgagtgcctgagcctggagaagctggtgaatgagcacaagtgcctgtgccagatcgagccctgcagcgccatcagcggctacggcaagaagattgacaagagcatcaagaagggcctgtactggctgctgcacgtgattgcccgggactttgatgccctgaatgaaagaatccagaaggagaccacagagcagagggccctggaggagcaggagaagcaggagagagctgagcgggtgaggaagctgcgggaggagaggaagcagaatgagcaggagcaggccgagctggatggcaccagcggcctggccgagctggaccctgagcccaccaaccccttccagcccatcgccagcgtcatcattgaaaatgaaggcaagctggagcgggagaagaagaaccagaagatggagaaggacagtgatggctgccacctgaagcacaagatggagcacgagcagatcgagacccagggccaggtgaaccacaacggccagaagaacaatgaatttggcctggtggagaactacaaggaggccctgacccagcagctgaagaatgaagatgaaacagaccggcccagcctggagagcgccaacgggaagaagaagaccaagaagctgaggatgaagaggaaccaccgggtggagcccctgaacattgatgactgtgcccctgagagccccaccccacctcctcctcctcctcctgtgggctggggcacccccaaggtgacccggctgcccaagctggagcccctgggggagacccaccacaatgacttctacaggaagcccctgccccccctggccgtgccccagaggcccaacagtgatgcccatgatgtgatctcctag

SEQ ID NO: 142987 - DNA, 1287 bp, Artificial Sequence
  Description of Artificial Sequence: Synthetic coding sequence
atgttcagcctgatggccagctgctgcggctggttcaagcgctggagggagcctgtgaggaaggtgaccctgctgatggtgggcctggacaatgctgggaagacagccacagccaagggcatccagggcgagtacccagaagatgtggcccccaccgtgggcttcagcaagatcaacctgcggcagggcaagtttgaggtgaccatctttgacctgggcggcggcatccgcatccggggcatctggaagaactactatgcagagagctatggagtcatctttgtggtggacagcagtgatgaggagaggatggaggagaccaaggaggccatgtctgagatgctgcggcacccccgcatcagcggcaagcccatcctggtgctggccaacaagcaggacaaggagggcgccctgggggaggctgatgtgattgaatgtctgagcctggagaagctggtgaatgagcacaagtgcctgtgccagatcgagccctgcagcgccatcagcggctacggcaagaagattgacaagagcatcaagaagggcctgtactggctgctgcacgtgattgcccgggactttgatgccctgaatgaaagaatccagaaggagaccacagagcagagggccctggaggagcaggagaagcaggagcgggcagagcgggtgaggaagctgcgggaggagaggaagcagaatgagcaggagcaggccgagctggatggcaccagcggcctggccgagctggaccctgagcccaccaaccccttccagcccatcgccagcgtcatcattgaaaatgaaggcaagctggagcgggagaagaagaaccagaagatggagaaggacagtgatggctgccacctgaagcacaagatggagcacgagcagatcgagacccagggccaggtgaaccacaacggccagaagaacaatgaatttggcctggtggagaactacaaggaggccctgacccagcagctgaagaatgaagatgaaacagaccggcccagcctggagagcgccaacgggaagaagaagaccaagaagctgaggatgaagaggaaccaccgggtggagcccctgaacattgatgactgtgcccctgagagccccaccccacctcctcctcctcctcctgtgggctggggcacccccaaggtgacccggctgcccaagctggagcccctgggggagacccaccacaatgacttctacaggaagcccctgccccccctggccgtgccccagaggcccaacagtgatgcccatgatgtgatctcctag

SEQ ID NO: 142988 - DNA, 1287 bp, Artificial Sequence; identical to SEQ ID NO: 142987
  Description of Artificial Sequence: Synthetic coding sequence

SEQ ID NO: 142989 - DNA, 978 bp, Artificial Sequence
  Description of Artificial Sequence: Synthetic coding sequence
atggaggagaccaaggaggccatgtctgagatgctgcggcacccccgcatcagcggcaagcccatcctggtgctggccaacaagcaggacaaggagggcgccctgggggaggctgatgtgattgagtgcctgagcctggagaagctggtgaatgagcacaagtgcctgtgccagatcgagccctgcagcgccatcagcggctacggcaagaagattgacaagagcatcaagaagggcctgtactggctgctgcacgtgattgcccgggactttgatgccctgaatgaaagaatccagaaggagaccacagagcagagggccctggaggagcaggagaagcaggagagagctgagcgggtgaggaagctgcgggaggagaggaagcagaatgagcaggagcaggccgagctggatggcaccagcggcctggccgagctggaccctgagcccaccaaccccttccagcccatcgccagcgtcatcattgaaaatgaaggcaagctggagcgggagaagaagaaccagaagatggagaaggacagtgatggctgccacctgaagcacaagatggagcacgagcagatcgagacccagggccaggtgaaccacaacggccagaagaacaatgaatttggcctggtggagaactacaaggaggccctgacccagcagctgaagaatgaagatgaaacagaccggcccagcctggagagcgccaacgggaagaagaagaccaagaagctgaggatgaagaggaaccaccgggtggagcccctgaacattgatgactgtgcccctgagagccccaccccacctcctcctcctcctcctgtgggctggggcacccccaaggtgacccggctgcccaagctggagcccctgggggagacccaccacaatgacttctacaggaagcccctgccccccctggccgtgccccagaggcccaacagtgatgcccatgatgtgatctcctag

SEQ ID NO: 142990 - DNA, 450 bp, Artificial Sequence
  Description of Artificial Sequence: Synthetic coding sequence
atggagaaggacagtgatggctgccacctgaagcacaagatggagcacgagcagatcgagacccagggccaggtgaaccacaacggccagaagaacaatgaatttggcctggtggagaactacaaggaggccctgacccagcagctgaagaatgaagatgaaacagaccggcccagcctggagagcgccaacgggaagaagaagaccaagaagctgaggatgaagaggaaccaccgggtggagcccctgaacattgatgactgtgcccctgagagccccaccccacctcctcctcctcctcctgtgggctggggcacccccaaggtgacccggctgcccaagctggagcccctgggggagacccaccacaatgacttctacaggaagcccctgccccccctggccgtgccccagaggcccaacagtgatgcccatgatgtgatctcctag

SEQ ID NO: 142991 - DNA, 579 bp, Artificial Sequence
  Description of Artificial Sequence: Synthetic coding sequence
atgggcagcctgggcagcaagaacccccagaccaagcaggcccaggtgctgctgctgggcctggacagcgctgggaagagcaccctgctgtacaagctgaagctggccaaggacatcaccaccatccccaccatcggcttcaacgtggagatgattgagctggagaggaacctgagcctgactgtgtgggatgtgggcggccaggagaagatgaggacagtgtggggctgctactgtgagaacacagatggcctggtgtatgtggtggacagcacagacaagcagaggctggaggagagccagaggcagtttgagcacatcctgaagaatgagcacatcaagaatgtgcctgtggtgctgctggccaacaagcaggacatgcctggggccctgacagctgaggacatcaccaggatgttcaaggtgaagaagctgtgcagcgacaggaactggtacgtgcagccctgctgtgccctgaccggggagggcctggcccagggcttcaggaagctgaccggctttgtgaagagccacatgaagagcagaggagacaccctggccttcttcaagcagaactag

SEQ ID NO: 142992 - DNA, 555 bp, Artificial Sequence
  Description of Artificial Sequence: Synthetic coding sequence
atgggcctgctgaccatcctgaagaagatgaagcagaaggagcgggagctgcggctgctgatgctgggcctggacaatgccggcaagaccaccatcctgaagaagttcaatggagaagatattgacaccatcagccccaccctgggcttcaacatcaagaccctggagcaccggggcttcaagctgaacatctgggatgtgggcggccagaagagcctgcggagctactggaggaactactttgagagcacagatggcctcatctgggtggtggacagcgctgaccggcagaggatgcaggactgccagcgggagctgcagagcctgctggtggaggagcggctggccggggccaccctgctgatctttgccaacaagcaggacctgcccggggccctgagcagcaatgccatccgggaggtgctggagctggacagcatccgcagccaccactggtgcatccagggctgcagcgctgtgactggagagaacctgctgcccggcatcgactggctgctggatgacatcagcagccgcatcttcaccgctgactag

SEQ ID NO: 142993 - DNA, 555 bp, Artificial Sequence; identical to SEQ ID NO: 142992
  Description of Artificial Sequence: Synthetic coding sequence

SEQ ID NO: 142994 - DNA, 474 bp, Artificial Sequence
  Description of Artificial Sequence: Synthetic coding sequence
atgggcctgctgaccatcctgaagaagatgaagcagaaggagcgggagctgcggctgctgatgctgggcctggacaatgccggcaagaccaccatcctgaagaagttcaatggagaagatattgacaccatcagccccaccctgggcttcaacatcaagaccctggagcaccggggcttcaagctgaacatctgggatgtgggcggccagaagagcctgcggagctactggaggaactactttgagagcacagatggcctcatctgggtggtggacagcgctgaccggcagaggatgcaggactgccagcgggagctgcagagcctgctggtggaggaggtgctggagctggacagcatccgcagccaccactggtgcatccagggctgcagcgctgtgactggagagaacctgctgcccggcatcgactggctgctggatgacatcagcagccgcatcttcaccgctgactag

SEQ ID NO: 142995 - DNA, 549 bp, Artificial Sequence
  Description of Artificial Sequence: Synthetic coding sequence
atgggcctgctgagcatcctgaggaagctgaagagcgccccagaccaggaggtgcgcatcctgctgctgggcctggacaatgctgggaagaccaccctgctgaagcagctggccagcgaggacatcagccacatcacccccacccagggcttcaacatcaagtctgtgcagagccagggcttcaagctgaatgtgtgggacatcggcggccagaggaagatccggccctactggaagaactactttgaaaatacagacatcctgatctacgtgattgacagcgctgacaggaagagatttgaggagaccggccaggagctggccgagctgctggaggaggagaagctgagctgtgtgcctgtgctgatctttgccaacaagcaggacctgctgacagctgccccagccagcgagattgctgagggcctgaacctgcacaccatccgggacagagtgtggcagatccagagctgcagcgccctgaccggggagggcgtgcaggacggcatgaactgggtgtgcaagaatgtgaatgccaagaagaagtag

SEQ ID NO: 142996 - DNA, 606 bp, Artificial Sequence
  Description of Artificial Sequence: Synthetic coding sequence
atgggcaaccacctgacagagatggcccccacagccagcagcttcctgccccacttccaggccctgcacgtggtggtgattggcctggacagcgctgggaagaccagcctgctgtaccgcctgaagttcaaggagtttgtgcagagcgtgcccaccaagggcttcaacacagagaagatccgggtgcccctgggcggcagccggggcatcaccttccaggtgtgggatgtgggcggccaggagaagctgcggcccctgtggaggagctacaccaggagaacagatggcctggtgtttgtggtggatgctgctgaggccgagcggctggaggaggccaaggtggagctgcaccgcatcagccgggccagtgacaaccagggcgtgcctgtgctggtgctggccaacaagcaggaccagcccggggccctgtctgctgctgaggtggagaagaggctggccgtgcgggagctggccgccgccaccctgacccacgtgcagggctgcagcgctgtggatggcctgggcctgcagcagggcctggagcggctgtatgagatgatcctgaagaggaagaaggccgcccggggcggcaagaagagaagatag

SEQ ID NO: 142997 - DNA, 561 bp, Artificial Sequence
  Description of Artificial Sequence: Synthetic coding sequence
atgggcctgctggaccggctgtctgtgctgctgggcctgaagaagaaggaggtgcacgtgctgtgcctgggcctggacaacagcggcaagaccaccatcatcaacaagctgaagcccagcaatgcccagagccagaacatcctgcccaccatcggcttcagcattgagaagttcaagagcagcagcctgtccttcaccgtgtttgacatgagcggccagggccgctacagaaacctgtgggagcactactacaaggagggccaggccatcatcttcgtcatcgacagcagtgaccggctgaggatggtggtggccaaggaggagctggacaccctgctgaaccacccagacatcaagcaccggcgcatccccatcctcttctttgccaacaagatggacctgagagatgctgtgacctctgtgaaggtgtcccagctgctgtgcctggagaacatcaaggacaagccctggcacatctgtgccagtgatgccatcaagggggagggcctgcaggagggcgtggactggctgcaggaccagatccagacagtgaagacctag

SEQ ID NO: 142998 - DNA, 561 bp, Artificial Sequence; identical to SEQ ID NO: 142997
  Description of Artificial Sequence: Synthetic coding sequence

SEQ ID NO: 142999 - DNA, 366 bp, Artificial Sequence
  Description of Artificial Sequence: Synthetic coding sequence
atgggcctgctggaccggctgtctgtgctgctgggcctgaagaagaaggaggtgcacgtgctgtgcctgggcctggacaacagcggcaagaccaccatcatcaacaagctgaagcccagcaatgcccagagccagaacatcctgcccaccatcggcttcagcattgagaagttcaagagcagcagcctgtccttcaccgtgtttgacatgagcggccagggccgctacagaaacctgtgggagcactactacaaggagggccaggccatcatcttcgtcatcgacagcagtgaccggctgaggatggtggtggccaaggaggagctggacaccctgctgaaccacccagacatcaagcacaggtag

SEQ ID NO: 143000 - DNA, 561 bp, Artificial Sequence; identical to SEQ ID NO: 142997
  Description of Artificial Sequence: Synthetic coding sequence

SEQ ID NO: 143001 - DNA, 561 bp, Artificial Sequence; identical to SEQ ID NO: 142997
  Description of Artificial Sequence: Synthetic coding sequence

SEQ ID NO: 143002 - DNA, 564 bp, Artificial Sequence
  Description of Artificial Sequence: Synthetic coding sequence
ctgcggcccacctggaaggccctgagccacccagcctggccagaggagaagaacaagcagatcctggtgctgggcctggatggagctgggaagacctctgtgctgcacagcctggccagcaacagagtgcagcacagcgtggcccccacccagggcttccacgctgtgtgcatcaacacagaggacagccagatggagttcctggagatcggcggcagcaagcccttccgcagctactgggagatgtacctgagcaagggcctgctgctgatctttgtggtggacagcgctgaccacagccggctgcctgaggccaagaagtacctgcaccagctgattgctgccaaccctgtgctgcccctggtggtgtttgccaacaagcaggacctggaggccgcctaccacatcacagacatccacgaggccctggccctgtctgaggtgggcaatgacaggaagatgttcctgtttggcacctacctgaccaagaatggcagcgagatccccagcaccatgcaggatgccaaggacctgattgcccagctggccgcagatgtgcagtag

SEQ ID NO: 143003 - DNA, 1083 bp, Artificial Sequence
  Description of Artificial Sequence: Synthetic coding sequence
atggagcgggccggccctgctggggaggagggcggggcccgggagggccgcctgctgccccgggcccctggggcctgggtgctgcgggcctgtgccgagagagctgccctggaggtgggcgccgccagcgctgacaccggggtgcggggctgtggggcccggggccctgcccccctgctggccagcgctgggggcggccgggccagagatggcacctggggcgtgaggaccaagggcagcggggccgccctgcccagcaggcctgccagccgggccgcccccaggcctgaggccagcagcccccccctgcccctggagaaggcccggggcggcctgagcggcccccagggcggccgggcccggggggccatggcccacgtgggcagcaggaagaggagccgcagccgcagccgcagccggggccggggcagcgagaagaggaagaagaagagcaggaaggacaccagcaggaactgcagcgccagcaccagccagggcaggaaggccagcacagcccctggagctgaggccagccccagcccctgcatcacagagaggagcaagcagaaggcccggcggaggaccaggagcagcagcagcagcagcagcagcagcagcagcagcagcagcagcagcagcagcagcagcagcagcagcagcagtgatggcaggaagaagaggggcaagtacaaggacaagaggaggaagaagaagaagaagaggaagaagctgaagaagaagggcaaggagaaggccgaggcccagcaggtggaggccctgcccggccccagcctggaccagtggcacaggtctgctggggaggaggaggatggccctgtgctgacagatgagcagaagagccgcatccaggccatgaagcccatgaccaaggaggagtgggatgcccggcagagcatcatcaggaaggtggtggaccctgagactggaagaaccaggctcatcaagggagatggagaggtgctggaggagatcgtgaccaaggagcggcaccgggagatcaacaagcaggccaccaggggggactgcctggccttccagatgagagctggcctgctgccctag

SEQ ID NO: 143004 - DNA, 1017 bp, Artificial Sequence
  Description of Artificial Sequence: Synthetic coding sequence
atggagcgggccggccctgctggggaggagggcggggcccgggagggccgcctgctgccccgggcccctggggcctgggtgctgcgggcctgtgccgagagagctgccctggaggtgggcgccgccagcgctgacaccggggtgcggggctgtggggcccggggccctgcccccctgctggccagcgctgggggcggccgggccagagatggcacctggggcgtgaggaccaagggcagcggggccgccctgcccagcaggcctgccagccgggccgcccccaggcctgaggccagcagcccccccctgcccctggagaaggcccggggcggcctgagcggcccccagggcggccgggcccggggggccatggcccacgtgggcagcaggaagaggagccgcagccgcagccgcagccggggccggggcagcgagaagaggaagaagaagagcaggaaggacaccagcaggaactgcagcgccagcaccagccaggagaggagcaagcagaaggcccggcggaggaccaggagcagcagcagcagcagcagcagcagcagcagcagcagcagcagcagcagcagcagcagcagcagcagcagcagtgatggcaggaagaagaggggcaagtacaaggacaagaggaggaagaagaagaagaagaggaagaagctgaagaagaagggcaaggagaaggccgaggcccagcaggtggaggccctgcccggccccagcctggaccagtggcacaggtctgctggggaggaggaggatggccctgtgctgacagatgagcagaagagccgcatccaggccatgaagcccatgaccaaggaggagtgggatgcccggcagagcatcatcaggaaggtggtggaccctgagaccggccgcaccaggctcatcaagggagatggagaggtgctggaggagatcgtgaccaaggagcggcaccgggagatcaacaaggtgggcgtggcccccctgcctgccatccggccccagctgtgcctgtag

SEQ ID NO: 143005 - DNA, 1059 bp, Artificial Sequence
  Description of Artificial Sequence: Synthetic coding sequence
atggagcgggccggccctgctggggaggagggcggggcccgggagggccgcctgctgccccgggcccctggggcctgggtgctgcgggcctgtgccgagagagctgccctggaggtgggcgccgccagcgctgacaccggggtgcggggctgtggggcccggggccctgcccccctgctggccagcgctgggggcggccgggccagagatggcacctggggcgtgaggaccaagggcagcggggccgccctgcccagcaggcctgccagccgggccgcccccaggcctgaggccagcagcccccccctgcccctggagaaggcccggggcggcctgagcggcccccagggcggccgggcccggggggccatggcccacgtgggcagcaggaagaggagccgcagccgcagccgcagccggggccggggcagcgagaagaggaagaagaagagcaggaaggacaccagcaggaactgcagcgccagcaccagccagggcaggaaggccagcacagcccctggagctgaggagaggagcaagcagaaggcccggcggaggaccaggagcagcagcagcagcagcagcagcagcagcagcagcagcagcagcagcagcagcagcagcagcagcagcagcagtgatggcaggaagaagaggggcaagtacaaggacaagaggaggaagaagaagaagaagaggaagaagctgaagaagaagggcaaggagaaggccgaggcccagcaggtggaggccctgcccggccccagcctggaccagtggcacaggtctgctggggaggaggaggatggccctgtgctgacagatgagcagaagagccgcatccaggccatgaagcccatgaccaaggaggagtgggatgcccggcagagcatcatcaggaaggtggtggaccctgagactggaagaaccaggctcatcaagggagatggagaggtgctggaggagatcgtgaccaaggagcggcaccgggagatcaacaagcaggccaccaggggggactgcctggccttccagatgagagctggcctgctgccctag

SEQ ID NO: 143006 - DNA, 1026 bp, Artificial Sequence
  Description of Artificial Sequence: Synthetic coding sequence
atggagcgggccggccctgctggggaggagggcggggcccgggagggccgcctgctgccccgggcccctggggcctgggtgctgcgggcctgtgccgagagagctgccctggaggtgggcgccgccagcgctgacaccggggtgcggggctgtggggcccggggccctgcccccctgctggccagcgctgggggcggccgggccagagatggcacctggggcgtgaggaccaagggcagcggggccgccctgcccagcaggcctgccagccgggccgcccccaggcctgaggccagcagcccccccctgcccctggagaaggcccggggcggcctgagcggcccccagggcggccgggcccggggggccatggcccacgtgggcagcaggaagaggagccgcagccgcagccgcagccggggccggggcagcgagaagaggaagaagaagagcaggaaggacaccagcaggaactgcagcgccagcaccagccaggagaggagcaagcagaaggcccggcggaggaccaggagcagcagcagcagcagcagcagcagcagcagcagcagcagcagcagcagcagcagcagcagcagcagcagcagtgatggcaggaagaagaggggcaagtacaaggacaagaggaggaagaagaagaagaagaggaagaagctgaagaagaagggcaaggagaaggccgaggcccagcaggtggaggccctgcccggccccagcctggaccagtggcacaggtctgctggggaggaggaggatggccctgtgctgacagatgagcagaagagccgcatccaggccatgaagcccatgaccaaggaggagtgggatgcccggcagagcatcatcaggaaggtggtggaccctgagaccggccgcaccaggctcatcaagggagatggagaggtgctggaggagatcgtgaccaaggagcggcaccgggagatcaacaagcaggccaccaggggggactgcctggccttccagatgagagctggcctgctgccctag

SEQ ID NO: 143007 - DNA, 567 bp, Artificial Sequence
  Description of Artificial Sequence: Synthetic coding sequence
atggatgtgaacatcgcccccctgcgggcctgggatgacttcttccctggcagtgacagatttgcccggccagacttccgggacatcagcaagtggaacaacagagtggtgagcaacctgctgtactaccagaccaactacctggtggtggccgccatgatgatcagcatcgtgggcttcctgagccccttcaacatgatcctgggcggcatcgtggtggtgctggtgttcaccggctttgtgtgggccgcccacaacaaggatgtgctgcggaggatgaagaagcgctaccccaccacctttgtgatggtggtgatgctggccagctacttcctgatctccatgtttggaggagtgatggtgtttgtgtttggcatcaccttccccctgctgctgatgttcatccacgccagcctgcggctgaggaacctgaagaacaagctggagaacaagatggagggcatcggcctgaagaggacccccatgggcatcgtgctggatgccctggagcagcaggaggagggcatcaaccggctgacagactacatcagcaaggtgaaggagtag

SEQ ID NO: 143008 - DNA, 411 bp, Artificial Sequence
  Description of Artificial Sequence: Synthetic coding sequence
atggatgtgaacatcgcccccctgcgggcctgggatgacttcttccctggcagtgacagatttgcccggccagacttccgggacatcagcaagtggaacaacagagtggtgagcaacctgctgtactaccagaccaactacctggtggtggccgccatgatgatcagcatcgtgggcttcctgagccccttcaacatgatcctgggcggcatcgtggtggtgctggtgttcaccggctttgtgtgggccgcccatgatgtgcgctatggaggccacgtgggggagctgttcccctacctgcacgtgtggaggagccacggcctgtgtgtgtggcactacttctcctttgctgtggatgtgtacccctgcatcgtggagaccagcgagccccaggagcagacaggagagtag

SEQ ID NO: 143009 - DNA, 819 bp, Artificial Sequence
  Description of Artificial Sequence: Synthetic coding sequence
atggtgcgctgctacgtggagatcgtggagaagctgcctgagaggaggccagaccctgccaccatcgagggctgtgcccagctgaagcccaacaactacctgctggcctggcacacccccttcaatgagaagggcagcggctttggagctgccaccaaggccatgtgcatcggcctgcgctactggaagccagagcggctggagaccctgattgaggtgtctgtggagtgtggccgcatgacccacaaccaccccaccggcttcctgggcagcctgtgcacagccctgtttgtgtcctttgctgcccagggcaagcccctggtgcagtggggccgggacatgctgcgggctgtgcccctggccgaggagtactgcaggaagaccatccgccacacagctgagtaccaggagcactggttctactttgaggccaagtggcagttctacctggaggagaggaagatcagcaaggacagcgagaacaaggccatcttcccagacaactatgatgctgaggagcgggagaagacctacaggaagtggagcagcgagggccggggcggcagaagaggacatgatgcccccatgattgcctatgatgccctgctggccgccggcaacagctggacagagctgtgccaccgggccatgtttcatggaggagagagcgctgccaccggcaccatcgccggctgcctgtttggcctgctgtatggcctggacctggtgcccaagggcctgtaccaggacctggaggacaaggagaagctggaggacctgggcgccgccctgtaccgcctgagcacagaggagaagtag

SEQ ID NO: 143010 - DNA, 1065 bp, Artificial Sequence
  Description of Artificial Sequence: Synthetic coding sequence
atggagaagttcaaggccgccatgctgctgggctctgtgggagatgccctgggctacagaaatgtgtgcaaggagaacagcacagtgggcatgaagatccaggaggagctgcagaggtctgggggcctggaccacctggtgctgagccctggagagtggcctgtgtctgacaacaccatcatgcacatcgccacagctgaggccctgaccacagactactggtgcctggatgacctgtaccgggagatggtgcgctgctacgtggagatcgtggagaagctgcctgagaggaggccagaccctgccaccatcgagggctgtgcccagctgaagcccaacaactacctgctggcctggcacacccccttcaatgagaagggcagcggctttggagctgccaccaaggccatgtgcatcggcctgcgctactggaagccagagcggctggagaccctgattgaggtgtctgtggagtgtggccgcatgacccacaaccaccccaccggcttcctgggcagcctgtgcacagccctgtttgtgtcctttgctgcccagggcaagcccctggtgcagtggggccgggacatgctgcgggctgtgcccctggccgaggagtactgcaggaagaccatccgccacacagctgagtaccaggagcactggttctactttgaggccaagtggcagttctacctggaggagaggaagatcagcaaggacagcgagaacaaggccatcttcccagacaactatgatgctgaggagcgggagaagacctacaggaagtggagcagcgagggccggggcggcagaagaggacatgatgcccccatgattgcctatgatgccctgctggccgccggcaacagctggacagagctgtgccaccgggccatgtttcatggaggagagagcgctgccaccggcaccatcgccggctgcctgtttggcctgctgtatggcctggacctggtgcccaagggcctgtaccaggacctggaggacaaggagaagctggaggacctgggcgccgccctgtaccgcctgagcacagaggagaagtag

SEQ ID NO: 143011 - DNA, 531 bp, Artificial Sequence
  Description of Artificial Sequence: Synthetic coding sequence
atggtgcgctgctacgtggagatcgtggagaagctgcctgagaggaggccagaccctgccaccatcgagggctgtgcccagctgaagcccaacaactacctgctggcctggcacacccccttcaatgagaagggcagcggctttggagctgccaccaaggccatgtgcatcggcctgcgctactggaagccagagcggctggagaccctgattgaggtgtctgtggagtgtggccgcatgacccacaaccaccccaccggcttcctgggcagcctgtgcacagccctgtttgtgtcctttgctgcccagggcaagcccctggtgcagtggggccgggacatgctgcgggctgtgcccctggccgaggagtactgcaggaagaccatccgccacacagctgagtaccaggagcactggttctactttgaggccaagtggcagttctacctggaggagaggaagatcagcaaggacagcgagaacaaggccatcttcccagacaactatgatgctgaggagcgggagaagtag

SEQ ID NO: 143012 - DNA, 1092 bp, Artificial Sequence
  Description of Artificial Sequence: Synthetic coding sequence
atggctgctgctgccatggctgctgctgctgggggcggggccggggccgcccggagcctgagccgcttccggggctgcctggccggggccctgctgggggactgtgtgggcagcttctatgaggcccatgacacagtggacctgacctctgtgctgcggcacgtgcagagcctggagccagaccccggcaccccaggcagcgagaggacagaggccctgtactacacagatgacacagccatggcccgggccctggtgcagagcctgctggccaaggaggcctttgatgaggtggacatggcccacagatttgcccaggagtacaagaaggaccctgaccggggctacggggccggcgtggtgaccgtcttcaagaagctgctgaaccccaagtgcagagatgtgtttgagcccgcccgggcccagttcaacgggaagggcagctatggaaatggaggagccatgagggtggccggcatcagcctggcctacagctctgtgcaggatgtgcagaagtttgcccggctgagcgcccagctgacccacgccagcagcctgggctacaatggagccatcctgcaggccctggccgtgcacctggccctgcagggcgagagcagcagcgagcacttcctgaagcagctgctgggccacatggaggacctggagggagatgcccagagcgtgctggatgcccgggagctgggcatggaggagcggccctacagcagccggctgaagaagattggagagctgctggaccaggcctctgtgacccgggaggaggtggtgtctgagctgggcaatggaattgctgcctttgagagcgtgcccacagccatctactgcttcctgcgctgcatggagccagaccctgagatccccagcgccttcaacagcctgcagaggaccctcatctacagcatcagcctgggcggggacacagacaccatcgccaccatggccggggccatcgccggggcctactacggcatggaccaggtgcctgagagctggcagcagagctgtgagggctatgaggagacagacatcctggcccagagcctgcacagggtcttccagaagagctag

SEQ ID NO: 143013 - DNA, 852 bp, Artificial Sequence
  Description of Artificial Sequence: Synthetic coding sequence
atggcccgggccctggtgcagagcctgctggccaaggaggcctttgatgaggtggacatggcccacagatttgcccaggagtacaagaaggaccctgaccggggctacggggccggcgtggtgaccgtcttcaagaagctgctgaaccccaagtgcagagatgtgtttgagcccgcccgggcccagttcaacgggaagggcagctatggaaatggaggagccatgagggtggccggcatcagcctggcctacagctctgtgcaggatgtgcagaagtttgcccggctgagcgcccagctgacccacgccagcagcctgggctacaatggagccatcctgcaggccctggccgtgcacctggccctgcagggcgagagcagcagcgagcacttcctgaagcagctgctgggccacatggaggacctggagggagatgcccagagcgtgctggatgcccgggagctgggcatggaggagcggccctacagcagccggctgaagaagattggagagctgctggaccaggcctctgtgacccgggaggaggtggtgtctgagctgggcaatggaattgctgcctttgagagcgtgcccacagccatctactgcttcctgcgctgcatggagccagaccctgagatccccagcgccttcaacagcctgcagaggaccctcatctacagcatcagcctgggcggggacacagacaccatcgccaccatggccggggccatcgccggggcctactacggcatggaccaggtgcctgagagctggcagcagagctgtgagggctatgaggagacagacatcctggcccagagcctgcacagggtcttccagaagagctag

SEQ ID NO: 143014 - DNA, 630 bp, Artificial Sequence
  Description of Artificial Sequence: Synthetic coding sequence
atgagggtggccggcatcagcctggcctacagctctgtgcaggatgtgcagaagtttgcccggctgagcgcccagctgacccacgccagcagcctgggctacaatggagccatcctgcaggccctggccgtgcacctggccctgcagggcgagagcagcagcgagcacttcctgaagcagctgctgggccacatggaggacctggagggagatgcccagagcgtgctggatgcccgggagctgggcatggaggagcggccctacagcagccggctgaagaagattggagagctgctggaccaggcctctgtgacccgggaggaggtggtgtctgagctgggcaatggaattgctgcctttgagagcgtgcccacagccatctactgcttcctgcgctgcatggagccagaccctgagatccccagcgccttcaacagcctgcagaggaccctcatctacagcatcagcctgggcggggacacagacaccatcgccaccatggccggggccatcgccggggcctactacggcatggaccaggtgcctgagagctggcagcagagctgtgagggctatgaggagacagacatcctggcccagagcctgcacagggtcttccagaagagctag

SEQ ID NO: 143015 - DNA, 984 bp, Artificial Sequence
  Description of Artificial Sequence: Synthetic coding sequence
atgcagatgcctgccatgatgagcctgctgctggtgtctgtgggcctgatggaggccctgcaggcccagagccaccccatcacccggcgggacctcttcagccaggagatccagctggacatggccctggccagctttgatgaccagtatgccggctgtgccgccgccatgacagctgccctgcctgacctgaaccacacagagttccaggccaaccaggtgtatgctgacagctggaccctggccagcagccagtggcaggagcggcaggcccgctggccagagtggagcctgagccccacccggcccagccccccacccctgggcttcagagatgagcacggcgtggccctgctggcctacacagccaacagccccctgcacaaggagttcaatgctgctgtgcgggaggccggccgcagccgggcccactacctgcaccacttctccttcaagaccctgcacttcctgctgacagaggccctgcagctgctgggcagcggccagaggcctccccgctgccaccaggtgttccggggcgtgcacggcctgcgcttccggcctgctggcccccgggccaccgtgcggctgggcggctttgccagcgccagcctgaagcacgtggccgcccagcagtttggagaggacaccttcttcggcatctggacctgcctgggcgcccccatcaagggctacagcttcttccctggagaggaggaggtgctgatccccccatttgagaccttccaggtgatcaatgccagccggctggcccagggccctgcccgcatctacctgcgggccctgggcaagcacagcacctacaactgtgagtacatcaaggacaagaagtgcaagagcggcccctgccacctggacaacagcgccatgggccagagccccctgtctgctgtgtggagcctgctgctgctgctgtggttcctggtggtgcgggccttcccagatggccctggcctgctgtag

SEQ ID NO: 143016 - DNA, 1104 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactacatctacggcttccagttcaaggccttccacttctacctgacccgggccctgcagctgctgaggaagccctgtgaggccagcagcaagacagtggtgtaccgcaccagccagggcaccagcttcaccttcggcggcctgaaccaggcccgcttcggccacttcaccctggcctacagcgccaagccccaggccgccaatgaccagctgactgtgctgagcatctacacctgcctgggcgtggacatcgagaacttcctggacaaggagagcgagcgcatcaccctcatccccctgaatgaggtgttccaggtgtcccaggagggcgccggcaacaacctgatcctgcagagcatcaacaagacctgcagccactatgaatgtgccttcctgggcggcctgaagacagagaactgcatcgagaacctggagtacttccagcccatctacgtgtacaaccctggagagaagaaccagaagctggaggaccacagcgagaagaactggaagctggaggaccacggggagaagaaccagaagctggaggaccacggcgtgaagatcctggagcccacccagatcccagcccctggccctgtgcctgtgcccggccccaagagccaccccagcgccagcagcggcaagctgctgctgccccagtttggcatggtgatcatcctgatctctgtgtctgccatcaacctgtttgtggccctgtag

SEQ ID NO: 143017 - DNA, 1137 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactacatctacggcttccagttcaaggccttccacttctacctgacccgggccctgcagctgctgaggaagccctgtgaggccagcagcaagacagtggtgtaccgcaccagccagggcaccagcttcaccttcggcggcctgaaccaggcccgcttcggccacttcaccctggcctacagcgccaagccccaggccgccaatgaccagctgactgtgctgagcatctacacctgcctgggcgtggacatcgagaacttcctggacaaggagagcgagcgcatcaccctcatccccctgaatgaggtgttccaggtgtcccaggagggcgccggcaacaacctgatcctgcagagcatcaacaagacctgcagccactatgaatgtgccttcctgggcggcctgaagacagagaactgcatcgagaacctggagtacttccagcccatctacgtgtacaaccctggagagaagaaccagaagctggaggaccacagcgagaagaactggaagctggaggaccacggggagaagaaccagaagctggaggaccacggcgtgaagatcctggagcccacccagatccctgaggacaagagccagggcaacatcaacaaccccaccccaggccctgtgcctgtgcccggccccaagagccaccccagcgccagcagcggcaagctgctgctgccccagtttggcatggtgatcatcctgatctctgtgtctgccatcaacctgtttgtggccctgtag

SEQ ID NO: 143018 - DNA, 1170 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactacatctacggcttccagttcaaggccttccacttctacctgacccgggccctgcagctgctgaggaagccctgtgaggccagcagcaagacagtggtgtaccgcaccagccagggcaccagcttcaccttcggcggcctgaaccaggcccgcttcggccacttcaccctggcctacagcgccaagccccaggccgccaatgaccagctgactgtgctgagcatctacacctgcctgggcgtggacatcgagaacttcctggacaaggagagcgagcgcatcaccctcatccccctgaatgaggtgttccaggtgtcccaggagggcgccggcaacaacctgatcctgcagagcatcaacaagacctgcagccactatgaatgtgccttcctgggcggcctgaagacagagaactgcatcgagaacctggagtacttccagcccatctacgtgtacaaccctggagagaagaaccagaagctggaggaccacagcgagaagaactggaagctggaggaccacggggagaagaaccagaagctggaggaccacggcgtgaagatcctggagcccacccagatccctggcatgaagatccctgagcccttccccctgcctgaggacaagagccagggcaacatcaacaaccccaccccaggccctgtgcctgtgcccggccccaagagccaccccagcgccagcagcggcaagctgctgctgccccagtttggcatggtgatcatcctgatctctgtgtctgccatcaacctgtttgtggccctgtag

SEQ ID NO: 143019 - DNA, 390 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactactag

SEQ ID NO: 143020 - DNA, 528 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactacatctacggcttccagttcaaggccttccacttctacctgacccgggccctgcagctgctgaggaagccctgtgaggccagcagcaagacagtggtgtaccgcaccagccagggcaccagcttcaccttcggcggcctgtag

SEQ ID NO: 143021 - DNA, 609 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagcagacccccttctaccacctgttcagcgaggccgtgaagatggccggccagagccgggaggactacatctacggcttccagttcaaggccttccacttctacctgacccgggccctgcagctgctgaggaagccctgtgaggccagcagcaagacagtggtgtaccgcaccagccagggcaccagcttcaccttcggcggcctgaaccaggcccgcttcggccacttcaccctggcctacagcgccaagccccaggccgccaatgaccagctgactgtgctgtcctag

SEQ ID NO: 143022 - DNA, 324 bp, Artificial Sequence
  Description of Artificial Sequence: Synthetic coding sequence
atgaagacaggccactttgagatcgtgaccatgctgctggccaccatgatcctggtggacatcttccaggtgaaggccgaggtgctggacatggctgacaatgcctttgatgatgagtacctgaagtgcacagacaggatggagatcaagtatgtgccccagctgctgaaggaggagaaggccagccaccagcagctggacacagtgtgggagaatgccaaggccaagtgggccgccaggaagacccagatcttcctgcccatgaacttcaaggacaaccacggcatcgccctgatggcctacatcagcgaggcccaggagtag

SEQ ID NO: 143023 - DNA, 456 bp, Artificial Sequence
  Description of Artificial Sequence: Synthetic coding sequence
atgagcggccggggcaagcagggcggcaaggtgcgggccaaggccaagagccgcagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccatctgtgagcacagcggccccagcagcggcaagatccccagcgacagagctgagctgggcgccggctctgtgtgtggccacatcttccagaaggtggagtag

SEQ ID NO: 143024 - DNA, 177 bp, Artificial Sequence
  Description of Artificial Sequence: Synthetic coding sequence
atgggccccctcatcaaccgctgcaagaagatcctgctgcccaccaccgtgcccccagccaccatgaggatctggctgctgggcggcctgctgcccttcctgctgctgctgagcggcctgcagaggcccacagagggcagcgagctgcctgccagaaatgccagcctcatcctgtag

SEQ ID NO: 143025 - DNA, 876 bp, Artificial Sequence
  Description of Artificial Sequence: Synthetic coding sequence
atggccctggccgccctgatgattgccctgggcagcctgggcctgcacacctggcaggcccaggccgtgcccatcctgcccctgggcctggccccagacacctttgatgacacctacgtgggctgtgccgaggagatggaggagaaggccgcccccctgctgaaggaggagatggcccaccacgccctgctgcgggagagctgggaggccgcccaggagacctgggaggacaagagaagaggcctgaccctgcccccaggcttcaaggcccagaatggcatcgccatcatggtgtacaccaacagcagcaacaccctgtactgggagctgaaccaggccgtgaggactggaggcggcagccgggagctgtacatgaggcacttccccttcaaggccctgcacttctacctgatccgggccctgcagctgctgcggggcagcggcggctgcagccggggccctggagaggtggtgttccggggcgtgggcagcctgcgctttgagcccaagaggctgggggacagcgtgcggctgggccagtttgccagcagcagcctggacaaggctgtggcccacagatttggaaatgccaccctcttcagcctgaccacctgcttcggggcccccatccaggccttcagcgtcttccccaaggagcgggaggtgctgatcccccctcatgaggtgttcctggtgacccgcttcagccaggatggagcccagagcctggtgaccctgtggagctacaaccagacctgcagccacttcaactgtgcctacctgggcggggagaagaggcggggctgtgtgtctgcccctggggccctgggcaccggggacctgcacatgaccaagaggcacctgcagcagccctag

SEQ ID NO: 143026 - DNA, 720 bp, Artificial Sequence
  Description of Artificial Sequence: Synthetic coding sequence
atggccctggccgccctgatgattgccctgggcagcctgggcctgcacacctggcaggcccaggccgtgcccatcctgcccctgggcctggccccagacacctttgatgacacctacgtgggctgtgccgaggagatggaggagaaggccgcccccctgctgaaggaggagatggcccaccacgccctgctgcgggagagctgggaggccgcccaggagacctgggaggacaagagaagaggcctgaccctgcccccaggcttcaaggcccagaatggcatcgccatcatggtgtacaccaacagcagcaacaccctgtactgggagctgaaccaggccgtgaggactggaggcggcagccgggagctgtacatgaggcacttccccttcaaggccctgcacttctacctgatccgggccctgcagctgctgcggggcagcggcggctgcagccggggccctggagaggtggtgttccggggcgtgggcagcctgcgctttgagcccaagaggctgggggacagcgtgcggctgggccagtttgccagcagcagcctggacaaggctgtggcccacagatttggagagaagaggcggggctgtgtgtctgcccctggggtgcagctgggcagccagagcgagggcgccagcagcctgcccccctggaagaccctgctgctggcccctggagagttccagctgtctggagtgggcccctag

SEQ ID NO: 143027 - DNA, 876 bp, Artificial Sequence; identical to SEQ ID NO: 143025
  Description of Artificial Sequence: Synthetic coding sequence

SEQ ID NO: 143028 - DNA, 1401 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcagcttcttcccagacttcaagcccagcgagaccgtcttcaagatcgtgttctggctgggctacctgaacagctgcatcaaccccatcatctacccctgcagcagccaggagttcaagaaggccttccagaatgtgctgcgcatccagtgcctgtgcaggaagcagagcagcaagcacgccctgggctacaccctgcacccccccagccaggccgtggagggccagcacaaggacatggtgcgcatccctgtgggcagccgggagaccttctaccgcatcagcaagacagatggagtgtgtgagtggaagttcttcagctccatgccccggggcagcgcccgcatcaccgtgtccaaggaccagagcagctgcaccacagcccgggtgcgcagcaagagcttcctgcaggtgtgctgctgcgtgggccccagcacccccagcctggacaagaaccaccaggtgcccaccatcaaggtgcacaccatcagcctgtctgaaaatggagaggaggtgtag

SEQ ID NO: 143029 - DNA, 1368 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcagcttcttcccagacttcaagcccagcgagaccgtcttcaagatcgtgttctggctgggctacctgaacagctgcatcaaccccatcatctacccctgcagcagccaggagttcaagaaggccttccagaatgtgctgcgcatccagtgcctgtgcaggaagcagagcagcaagcacgccctgggctacaccctgcacccccccagccaggccgtggagggccagcacaaggacatggtgcgcatccctgtgggcagccgggagaccttctaccgcatcagcaagacagatggagtgtgtgagtggaagttcttcagctccatgccccggggcagcgcccgcatcaccgtgtccaaggaccagagcagctgcaccacagcccggcggggcatggactgccgctacttcaccaagaactgccgggagcacatcaagcacgtgaacttcatgatgccaccctggaggaaaggaagtgagtgctag

SEQ ID NO: 143030 - DNA, 975 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcacctacatcctgaagtatgatgtgctcttctggaggaagggcctgtctgtgtgcacccggctgcgggagaggaaggagatcaagaactag

SEQ ID NO: 143031 - DNA, 1029 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccattgatgaggagacagaggcccaggagggcaagaatgacagccccagcttcaagcagcctgtgcaccacgccgctgtgctgggcctggaggtgatggagaaggagaacctggagggcgtgtccaggaaggacacctgtggggtgtggtag

SEQ ID NO: 143032 - DNA, 1401 bp, Artificial Sequence; identical to SEQ ID NO: 143028
  Description of Artificial Sequence: Synthetic coding sequence

SEQ ID NO: 143033 - DNA, 1119 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcacccacacccatgacatgaagccagccagccggccccggctgctgagcctgctgcccaaggagggggagcacgagacccaccactggagctgtgaccccctgagcctggagagcacccctggggcccaggagccctgcctgaccctgggcttcaccagcctgagcagcatccacctgaccaaggcccagatccagcacgtgacagtgacagacaccgggaagacagtgacctag

SEQ ID NO: 143034 - DNA, 1290 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcagcttcttcccagacttcaagcccagcgagaccgtcttcaagatcgtgttctggctgggctacctgaacagctgcatcaaccccatcatctacccctgcagcagccaggagttcaagaaggccttccagaatgtgctgcgcatccagtgcctgtgcaggaagcagagcagcaagcacgccctgggctacaccctgcacccccccagccaggccgtggagggccagcacaaggacatggtgcgcatccctgtgggcagccgggagaccttctaccgcatcagcaagacagatggagtgtgtgagtggaagttcttcagctccatgccccggggcagcgcccgcatcaccgtgtccaaggaccagagcagctgcaccacagcccggggccacacccccatgacctag

SEQ ID NO: 143035 - DNA, 1428 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcagcttcttcccagacttcaagcccagcgagaccgtcttcaagatcgtgttctggctgggctacctgaacagctgcatcaaccccatcatctacccctgcagcagccaggagttcaagaaggccttccagaatgtgctgcgcatccagtgcctgtgcaggaagcagagcagcaagcacgccctgggctacaccctgcacccccccagccaggccgtggagggccagcacaaggacatggtgcgcatccctgtgggcagccgggagaccttctaccgcatcagcaagacagatggagtgtgtgagtggaagttcttcagctccatgccccggggcagcgcccgcatcaccgtgtccaaggaccagagcagctgcaccacagcccggaccaagagccgctctgtgacccggctggagtgcagcggcatgatcctggcccactgcaacctgcggctgcccggcagccgggacagccctgccagcgccagccaggccgccggcaccaccggcatgtgccaccaggctgatgccacccggcccagctag

SEQ ID NO: 143036 - DNA, 1113 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccattgatgaggtgtccctgtgccaccaggccggcgtgcagtggcatgacctgggcagcctgcagcccccacctcctggcttcaagcgcttcagctgcctgagcctgcccagctcctgggactacagagatgtgcccccaggaagaagacaccaggcccagctgatctttgtgttcctggtggagaccggcttccaccacgtgggccaggatgacctggacctgctgaccagctag

SEQ ID NO: 143037 - DNA, 1284 bp, Artificial Sequence
  Description of Artificial Sequence: Synthetic coding sequence
atggtgttcctgtctggaaatgccagtgacagcagcaactgcacccagcccccagcccctgtgaacatcagcaaggccatcctgctgggcgtcatcctgggcggcctcatcctgtttggagtgctgggcaacatcctggtgatcctgtctgtggcctgccaccgccacctgcacagcgtgacccactactacatcgtgaacctggccgtggccgacctgctgctgaccagcacagtgctgcccttcagcgccatctttgaggtgctgggctactgggccttcggccgggtcttctgcaacatctgggccgctgtggatgtgctgtgctgcacagccagcatcatgggcctgtgcatcatcagcattgaccgctacatcggcgtgtcctaccccctgcgctaccccaccatcgtgacccagaggcggggcctgatggccctgctgtgtgtgtgggccctgagcctggtgatcagcatcggccccctgtttggctggaggcagcctgccccagaagatgagaccatctgccagatcaatgaggagcccggctacgtgctcttcagcgccctgggcagcttctacctgcccctggccatcatcctggtgatgtactgccgggtgtatgtggtggccaagcgggagagccggggcctgaagagcggcctgaagacagacaagagtgacagcgagcaggtgaccctgcgcatccacaggaagaatgccccagctgggggcagcggcatggccagcgccaagaccaagacccacttctctgtgcggctgctgaagttcagccgggagaagaaggccgccaagaccctgggcatcgtggtgggctgctttgtgctgtgctggctgcccttcttcctggtgatgcccatcggcagcttcttcccagacttcaagcccagcgagaccgtcttcaagatcgtgttctggctgggctacctgaacagctgcatcaaccccatcatctacccctgcagcagccaggagttcaagaaggccttccagaatgtgctgcgcatccagtgcctgtgcaggaagcagagcagcaagcacgccctgggctacaccctgcacccccccagccaggccgtggagggccagcacaaggacatggtgcgcatccctgtgggcagccgggagaccttctaccgcatcagcaagacagatggagtgtgtgagtggaagttcttcagctccatgccccggggcagcgcccgcatcaccgtgtccaaggaccagagcagctgcaccacagcccggagcagcggcttctag

SEQ ID NO: 143038 - DNA, 1563 bp, Artificial Sequence
  Description of Artificial Sequence: Synthetic coding sequence
atgaacccagacctggacaccggccacaacaccagcgccccagcccactggggcgagctgaagaatgccaacttcaccggccccaaccagaccagcagcaacagcaccctgccccagctggacatcacccgggccatctctgtgggcctggtgctgggcgccttcatcctgtttgccatcgtgggcaacatcctggtgatcctgtctgtggcctgcaacagacacctgcggacccccaccaactacttcatcgtgaacctggccatggctgacctgctgctgtccttcaccgtgctgcccttctctgctgccctggaggtgctgggctactgggtgctgggccgcatcttctgtgacatctgggccgctgtggatgtgctgtgctgcacagccagcatcctgagcctgtgtgccatcagcattgaccgctacatcggcgtgcgctacagcctgcagtaccccaccctggtgaccaggaggaaggccatcctggccctgctgtctgtgtgggtgctgagcaccgtcatcagcatcggccccctgctgggctggaaggagcccgccccaaatgatgacaaggaatgtggggtgacagaggagcccttctacgccctcttcagcagcctgggcagcttctacatccccctggccgtcatcctggtgatgtactgccgggtgtacatcgtggccaagaggaccaccaagaacctggaggccggcgtgatgaaggagatgagcaacagcaaggagctgaccctgcgcatccacagcaagaacttccacgaggacaccctgagcagcaccaaggccaagggccacaaccccaggagcagcattgctgtgaagctgttcaagttcagccgggagaagaaggccgccaagaccctgggcatcgtggtgggcatgttcatcctgtgctggctgcccttcttcatcgccctgcccctgggcagcctcttcagcaccctgaagcccccagatgctgtgttcaaggtggtgttctggctgggctacttcaacagctgcctgaaccccatcatctacccctgcagcagcaaggagttcaagagggcctttgtgcgcatcctgggctgccagtgccggggccggggcagaagaagaagaagaagaagaagaaggctgggcggctgtgcctacacctaccggccctggacccggggcggcagcctggagaggagccagagcaggaaggacagcctggatgacagcggcagctgcctgagcggcagccagaggaccctgcccagcgccagccccagccctggctacctgggccgcggggcccctcctcctgtggagctgtgtgccttccctgagtggaaggcccctggggccctgctgagcctgcctgcccctgagcccccaggccggcggggcagacatgacagcggccccctcttcaccttcaagctgctgacagagcctgagagccctggaacagatggaggagccagcaatggaggctgtgaggccgctgctgatgtggccaacggccagcccggcttcaagagcaacatgcccctggcccctggccagttctag

SEQ ID NO: 143039 - DNA, 1719 bp, Artificial Sequence
  Description of Artificial Sequence: Synthetic coding sequence
atgaccttccgggacctgctgtctgtgtcctttgagggccccaggccagacagcagcgctgggggcagcagcgctgggggcggcggcggcagcgctgggggcgccgcccccagcgagggccctgctgtgggcggcgtgcctggaggagctgggggcggcggcggcgtggtgggcgccggcagcggggaggacaacagaagcagcgctggggagcccggcagcgctggagctggaggagatgtgaatggaacagctgctgtgggcggcctggtggtgtctgcccagggcgtgggcgtgggcgtcttcctggccgccttcatcctgatggctgtggccggcaacctgctggtgatcctgtctgtggcctgcaacagacacctgcagacagtgaccaactacttcatcgtgaacctggccgtggccgacctgctgctgagcgccaccgtgctgcccttcagcgccaccatggaggtgctgggcttctgggccttcggccgggccttctgtgatgtgtgggccgctgtggatgtgctgtgctgcacagccagcatcctgagcctgtgcaccatctctgtggacagatatgtgggcgtgcgccacagcctgaagtacccagccatcatgacagagaggaaggccgccgccatcctggccctgctgtgggtggtggccctggtggtgtctgtgggccccctgctgggctggaaggagcctgtgcccccagatgagcgcttctgtggcatcacagaggaggccggctatgctgtgttcagctctgtgtgcagcttctacctgcccatggccgtcatcgtggtgatgtactgccgggtgtatgtggtggcccggagcaccaccaggagcctggaggccggcgtgaagcgggagcggggcaaggccagcgaggtggtgctgcgcatccactgcagaggagctgccactggagcagatggagcccacggcatgaggtctgccaagggccacaccttccgcagcagcctgtctgtgcggctgctgaagttcagccgggagaagaaggccgccaagaccctggccatcgtggtgggcgtgtttgtgctgtgctggttccccttcttctttgtgctgcccctgggcagcctcttcccccagctgaagcccagcgagggcgtcttcaaggtgatcttctggctgggctacttcaacagctgtgtgaaccccctcatctacccctgcagcagccgggagttcaagagggccttcctgcggctgctgcgctgccagtgcagaagaagaagaagaagaagacccctgtggagggtgtatggccaccactggagggccagcaccagcggcctgcggcaggactgtgcccccagcagtggagatgcccctcctggggcccccctggccctgacagccctgcctgaccctgaccctgagcccccaggcaccccagagatgcaggcccctgtggccagcaggaggaagccacccagcgccttccgggagtggaggctgctgggccccttccggcggcccaccacccagctgcgggccaaggtgagcagcctgagccacaagatccgggccggcggggcccagagagctgaggccgcctgtgcccagaggtctgaggtggaggccgtgtccctgggcgtgccccatgaggtggccgagggcgccacctgccaggcctatgagctggccgactacagcaacctgcgggagacagacatctag

SEQ ID NO: 143040 - DNA, 1344 bp, Artificial Sequence
  Description of Artificial Sequence: Synthetic coding sequence
atggaccaccaggacccctacagcgtgcaggccacagctgccatcgctgctgccatcaccttcctgatcctcttcaccatctttggaaatgccctggtgatcctggccgtgctgaccagccgcagcctgcgggccccccagaacctcttcctggtgtccctggccgctgctgacatcctggtggccaccctcatcatccccttcagcctggccaatgagctgctgggctactggtacttccggaggacctggtgtgaggtgtacctggccctggatgtgctcttctgcaccagcagcatcgtgcacctgtgtgccatcagcctggaccgctactgggccgtgtcccgggccctggagtacaacagcaagaggaccccccggcgcatcaagtgcatcatcctgactgtgtggctgattgctgctgtgatcagcctgcccccactcatctacaagggggaccagggcccccagccccggggccggccccagtgcaagctgaaccaggaggcctggtacatcctggccagcagcatcggcagcttctttgccccctgcctgatcatgatcctggtgtacctgcgcatctacctgattgccaagaggagcaacagaagaggcccccgggccaagggcggccctggccagggcgagagcaagcagcccaggccagaccatggaggagccctggccagcgccaagctgcctgccctggcctctgtggccagcgcccgggaggtgaatggccacagcaagagcactggagagaaggaggagggggagaccccagaggacaccggcacccgggccctgcccccatcctgggccgccctgcccaacagcggccagggccagaaggagggcgtgtgtggggccagcccagaagatgaagctgaggaggaggaggaggaggaggaggagtgtgagccccaggccgtgcctgtgtccccagccagcgcctgcagcccccccctgcagcagccccagggcagccgggtgctggccaccctgcggggccaggtgctgctgggccggggcgtgggcgccatcggcggccagtggtggaggcggcgggcccagctgacccgggagaagcgcttcacctttgtgctggccgtggtgattggagtgtttgtgctgtgctggttccccttcttcttctcctacagcctgggcgccatctgccccaagcactgcaaggtgccccacggcctcttccagttcttcttctggattggctactgcaacagcagcctgaaccctgtgatctacaccatcttcaaccaggacttcagaagagccttccgccgcatcctgtgccggccctggacccagacagcctggtag

SEQ ID NO: 143041 - DNA, 1389 bp, Artificial Sequence
  Description of Artificial Sequence: Synthetic coding sequence
atggccagccctgccctggccgccgccctggccgtggccgctgctgctggccccaatgccagcggggccggggagcggggcagcggcggcgtggccaatgccagcggggcctcctggggccccccccggggccagtacagcgctggagctgtggccggcctggccgctgtggtgggcttcctgattgtgttcaccgtggtgggcaatgtgctggtggtgattgctgtgctgaccagccgggccctgcgggccccccagaacctcttcctggtgtccctggccagcgctgacatcctggtggccaccctggtgatgcccttcagcctggccaatgagctgatggcctactggtacttcggccaggtgtggtgtggggtgtacctggccctggatgtgctcttctgcaccagcagcatcgtgcacctgtgtgccatcagcctggaccgctactggagcgtgacccaggccgtggagtacaacctgaagaggaccccccggcgggtgaaggccaccatcgtggccgtgtggctgatctctgctgtgatctccttcccccccctggtgtccctgtaccggcagccagatggagctgcctacccccagtgtggcctgaatgatgagacctggtacatcctgagcagctgcatcggcagcttctttgccccctgcctgatcatgggcctggtgtatgcccgcatctacagagtggccaagctgcggaccaggaccctgtctgagaagagggcccctgtgggcccagatggagccagccccaccacagaaaatggcctgggcgctgctgctggggccggggagaatggccactgtgcccctcctccagcagatgtggagccagatgagagcagcgctgctgctgagaggagaagaagaagaggagccctgcggcggggcggcagaagaagagctggagctgagggcggggccggcggcgcagatggccagggcgccggccctggagctgctgagagcggggccctgacagccagccgcagccctggccctgggggccgcctgagccgggccagcagccgctctgtggagttcttcctgagcagaagaagaagagcccggagctctgtgtgcaggaggaaggtggcccaggcccgggagaagcgcttcacctttgtgctggccgtggtgatgggcgtgtttgtgctgtgctggttccccttcttcttctcctacagcctgtatggcatctgccgggaggcctgccaggtgcccggccccctcttcaagttcttcttctggattggctactgcaacagcagcctgaaccctgtgatctacaccgtcttcaaccaggacttcagaagaagcttcaagcacatcctcttcagaagaagaagaagaggcttccggcagtag

SEQ ID NO: 143042 - DNA, 2070 bp, Artificial Sequence
  Description of Artificial Sequence: Synthetic coding sequence
atggctgacctggaggccgtgctggctgatgtgtcctacctgatggccatggagaagagcaaggccaccccagctgcccgggccagcaagaagatcctgctgcctgagcccagcatccgctctgtgatgcagaagtacctggaggacagaggagaggtgacctttgagaagatcttcagccagaagctgggctacctgctcttccgggacttctgcctgaaccacctggaggaggcccggcccctggtggagttctatgaggagatcaagaagtatgagaagctggagacagaggaggagcgggtggcccggagccgggagatctttgacagctacatcatgaaggagctgctggcctgcagccaccccttcagcaagagcgccacagaacatgtgcagggccacctgggcaagaagcaggtgcccccagacctcttccagccctacatcgaggagatctgccagaacctgcggggagatgtgttccagaagttcatcgagagtgacaagttcacccgcttctgccagtggaagaatgtggagctgaacatccacctgaccatgaatgacttctctgtgcaccgcatcatcggccggggcggctttggagaggtgtatggctgcaggaaggctgacaccgggaagatgtatgccatgaagtgcctggacaagaagaggatcaagatgaagcagggcgagaccctggccctgaatgaaagaatcatgctgagcctggtgtccactggagactgccccttcatcgtgtgcatgtcctatgccttccacaccccagacaagctgtccttcatcctggacctgatgaatggaggagacctgcactaccacctgagccagcacggcgtcttcagcgaggccgacatgaggttctacgccgctgagatcatcctgggcctggagcacatgcacaacagatttgtggtgtacagagacctgaagccagccaacatcctgctggatgagcacggccacgtgcgcatcagtgacctgggcctggcctgtgacttcagcaagaagaagccccacgcctctgtgggcacccacggctacatggcccctgaggtgctgcagaagggcgtggcctatgacagcagcgctgactggttcagcctgggctgcatgctgttcaagctgctgcggggccacagccccttccggcagcacaagaccaaggacaagcatgaaattgacaggatgaccctgaccatggctgtggagctgcctgacagcttcagccctgagctgcggagcctgctggagggcctgctgcagagagatgtgaacagaaggctgggctgcctgggccgcggggcccaggaggtgaaggagagccccttcttccgcagcctggactggcagatggtgttcctgcagaagtaccccccacccctcatccccccaagaggagaggtgaatgctgctgatgcctttgatattggcagctttgatgaggaggacaccaagggcatcaagctgctggacagcgaccaggagctgtacagaaacttccccctgaccatcagcgagcgctggcagcaggaggtggccgagaccgtgtttgacaccatcaatgctgagacagaccggctggaggccaggaagaaggccaagaacaagcagctgggccatgaagaagattatgccctgggcaaggactgcatcatgcacggctacatgagcaagatgggcaaccccttcctgacccagtggcagaggcgctacttctacctgttccccaaccggctggagtggagaggagagggggaggccccccagagcctgctgaccatggaggagatccagagcgtggaggagacccagatcaaggagaggaagtgcctgctgctgaagatccggggcggcaagcagttcatcctgcagtgtgacagcgaccctgagctggtgcagtggaagaaggagctgagagatgcctaccgggaggcccagcagctggtgcagagggtgcccaagatgaagaacaagcccaggagccctgtggtggagctgagcaaggtgcccctggtgcagaggggcagcgccaacggcctgtag

SEQ ID NO: 143043 - DNA, 2067 bp, Artificial Sequence
  Description of Artificial Sequence: Synthetic coding sequence
atggctgacctggaggccgtgctggctgatgtgtcctacctgatggccatggagaagagcaaggccaccccagctgcccgggccagcaagagaattgtgctgcctgagcccagcatccgctctgtgatgcagaagtacctggccgagagaaatgagatcacctttgacaagatcttcaaccagaagattggcttcctgctcttcaaggacttctgcctgaatgagatcaatgaagctgtgccccaggtgaagttctatgaggagatcaaggagtatgagaagctggacaatgaagaagatcggctgtgccgcagccggcagatctatgatgcctacatcatgaaggagctgctgagctgcagccaccccttcagcaagcaggccgtggagcacgtgcagagccacctgagcaagaagcaggtgaccagcaccctcttccagccctacatcgaggagatctgtgagagcctgcggggggacatcttccagaagttcatggagagtgacaagttcacccgcttctgccagtggaagaatgtggagctgaacatccacctgaccatgaatgagttctctgtgcaccgcatcatcggccggggcggctttggagaggtgtatggctgcaggaaggctgacaccgggaagatgtatgccatgaagtgcctggacaagaagaggatcaagatgaagcagggcgagaccctggccctgaatgaaagaatcatgctgagcctggtgtccactggagactgccccttcatcgtgtgcatgacctacgccttccacaccccagacaagctgtgcttcatcctggacctgatgaatggaggagacctgcactaccacctgagccagcacggcgtcttcagcgagaaggagatgaggttctacgccacagagatcatcctgggcctggagcacatgcacaacagatttgtggtgtacagagacctgaagccagccaacatcctgctggatgagcacggccacgcccgcatcagtgacctgggcctggcctgtgacttcagcaagaagaagccccacgcctctgtgggcacccacggctacatggcccctgaggtgctgcagaagggcacagcctatgacagcagcgctgactggttcagcctgggctgcatgctgttcaagctgctgcggggccacagccccttccggcagcacaagaccaaggacaagcatgaaattgacaggatgaccctgactgtgaatgtggagctgcctgacaccttcagccctgagctgaagagcctgctggagggcctgctgcagagagatgtgtccaagaggctgggctgccacggcggcggcagccaggaggtgaaggagcacagcttcttcaagggcgtggactggcagcacgtgtacctgcagaagtaccccccacccctcatccccccaagaggagaggtgaatgctgctgatgcctttgatattggcagctttgatgaggaggacaccaagggcatcaagctgctggactgtgaccaggagctgtacaagaacttccccctggtgatcagcgagcgctggcagcaggaggtgacagagaccgtgtatgaggccgtgaatgctgacacagacaagattgaggccaggaagagggccaagaacaagcagctgggccatgaagaagattatgccctgggcaaggactgcatcatgcacggctacatgctgaagctgggcaaccccttcctgacccagtggcagaggcgctacttctacctgttccccaaccggctggagtggagaggagagggggagagccggcagaacctgctgaccatggagcagatcctgtctgtggaggagacccagatcaaggacaagaagtgcatcctcttccgcatcaagggcggcaagcagtttgtgctgcagtgtgagagtgaccctgagtttgtgcagtggaagaaggagctgaatgagaccttcaaggaggcccagaggctgctgcggcgggcccccaagttcctgaacaagcccaggagcggcaccgtggagctgcccaagcccagcctgtgccacaggaacagcaatggcctgtag

SEQ ID NO: 143044 - DNA, 1164 bp, Artificial Sequence
  Description of Artificial Sequence: Synthetic coding sequence
atggctgacctggaggccgtgctggctgatgtgtcctacctgatggccatggagaagagcaaggccaccccagctgcccgggccagcaagagaattgtgctgcctgagcccagcatccgctctgtgatgcagaagtacctggccgagagaaatgagatcacctttgacaagatcttcaaccagaagattggcttcctgctcttcaaggacttctgcctgaatgagatcaatgaagctgtgccccaggtgaagttctatgaggagatcaaggagtatgagaagctggacaatgaagaagatcggctgtgccgcagccggcagatctatgatgcctacatcatgaaggagctgctgagctgcagccaccccttcagcaagcaggccgtggagcacgtgcagagccacctgagcaagaagcaggtgaccagcaccctcttccagccctacatcgaggagatctgtgagagcctgcggggggacatcttccagaagttcatggagagtgacaagttcacccgcttctgccagtggaagaatgtggagctgaacatccacctgaccatgaatgagttctctgtgcaccgcatcatcggccggggcggctttggagaggtgtatggctgcaggaaggctgacaccgggaagatgtatgccatgaagtgcctggacaagaagaggatcaagatgaagcagggcgagaccctggccctgaatgaaagaatcatgctgagcctggtgtccactggagactgccccttcatcgtgtgcatgacctacgccttccacaccccagacaagctgtgcttcatcctggacctgatgaatggaggagacctgcactaccacctgagccagcacggcgtcttcagcgagaaggagatgaggttctacgccacagagatcatcctgggcctggagcacatgcacaacagatttgtggtgtacagagacctgaagccagccaacatcctgctggatgagcacggccacgcccgcatcagtgacctgggcctggcctgtgacttcagcaagaagaagccccacgcctctgtgggcacccacggctacatggcccctgaggtgctgcagaagggcacagcctatgacagcagcgctgactggttcagcctgggctgcatgctgttcaagctgctgcggggctag

SEQ ID NO: 143045 - DNA, 1434 bp, Artificial Sequence
  Description of Artificial Sequence: Synthetic coding sequence
atgggcgccggcgtgctggtgctgggcgccagcgagcccggcaacctgagcagcgctgcccccctgcctgatggagctgccacagctgcccggctgctggtgcctgccagccccccagccagcctgctgcccccagccagcgagagccctgagcccctgagccagcagtggacagctggcatgggcctgctgatggccctgattgtgctgctgattgtggccggaaatgtgctggtgattgtggccatcgccaagaccccccggctgcagaccctgaccaacctcttcatcatgagcctggccagcgctgacctggtgatgggcctgctggtggtgccctttggagccaccatcgtggtgtggggccgctgggagtatggcagcttcttctgtgagctgtggacctctgtggatgtgctgtgtgtgacagccagcattgagaccctgtgtgtgattgccctggaccgctacctggccatcaccagccccttccgctaccagagcctgctgacccgggcccgggcccggggcctggtgtgcaccgtgtgggccatcagcgccctggtgtccttcctgcccatcctgatgcactggtggagggctgagagtgatgaggcccggcgctgctacaatgaccccaagtgctgtgactttgtgaccaacagagcctatgccatcgccagctctgtggtgtccttctacgtgcccctgtgcatcatggcctttgtgtacctgcgggtcttccgggaggcccagaagcaggtgaagaagattgacagctgtgaaagacgcttcctgggcggccctgcccggccccccagccccagccccagccctgtgcctgccccagcccctcctcctggcccccccaggcctgctgctgctgctgccacagcccccctggccaacggccgggccggcaagagaagacccagccggctggtggccctgcgggagcagaaggccctgaagaccctgggcatcatcatgggcgtcttcaccctgtgctggctgcccttcttcctggccaacgtggtgaaggccttccaccgggagctggtgcctgaccggctgtttgtgttcttcaactggctgggctacgccaacagcgccttcaaccccatcatctactgccgcagcccagacttcaggaaggccttccagggcctgctgtgctgtgccaggagagctgcccggaggagacatgccacccatggagaccggccccgggccagcggctgcctggcccggcccggccccccacccagccctggggccgccagtgatgatgatgatgatgatgtggtgggcgccaccccaccagcccggctgctggagccctgggccggctgcaatggaggagctgctgctgacagcgacagcagcctggatgagccctgcaggcctggctttgccagcgagagcaaggtgtag

SEQ ID NO: 143046 - DNA, 1242 bp, Artificial Sequence
  Description of Artificial Sequence: Synthetic coding sequence
atgggccagcctggaaatggcagcgccttcctgctggccccaaatggcagccacgccccagaccatgatgtgacccaggagagagatgaggtgtgggtggtgggcatgggcatcgtgatgagcctgattgtgctggccatcgtgtttggaaatgtgctggtgatcacagccatcgccaagtttgagcggctgcagacagtgaccaactacttcatcaccagcctggcctgtgccgacctggtgatgggcctggccgtggtgccctttggagctgcccacatcctgatgaagatgtggacctttggaaacttctggtgtgagttctggaccagcattgatgtgctgtgtgtgacagccagcattgagaccctgtgtgtgattgctgtggaccgctactttgccatcaccagccccttcaagtaccagagcctgctgaccaagaacaaggcccgggtcatcatcctgatggtgtggatcgtgtctggcctgaccagcttcctgcccatccagatgcactggtaccgggccacccaccaggaggccatcaactgctacgccaatgagacctgctgtgacttcttcaccaaccaggcctatgccatcgccagcagcatcgtgtccttctacgtgcccctggtgatcatggtgtttgtgtacagcagggtcttccaggaggccaagaggcagctgcagaagattgacaagtctgagggccgcttccacgtgcagaacctgagccaggtggagcaggacggccgcacaggccacggcctgcggcgcagcagcaagttctgcctgaaggagcacaaggccctgaagaccctgggcatcatcatgggcaccttcaccctgtgctggctgcccttcttcatcgtgaacatcgtgcacgtgatccaggacaacctgatcaggaaggaggtgtacatcctgctgaactggattggctacgtgaacagcggcttcaaccccctcatctactgccgcagcccagacttccgcatcgccttccaggagctgctgtgcctgcggcgcagcagcctgaaggcctatggaaatggctacagcagcaatggaaacacaggagagcagagcggctaccacgtggagcaggagaaggagaacaagctgctgtgtgaggacctgcccggcacagaagattttgtgggccaccagggcaccgtgcccagcgacaacatcgacagccagggcaggaactgcagcaccaatgacagcctgctgtag

SEQ ID NO: 143047 - DNA, 1227 bp, Artificial Sequence
  Description of Artificial Sequence: Synthetic coding sequence
atggccccctggccccatgagaacagcagcctggccccctggccagacctgcccaccctggcccccaacacagccaacaccagcggcctgcccggggtgccctgggaggccgccctggccggggccctgctggccctggccgtgctggccaccgtgggcggcaacctgctggtgattgtggccatcgcctggaccccccggctgcagaccatgaccaacgtgtttgtgaccagcctggccgctgctgacctggtgatgggcctgctggtggtgcccccagctgccaccctggccctgaccggccactggcccctgggcgccaccggctgtgagctgtggacctctgtggatgtgctgtgtgtgacagccagcattgagaccctgtgtgccctggccgtggaccgctacctggccgtgaccaaccccctgcgctatggagccctggtgaccaagagatgtgccaggacagctgtggtgctggtgtgggtggtgtctgctgctgtgtcctttgcccccatcatgagccagtggtggagggtgggcgcagatgctgaggcccagcgctgccacagcaacccccgctgctgtgcctttgccagcaacatgccctacgtgctgctgagcagctctgtgtccttctacctgcccctgctggtgatgctgtttgtgtatgcccgggtgtttgtggtggccacccggcagctgcggctgctgcggggggagctgggccgcttccccccagaggagagccccccagcccccagccgcagcctggccccagcccctgtgggcacctgtgcccctcctgagggcgtgcctgcctgtggcagaagacctgcccggctgctgcccctgcgggagcaccgggccctgtgcaccctgggcctcatcatgggcaccttcaccctgtgctggctgcccttcttcctggccaacgtgctgcgggccctgggcggccccagcctggtgcccggccctgccttcctggccctgaactggctgggctacgccaacagcgccttcaaccccctcatctactgccgcagcccagacttccgcagcgccttccggcggctgctgtgccgctgtggccgccgcctgcccccagagccctgtgccgccgcccggcctgccctcttccccagcggcgtgcctgctgcccggagcagccctgcccagccccggctgtgccagaggctggatggagcctcctggggcgtgtcctag

SEQ ID NO: 143048 - DNA, 1044 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 143049 - DNA, 702 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcactag

SEQ ID NO: 143050 - DNA, 402 bp, Artificial Sequence
  Description of Artificial Sequence: Synthetic coding sequence
atgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcccggggaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 143051 - DNA, 366 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactggtggtggagccagaaggtggagcagtag

SEQ ID NO: 143052 - DNA, 1029 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatgtgtctgacctggagcggggggccggccgcacccggcggggcggggccaactgccgcctgtgtggccgcatccgggccggcaacagcagccctggccctggggaccccggccggcctggggacagcaggcctgcccactggggccacctggtggccaaggccgccaccccccggcggggggaggagggccccaggaagccaggcggccggggcggggcctgcaggacagagagcgtgggcggcacctag

SEQ ID NO: 143053 - DNA, 885 bp, Artificial Sequence
  Description of Artificial Sequence: Synthetic coding sequence
atgaacagaaatggcaaggagaccaagagcaactacagagtgcgggtgtaccagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagcgggcagagctgaaccagagcgaggagcctgaggccggggagagcagcactggaggcccctag

SEQ ID NO: 143054 - DNA, 1308 bp, Artificial Sequence
  Description of Artificial Sequence: Synthetic coding sequence
atgggcgctggggagcgggtgcaggccccacccagggctgaggccacagctggaagaggagctgaccgggcccggaccctggagggcagcaggatggccgccggcacagctgtgggcgcctgggtgctggtgctgagcctgtggggcgctgtggtgggcgcccagaacatcacagccagaattggagagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcccggggaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 143055 - DNA, 1215 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagcgggcagagctgaaccagagcgaggagcctgaggccggggagagcagcactggaggcccctag

SEQ ID NO: 143056 - DNA, 1044 bp, Artificial Sequence; identical to SEQ ID NO: 143048
  Description of Artificial Sequence: Synthetic coding sequence

SEQ ID NO: 143057 - DNA, 1029 bp, Artificial Sequence; identical to SEQ ID NO: 143052
  Description of Artificial Sequence: Synthetic coding sequence

SEQ ID NO: 143058 - DNA, 1029 bp, Artificial Sequence; identical to SEQ ID NO: 143052
  Description of Artificial Sequence: Synthetic coding sequence

SEQ ID NO: 143059 - DNA, 702 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcactag

SEQ ID NO: 143060 - DNA, 705 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactaccgcagcctgcggaccttcaccatcacagccagtgactggatcttccccccatctgagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggtag

SEQ ID NO: 143061 - DNA, 705 bp, Artificial Sequence; identical to SEQ ID NO: 143060
  Description of Artificial Sequence: Synthetic coding sequence

SEQ ID NO: 143062 - DNA, 702 bp, Artificial Sequence; identical to SEQ ID NO: 143049
  Description of Artificial Sequence: Synthetic coding sequence

SEQ ID NO: 143063 - DNA, 1215 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagcgggcagagctgaaccagagcgaggagcctgaggccggggagagcagcactggaggcccctag

SEQ ID NO: 143064 - DNA, 1044 bp, Artificial Sequence; identical to SEQ ID NO: 143048
  Description of Artificial Sequence: Synthetic coding sequence

SEQ ID NO: 143065 - DNA, 702 bp, Artificial Sequence; identical to SEQ ID NO: 143049
  Description of Artificial Sequence: Synthetic coding sequence

SEQ ID NO: 143066 - DNA, 1215 bp, Artificial Sequence; identical to SEQ ID NO: 143055
  Description of Artificial Sequence: Synthetic coding sequence

SEQ ID NO: 143067 - DNA, 705 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactaccgcagcctgcggaccttcaccatcacagccagtgactggatcttccccccatctgagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggtag

SEQ ID NO: 143068 - DNA, 1092 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 143069 - DNA, 1029 bp, Artificial Sequence; identical to SEQ ID NO: 143052
  Description of Artificial Sequence: Synthetic coding sequence

SEQ ID NO: 143070 - DNA, 702 bp, Artificial Sequence; identical to SEQ ID NO: 143049
  Description of Artificial Sequence: Synthetic coding sequence

SEQ ID NO: 143071 - DNA, 1029 bp, Artificial Sequence; identical to SEQ ID NO: 143052
  Description of Artificial Sequence: Synthetic coding sequence

SEQ ID NO: 143072 - DNA, 705 bp, Artificial Sequence; identical to SEQ ID NO: 143060
  Description of Artificial Sequence: Synthetic coding sequence

SEQ ID NO: 143073 - DNA, 1215 bp, Artificial Sequence; identical to SEQ ID NO: 143055
  Description of Artificial Sequence: Synthetic coding sequence

SEQ ID NO: 143074 - DNA, 1029 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatgtgtctgacctggagcggggggccggccgcacccggcggggcggggccaactgccgcctgtgtggccgcatccgggccggcaacagcagccctggccctggggaccccggccggcctggggacagcaggcctgcccactggggccacctggtggccaaggccgccaccccccggcggggggaggagggccccaggaagccaggcggccggggcggggcctgcaggacagagagcgtgggcggcacctag

SEQ ID NO: 143075 - DNA, 1044 bp, Artificial Sequence; identical to SEQ ID NO: 143048
  Description of Artificial Sequence: Synthetic coding sequence

SEQ ID NO: 143076 - DNA, 705 bp, Artificial Sequence; identical to SEQ ID NO: 143060
  Description of Artificial Sequence: Synthetic coding sequence

SEQ ID NO: 143077 - DNA, 1215 bp, Artificial Sequence; identical to SEQ ID NO: 143055
  Description of Artificial Sequence: Synthetic coding sequence

SEQ ID NO: 143078 - DNA, 1044 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 143079 - DNA, 702 bp, Artificial Sequence; identical to SEQ ID NO: 143049
  Description of Artificial Sequence: Synthetic coding sequence

SEQ ID NO: 143080 - DNA, 1044 bp, Artificial Sequence; identical to SEQ ID NO: 143048
  Description of Artificial Sequence: Synthetic coding sequence

SEQ ID NO: 143081 - DNA, 705 bp, Artificial Sequence; identical to SEQ ID NO: 143060
  Description of Artificial Sequence: Synthetic coding sequence

SEQ ID NO: 143082 - DNA, 1215 bp, Artificial Sequence; identical to SEQ ID NO: 143055
  Description of Artificial Sequence: Synthetic coding sequence

SEQ ID NO: 143083 - DNA, 387 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcttccgctgccaggccatgaacagaaatggcaaggagaccaagagcaactacagagtgcgggtgtaccagtttgagaacctgcacaactacagcctgtag

SEQ ID NO: 143084 - DNA, 462 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacggcagcctcttcctgcctgctgtgggcatccaggatgagggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 143085 - DNA, 885 bp, Artificial Sequence; identical to SEQ ID NO: 143053
  Description of Artificial Sequence: Synthetic coding sequence

SEQ ID NO: 143086 - DNA, 885 bp, Artificial Sequence; identical to SEQ ID NO: 143053
  Description of Artificial Sequence: Synthetic coding sequence

SEQ ID NO: 143087 - DNA, 366 bp, Artificial Sequence; identical to SEQ ID NO: 143051
  Description of Artificial Sequence: Synthetic coding sequence

SEQ ID NO: 143088 - DNA, 1308 bp, Artificial Sequence; identical to SEQ ID NO: 143054
  Description of Artificial Sequence: Synthetic coding sequence

SEQ ID NO: 143089 - DNA, 1092 bp, Artificial Sequence; identical to SEQ ID NO: 143068
  Description of Artificial Sequence: Synthetic coding sequence

SEQ ID NO: 143090 - DNA, 402 bp, Artificial Sequence; identical to SEQ ID NO: 143050
  Description of Artificial Sequence: Synthetic coding sequence

SEQ ID NO: 143091 - DNA, 387 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagtttgagaacctgcacaactacagcctgtag

SEQ ID NO: 143092 - DNA, 462 bp, Artificial Sequence; identical to SEQ ID NO: 143084
  Description of Artificial Sequence: Synthetic coding sequence

SEQ ID NO: 143093 - DNA, 1308 bp, Artificial Sequence; identical to SEQ ID NO: 143054
  Description of Artificial Sequence: Synthetic coding sequence

SEQ ID NO: 143094 - DNA, 366 bp, Artificial Sequence; identical to SEQ ID NO: 143051
  Description of Artificial Sequence: Synthetic coding sequence

SEQ ID NO: 143095 - DNA, 387 bp, Artificial Sequence; identical to SEQ ID NO: 143083
  Description of Artificial Sequence: Synthetic coding sequence

SEQ ID NO: 143096 - DNA, 885 bp, Artificial Sequence; identical to SEQ ID NO: 143053
  Description of Artificial Sequence: Synthetic coding sequence

SEQ ID NO: 143097 - DNA, 366 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactggtggtggagccagaaggtggagcagtag

SEQ ID NO: 143098 - DNA, 462 bp, Artificial Sequence; identical to SEQ ID NO: 143084
  Description of Artificial Sequence: Synthetic coding sequence

SEQ ID NO: 143099 - DNA, 1308 bp, Artificial Sequence; identical to SEQ ID NO: 143054
  Description of Artificial Sequence: Synthetic coding sequence

SEQ ID NO: 143100 - DNA, 366 bp, Artificial Sequence; identical to SEQ ID NO: 143051
  Description of Artificial Sequence: Synthetic coding sequence

SEQ ID NO: 143101 - DNA, 402 bp, Artificial Sequence; identical to SEQ ID NO: 143050
  Description of Artificial Sequence: Synthetic coding sequence

SEQ ID NO: 143102 - DNA, 885 bp, Artificial Sequence; identical to SEQ ID NO: 143053
  Description of Artificial Sequence: Synthetic coding sequence

SEQ ID NO: 143103 - DNA, 402 bp, Artificial Sequence; identical to SEQ ID NO: 143050
  Description of Artificial Sequence: Synthetic coding sequence

SEQ ID NO: 143104 - DNA, 1092 bp, Artificial Sequence; identical to SEQ ID NO: 143068
  Description of Artificial Sequence: Synthetic coding sequence

SEQ ID NO: 143105 - DNA, 1308 bp, Artificial Sequence
  Description of Artificial Sequence: Synthetic coding sequence
atgggcgctggggagcgggtgcaggccccacccagggctgaggccacagctggaagaggagctgaccgggcccggaccctggagggcagcaggatggccgccggcacagctgtgggcgcctgggtgctggtgctgagcctgtggggcgctgtggtgggcgcccagaacatcacagccagaattggagagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagaaattgtggacagcgccagcgagctgacagctggggtgcccaacaaggtgggcacctgtgtgtctgagggcagctacccagctggcaccctgtcctggcacctggatggcaagcccctggtgcccaatgagaagggcgtgtctgtgaaggagcagaccaggaggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcccggggaggagggccccacagctggctctgtgggcggcagcggcctgggcaccctggccctggccctgggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 143106 - DNA, 387 bp, Artificial Sequence; identical to SEQ ID NO: 143083
  Description of Artificial Sequence: Synthetic coding sequence

SEQ ID NO: 143107 - DNA, 462 bp, Artificial Sequence; identical to SEQ ID NO: 143084
  Description of Artificial Sequence: Synthetic coding sequence

SEQ ID NO: 143108 - DNA, 1092 bp, Artificial Sequence; identical to SEQ ID NO: 143068
  Description of Artificial Sequence: Synthetic coding sequence

SEQ ID NO: 143109 - DNA, 366 bp, Artificial Sequence; identical to SEQ ID NO: 143051
  Description of Artificial Sequence: Synthetic coding sequence

SEQ ID NO: 143110 - DNA, 402 bp, Artificial Sequence; identical to SEQ ID NO: 143050
  Description of Artificial Sequence: Synthetic coding sequence

SEQ ID NO: 143111 - DNA, 387 bp, Artificial Sequence; identical to SEQ ID NO: 143083
  Description of Artificial Sequence: Synthetic coding sequence

SEQ ID NO: 143112 - DNA, 1092 bp, Artificial Sequence; identical to SEQ ID NO: 143068
  Description of Artificial Sequence: Synthetic coding sequence

SEQ ID NO: 143113 - DNA, 1308 bp, Artificial Sequence; identical to SEQ ID NO: 143054
  Description of Artificial Sequence: Synthetic coding sequence

SEQ ID NO: 143114 - DNA, 462 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcctgggcggcctgggcacagctgccctgctgattggagtcatcctgtggcagaggcggcagaggagaggagaggagaggaaggcccctgagaaccaggaggaggaggaggagagagctgagctgaaccagagcgaggagcctgaggccggggagagcagcactggaggcccctag

SEQ ID NO: 143115 - DNA, 402 bp, Artificial Sequence; identical to SEQ ID NO: 143050
  Description of Artificial Sequence: Synthetic coding sequence

SEQ ID NO: 143116 - DNA, 885 bp, Artificial Sequence; identical to SEQ ID NO: 143053
  Description of Artificial Sequence: Synthetic coding sequence

SEQ ID NO: 143117 - DNA, 1092 bp, Artificial Sequence
  Description of Artificial Sequence: Synthetic coding sequence
atggctgctggaacagctgtgggcgcctgggtgctggtgctgagcctgtggggcgctgtggtgggcgcccagaacatcacagcccgcatcggggagcccctggtgctgaagtgcaagggggcccccaagaagccaccccagaggctggagtggaagctgaacacaggccgcacagaggcctggaaggtgctgagcccccagggcggcggcccctgggacagcgtggcccgggtgctgcccaacagcagcctcttcctgcctgctgtgggcatccaggatgagggcatcttccgctgccaggccatgaacagaaatggcaaggagaccaagagcaactacagagtgcgggtgtaccagatccctgggaagccagagatcgtggacagcgccagcgagctgacagctggggtgcccaacaaggtggtggaggagagccgccgcagcaggaagaggccctgtgagcaggaggtgggcacctgtgtgtctgagggcagctacccagctggcaccctgtcctggcacctggatggcaagcccctggtgcccaatgaaaaaggagtgtctgtgaaggagcagacccggcggcaccctgagaccggcctcttcaccctgcagagcgagctgatggtgaccccagcccggggcggggacccccggcccaccttcagctgcagcttcagccctggcctgcccaggcaccgggccctgaggacagcccccatccagccccgggtgtgggagcctgtgcccctggaggaggtgcagctggtggtggagcctgagggcggcgctgtggcccctgggggcaccgtgaccctgacctgtgaggtgcctgcccagcccagcccccagatccactggatgaaggatggagtgcccctgcccctgccccccagccctgtgctgatcctgcctgagatcggcccccaggaccagggcacctacagctgtgtggccacccacagcagccacggcccccaggagagcagagctgtgtccatcagcatcatcgagcctggagaggagggccccacagctggggagggctttgacaaggtgcgggaggccgaggacagcccccagcacatgtag

SEQ ID NO: 143118 - DNA, 462 bp, Artificial Sequence; identical to SEQ ID NO: 143084
  Description of Artificial Sequence: Synthetic coding sequence

SEQ ID NO: 143119 - DNA, 387 bp, Artificial Sequence; identical to SEQ ID NO: 143083
  Description of Artificial Sequence: Synthetic coding sequence

SEQ ID NO: 143120 - DNA, 2460 bp, Artificial Sequence
  Description of Artificial Sequence: Synthetic coding sequence
atgcccctgaccagcgccttccgggctgtggacaatgaccccggcatcatcgtgtggagaattgagaagatggagctggccctggtgcctgtgtctgcccacggcaacttctatgaaggagactgctacgtgatcctgagcaccaggagagtggccagcctgctgagccaggacatccacttctggattggcaaggacagcagccaggatgagcagagctgtgccgccatctacaccacccagctggatgactacctgggcggcagccctgtgcagcaccgggaggtgcagtaccatgaaagtgacaccttccggggctacttcaagcagggcatcatctacaagcagggcggcgtggccagcggcatgaagcacgtggagaccaacacctatgatgtgaagaggctgctgcacgtgaagggcaagaggaacatccgggccacagaggtggagatgtcctgggacagcttcaacagaggagatgtgttcctgctggacctgggcaaggtgatcatccagtggaatggacctgagagcaacagcggggagcggctgaaggccatgctgctggccaaggacatccgggaccgggagcggggcggccgggccaagattggagtcatcgagggggacaaggaggccgccagccctgagctgatgaaggtgctgcaggacaccctgggcagaagaagcatcatcaagcccaccgtgcctgatgagatcatcgaccagaagcagaagagcaccatcatgctgtaccacatcagtgacagcgctggccagctggccgtgacagaggtggccacccggcccctggtgcaggacctgctgaaccatgatgactgctacatcctggaccagagcggcaccaagatctacgtgtggaagggcaagggggccaccaaggccgagaagcaggccgccatgagcaaggccctgggcttcatcaagatgaagagctaccccagcagcaccaacgtggagaccgtgaatgatggagctgagagcgccatgttcaagcagctgttccagaagtggagcgtgaaggaccagaccatgggcctgggcaagaccttcagcatcggcaagatcgccaaggtgttccaggacaagtttgatgtgaccctgctgcacaccaagccagaggtggccgcccaggagaggatggtggatgatggaaatggcaaggtggaggtgtggagaattgagaacctggagctggtgcctgtggagtaccagtggtacggcttcttctatggaggagactgctacctggtgctgtacacctatgaggtgaatggcaagccccaccacatcctgtacatctggcagggcagacatgccagccaggatgagctggccgccagcgcctaccaggccgtggaggtggaccggcagtttgatggagctgctgtgcaggtgcgggtgaggatgggcacagagcccaggcacttcatggccatcttcaagggcaagctggtgatctttgagggcggcaccagcaggaaaggaaatgctgagccagacccccctgtgcggctcttccagatccacggcaatgacaagagcaacaccaaggctgtggaggtgcctgcctttgccagcagcctgaacagcaatgatgtgttcctgctgcggacccaggccgagcactacctgtggtacggcaagggcagcagtggagatgagcgggccatggccaaggagctggccagcctgctgtgtgatggctctgaaaatacagtggccgagggccaggagcctgctgagttctgggacctgctgggcggcaagaccccctatgccaatgacaagaggctgcagcaggagatcctggatgtgcagagccggctgtttgagtgcagcaacaagacaggccagtttgtggtgacagagatcacagacttcacccaggatgacctgaaccccacagatgtgatgctgctggacacctgggaccaggtgttcctgtggattggagctgaggccaatgccacagagaaggagagcgccctggccacagcccagcagtacctgcacacccaccccagcggccgggaccctgacacccccatcctgatcatcaagcagggctttgagccccccatcttcaccggctggttcctggcctgggaccccaacatctggagcgctgggaagacctatgagcagctgaaggaggagctgggagatgctgctgccatcatgaggatcacagctgacatgaagaatgccaccctgagcctgaacagcaatgacagcgagcccaagtactaccccatcgctgtgctgctgaagaaccagaaccaggagctgcctgaagatgtgaacccagccaagaaggagaactacctgtctgagcaggactttgtgtctgtgtttggcatcacccggggccagtttgctgccctgcccggctggaagcagctgcagatgaagaaggagaagggcctcttctag

SEQ ID NO: 143121 - DNA, 2439 bp, Artificial Sequence
  Description of Artificial Sequence: Synthetic coding sequence
atgagcagcacaggccaccctggcagctacaagatctggggcgagaagatggagctggccctggtgcctgtgtctgcccacggcaacttctatgaaggagactgctacgtgatcctgagcacccggcgggtggccagcctgctgagccaggacatccacttctggattggcaaggacagcagccaggatgagcagagctgtgccgccatctacaccacccagctggatgactacctgggcggcagccctgtgcagcaccgggaggtgcagtaccacgagagtgacaccttccggggctacttcaagcagggcatcatctacaagcagggcggcgtggccagcggcatgaagcacgtggagaccaacacctatgatgtgaagaggctgctgcacgtgaagggcaagaggaacatccgggccacagaggtggagatgtcctgggacagcttcaacagaggagatgtgttcctgctggacctgggcaaggtgatcatccagtggaatggacctgagagcaacagcggggagcggctgaaggccatgctgctggccaaggacatccgggaccgggagcggggcggccgggccaagattggagtgattgaaggagacaaggaggccgccagccctgagctgatgaaggtgctgcaggacaccctgggccgccgcagcatcatcaagcccaccgtgcctgatgagatcatcgaccagaagcagaagagcaccatcatgctgtaccacatcagtgacagcgctggccagctggccgtgacagaggtggccacccggcccctggtgcaggacctgctgaaccatgatgactgctacatcctggaccagagcggcaccaagatctacgtgtggaagggcaaaggagccaccaaggccgagaagcaggccgccatgagcaaggccctgggcttcatcaagatgaagagctaccccagcagcaccaacgtggagaccgtgaatgatggagctgagagcgccatgttcaagcagctgttccagaagtggagcgtgaaggaccagaccatgggcctgggcaagaccttcagcatcggcaagatcgccaaggtgttccaggacaagtttgatgtgaccctgctgcacaccaagccagaggtggccgcccaggagaggatggtggatgatggaaatggcaaggtggaggtgtggagaattgagaacctggagctggtgcctgtggagtaccagtggtacggcttcttctacggcggggactgctacctggtgctgtacacctatgaggtgaatggcaagccccaccacatcctgtacatctggcagggcagacatgccagccaggatgagctggccgccagcgcctaccaggccgtggaggtggaccggcagtttgatggagctgctgtgcaggtgcgggtgaggatgggcacagagcccaggcacttcatggccatcttcaagggcaagctggtgatctttgaaggaggcaccagcaggaaaggaaatgctgagccagacccccctgtgcggctcttccagatccatggaaatgacaagagcaacaccaaggctgtggaggtgcctgcctttgccagcagcctgaacagcaatgatgtgttcctgctgcggacccaggccgagcactacctgtggtacggcaagggcagcagtggagatgagcgggccatggccaaggagctggccagcctgctgtgtgatggcagcgagaacacagtggccgagggccaggagcctgctgagttctgggacctgctgggcggcaagaccccctatgccaatgacaagaggctgcagcaggagatcctggatgtgcagagccggctgtttgaatgtagcaacaagacaggccagtttgtggtgacagagatcacagacttcacccaggatgacctgaaccccacagatgtgatgctgctggacacctgggaccaggtgttcctgtggattggagctgaggccaatgccacagagaaggagagcgccctggccacagcccagcagtacctgcacacccaccccagcggccgggaccctgacacccccatcctgatcatcaagcagggctttgagccccccatcttcaccggctggttcctggcctgggaccccaacatctggagcgctgggaagacctatgagcagctgaaggaggagctgggagatgctgctgccatcatgaggatcacagctgacatgaagaatgccaccctgagcctgaacagcaatgattctgagcccaagtactaccccatcgctgtgctgctgaagaaccagaaccaggagctgcctgaagatgtgaacccagccaagaaggagaactacctgtctgagcaggactttgtgtctgtgtttggcatcacccggggccagtttgctgccctgcccggctggaagcagctgcagatgaagaaggagaagggcctcttctag

SEQ ID NO: 143122 - DNA, 474 bp, Artificial Sequence
  Description of Artificial Sequence: Synthetic coding sequence
atgcccctgaccagcgccttccgggctgtggacaatgaccccggcatcatcgtgtggagaattgagaagatggagctggccctggtgcctgtgtctgcccacggcaacttctatgaaggagactgctacgtgatcctgagcaccaggagagtggccagcctgctgagccaggacatccacttctggattggcaaggacagcagccaggatgagcagagctgtgccgccatctacaccacccagctggatgactacctgggcggcagccctgtgcagcaccgggaggtgcagtaccatgaaagtgacaccttccggggctacttcaagcagggcatcatctacaagcagggcggcgtggccagcggcatgaagcacgtggagaccaacacctatgatgtgaagaggctgctgcacgtgaagggcaagaggaacatccgggccacagaggtggagatgtcctgggacagcttctag

SEQ ID NO: 143123 - DNA, 2859 bp, Artificial Sequence
  Description of Artificial Sequence: Synthetic coding sequence
atgaagttcaagagaagacaccaggccttccccagcttcttcaagatgaaggtgtccctgcccagcgaccccagctgtgtggaggagatcctgcgggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagacagcgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcatcgagacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcacgccgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagcagaagagccaacagaaggaaggaggagaagctgtttcctccacccctgagccccctgcctgaagatcctccaagaagaagaaatgtgtctggcaacaacggccccttcggccaggacaagaacatcgccatgacaggccagatcaccagcaccaagcccaagaggacagagggcaagttctgtgccaccttcaagggcatctctgtgaatgaaggagacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgcggcggcccaagctgacctttgatgattctgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaatggacctgtgaccatcccccagaggatccaccacatggccgccagccacgtgaacatcaccagcaatgtgctgcggggctatgagcactgggacatggctgacaagctgacccgggagaacaaggagttctttggagacctggacaccctgatgggccccctgacccagcacagctccatgaccaacctggtgcgctacgtgcggcagggcctgtgctggctgagaattgatgcccacctgctgtag

SEQ ID NO: 143124 - DNA, 3837 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaagaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagacagcgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcatcgagacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcacgccgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagcagaagagccaacagaaggaaggaggagaagctgtttcctccacccctgagccccctgcctgaagatcctccaagaagaagaaatgtgtctggcaacaacggccccttcggccaggacaagaacatcgccatgacaggccagatcaccagcaccaagcccaagaggacagagggcaagttctgtgccaccttcaagggcatctctgtgaatgaaggagacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgcggcggcccaagctgacctttgatgattctgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaatggacctgtgaccatcccccagaggatccaccacatggccgccagccacgtgaacatcaccagcaatgtgctgcggggctatgagcactgggacatggctgacaagctgacccgggagaacaaggagttctttggagacctggacaccctgatgggccccctgacccagcacagctccatgaccaacctggtgcgctacgtgcggcagggcctgtgctggctgagaattgatgcccacctgctgtag

SEQ ID NO: 143125 - DNA, 3831 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaagaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagacagcgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcatcgagacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcacgccgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagcagaagagccaacagaaggaaggaggagaagctgtttcctccacccctgagccccctgcctgaagatcctccaagaagaagaaatgtgtctggcaacaacggccccttcggccaggacaagaacatcgccatgacaggccagatcaccagcaccaagcccaagaggacagagggcaagttctgtgccaccttcaagggcatcagcgagggggacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgcggcggcccaagctgacctttgatgattctgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaatggacctgtgaccatcccccagaggatccaccacatggccgccagccacgtgaacatcaccagcaatgtgctgcggggctatgagcactgggacatggctgacaagctgacccgggagaacaaggagttctttggagacctggacaccctgatgggccccctgacccagcacagctccatgaccaacctggtgcgctacgtgcggcagggcctgtgctggctgagaattgatgcccacctgctgtag

SEQ ID NO: 143126 - DNA, 1284 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaagaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagagccagcacctgaccccaggcttcaccctgcagaagtggaatgaccccaccacccgggccagcaccaagatgctggaggatgacctgaagctgagcagtgatgaagatgacctggagcctgtgaagaccctgaccacccagtgcacagccacagagctgtaccaggccgtggagaaggccaagcccaggaacaaccctgtgaagtag

SEQ ID NO: 143127 - DNA, 3936 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaaggtggccgagtacaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagatgacccacagctggcccacccccctgacctccatgcacacagctggccacagcgagcagagcaccttcagcatccctggccaggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagattctgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcattgaaacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcatgctgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagccggcgggccaacagaaggaaggaggagaagctgttccccccacccctgagccccctgcctgaggacccccccaggagaagaaatgtgtctggcaacaacggccccttcggccaggacaagaacatcgccatgacaggccagatcaccagcaccaagcccaagaggacagagggcaagttctgtgccaccttcaagggcatctctgtgaatgaaggagacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgagaagacccaagctgacctttgatgacagcgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaacggccctgtgaccatcccccagaggatccaccacatggccgccagccacgtgaacatcaccagcaatgtgctgcggggctatgagcactgggacatggctgacaagctgacccgggagaacaaggagttcttcggggacctggacaccctgatgggccccctgacccagcacagctccatgaccaacctggtgcgctacgtgcggcagggcctgtgctggctgagaattgatgcccacctgctgtag

SEQ ID NO: 143128 - DNA, 1410 bp, Artificial Sequence
  Description of Artificial Sequence: Synthetic coding sequence
atgtctgccctgaccccacccacagacatgcccacccccaccacagacaagatcacccaggccgccatggagaccatctacctgtgcaagttccgggtgtccatggatggagagtggctgtgcctgcgggagctggatgacatcagcctgaccccagaccctgagcccacccatgaggaccccaactacctgatggccaatgaaagaatgaacctgatgaacatggccaagctgagcatcaagggcctcatcgagagcgccctgaacctgggccgcaccctggacagcgactatgcccccctgcagcagttctttgtggtgatggagcactgcctgaagcacggcctgaaggccaagaagaccttcctgggccagaacaagagcttctggggccccctggagctggtggagaagctggtgcctgaggccgctgagatcacagcctctgtgaaggacctgcccggcctgaagacccctgtgggccggggccgggcctggctgcggctggccctgatgcagaagaagctgtctgagtacatgaaggccctgatcaacaagaaggagctgctgtctgagttctatgagcccaatgccctgatgatggaggaggagggcgccatcatcgccggcctgctggtgggcctgaatgtgattgatgccaacttctgcatgaagggggaggacctggacagccaggtgggcgtcatcgacttctccatgtacctgaaggatggcaacagcagcaaaggaacagaaggagatggccagatcacagccatcctggaccagaagaactacgtggaggagctgaacagacacctgaatgccaccgtgaacaacctgcaggccaaggtggatgccctggagaagagcaacaccaagctgacagaggagctggccgtggccaacaaccgcatcatcaccctgcaggaggagatggagcgggtgaaggaggagagcagctacatcctggagagcaacaggaagggccccaagcaggacagaacagctgagggccaggccctgtctgaggccaggaagcacctgaaggaggagacccagctgcggctggatgtggagaaggagctggagatgcagatctccatgaggcaggagatggagctggccatgaagatgctggagaaggatgtgtgtgagaagcaggatgccctggtgtccctgcggcagcagctggatgacctgcgggccctgaagcatgagctggccttcaagctgcagagcagtgacctgggcgtgaagcagaagtctgagctgaacagccggctggaggagaagaccaaccagatggccgccaccatcaagcagctggagcagagcgagaaggacctggtgaagcaggccaagaccctgaacagcgctgccaacaagctgatccccaagcaccactag

SEQ ID NO: 143129 - DNA, 2394 bp, Artificial Sequence
  Description of Artificial Sequence: Synthetic coding sequence
atggcccaccgctgcctgcggctgtggggccggggcggctgctggccccggggcctgcagcagctgctggtgcctggaggagtgggccctggagagcagccctgcctgcggaccctgtacagatttgtgaccacccaggcccgggccagcaggaacagcctgctgacagacatcatcgccgcctaccagcgcttctgcagcaggcctcccaagggctttgagaagtacttccccaacgggaagaatggcaagaaggccagcgagcccaaggaggtgatgggagagaagaaggagagcaagccagctgccaccaccaggagcagcggcggcggcggcggcggcggcggcaagagaggaggcaagaaggatgacagccactggtggagccgcttccagaagggggacatcccctgggatgacaaggacttcaggatgttcttcctgtggacagccctcttctggggcggcgtgatgttctacctgctgctgaagaggagcggccgggagatcacctggaaggactttgtgaacaactacctgagcaagggcgtggtggaccggctggaggtggtgaacaagagatttgtgcgggtgaccttcacccctgggaagacccctgtggatggccagtatgtgtggttcaacatcggctctgtggacacctttgagaggaacctggagaccctgcagcaggagctgggcattgaaggagagaacagagtgcctgtggtgtacatcgccgagagtgatggcagcttcctgctgtccatgctgcccaccgtgctgatcatcgccttcctgctgtacaccatccggcggggccctgctggcatcggccgcacaggccggggcatgggcggcctcttctctgtgggggagaccacagccaaggtgctgaaggatgaaattgatgtgaagttcaaggatgtggccggctgtgaggaggccaagctggagatcatggagtttgtgaacttcctgaagaaccccaagcagtaccaggacctgggcgccaagatccccaagggggccatcctgactggacctcctggcaccgggaagaccctgctggccaaggccacagctggggaggccaacgtgcccttcatcaccgtgtctggcagcgagttcctggagatgtttgtgggcgtgggccctgcccgggtgcgggacctgtttgccctggccaggaagaatgccccctgcatcctcttcattgatgaaattgatgctgtgggcaggaagaggggccggggcaactttggaggccagagcgagcaggagaacaccctgaaccagctgctggtggagatggatggcttcaacaccaccaccaacgtggtgatcctggccggcaccaacagaccagacatcctggaccctgccctgctgcggcccggccgctttgaccggcagatcttcatcggccccccagacatcaagggccgggccagcatcttcaaggtgcacctgcggcccctgaagctggacagcaccctggagaaggacaagctggccaggaagctggccagcctgaccccaggcttctctggagcagatgtggccaacgtgtgcaatgaggccgccctgattgctgcccggcacctgagtgacagcatcaaccagaagcactttgagcaggccatcgagcgggtgattggaggcctggagaagaagacccaggtgctgcagcctgaggagaagaagacagtggcctaccacgaggccggccatgctgtggccggctggtacctggagcacgccgaccccctgctgaaggtgtccatcatcccccggggcaagggcctgggctacgcccagtacctgcccaaggagcagtacctgtacaccaaggagcagctgctggacaggatgtgcatgaccctgggcggccgggtgtctgaggagatcttcttcggccgcatcaccaccggggcccaggatgacctgaggaaggtgacccagagcgcctatgcccagatcgtgcagtttggcatgaatgagaaggtgggccagatcagctttgacctgccccggcagggcgacatggtgctggagaagccctacagcgaggccacagcccggctgattgatgatgaggtgcgcatcctgatcaatgatgcctacaagaggacagtggccctgctgacagagaagaaggcagatgtggagaaggtggccctgctgctgctggagaaggaggtgctggacaagaatgacatggtggagctgctgggcccccggccctttgctgagaagagcacctatgaggagtttgtggagggcaccggcagcctggatgaggacaccagcctgcctgagggcctgaaggactggaacaaggagcgggagaaggagaaggaggagcccccaggagagaaggtggccaactag

SEQ ID NO: 143130 - DNA, 2439 bp, Artificial Sequence
  Description of Artificial Sequence: Synthetic coding sequence
ggggccggcggcagaagaagaagagtggagagcctgggcagctctgtgtccagaagaagagccagcctgcccggcggcctgagccccagccgggcccgcttccccaggcctcctgtggtggcctgcccccggctgcgggagcagccctgcctgcggaccctgtacagatttgtgaccacccaggcccgggccagcaggaacagcctgctgacagacatcatcgccgcctaccagcgcttctgcagccggccccccaagggctttgagaagtacttccccaacgggaagaatggcaagaaggccagcgagcccaaggaggtgatgggagagaagaaggagagcaagccagctgccaccaccaggagcagcggcggcggcggcggcggcggcggcaagaggggcggcaagaaggatgacagccactggtggagccgcttccagaagggggacatcccctgggatgacaaggacttcaggatgttcttcctgtggacagccctcttctggggcggcgtgatgttctacctgctgctgaagaggagcggccgggagatcacctggaaggactttgtgaacaactacctgagcaaaggagtggtggaccggctggaggtggtgaacaagagatttgtgcgggtgaccttcaccccaggcaagacccctgtggatggccagtatgtgtggttcaacatcggctctgtggacacctttgaaagaaacctggagaccctgcagcaggagctgggcatcgagggagaaaatagagtgcctgtggtgtacatcgccgagagtgatggcagcttcctgctgtccatgctgcccaccgtgctgatcatcgccttcctgctgtacaccatcagaagaggccctgctggcattggaagaacaggccggggcatgggcggcctcttctctgtgggggagaccacagccaaggtgctgaaggatgaaattgatgtgaagttcaaggatgtggccggctgtgaggaggccaagctggagatcatggagtttgtgaacttcctgaagaaccccaagcagtaccaggacctgggcgccaagatccccaagggggccatcctgaccggccccccaggcaccgggaagaccctgctggccaaggccacagctggggaggccaacgtgcccttcatcaccgtgtctggcagcgagttcctggagatgtttgtgggcgtgggccctgcccgggtgcgggacctgtttgccctggccaggaagaatgccccctgcatcctcttcattgatgaaattgatgctgtgggcaggaagaggggccggggcaactttggaggccagagcgagcaggagaacaccctgaaccagctgctggtggagatggatggcttcaacaccaccaccaacgtggtgatcctggccggcaccaacagaccagacatcctggaccctgccctgctgcggcccggccgctttgaccggcagatcttcatcggccccccagacatcaagggccgggccagcatcttcaaggtgcacctgcggcccctgaagctggacagcaccctggagaaggacaagctggccaggaagctggccagcctgaccccaggcttcagcggggctgatgtggccaacgtgtgcaatgaagctgccctgattgctgcccggcacctgagtgacagcatcaaccagaagcactttgagcaggccatcgagagggtcatcggcggcctggagaagaagacccaggtgctgcagcctgaggagaagaagacagtggcctaccatgaagctggccatgctgtggccggctggtacctggagcacgccgaccccctgctgaaggtgtccatcatcccccggggcaagggcctgggctacgcccagtacctgcccaaggagcagtacctgtacaccaaggagcagctgctggacaggatgtgcatgaccctgggcggccgggtgtctgaggagatcttcttcggccgcatcaccactggagcccaggatgacctgaggaaggtgacccagagcgcctatgcccagatcgtgcagtttggcatgaatgagaaggtgggccagatcagctttgacctgccccggcagggcgacatggtgctggagaagccctacagcgaggccacagcccggctgattgatgatgaggtgcgcatcctgatcaatgatgcctacaagaggacagtggccctgctgacagagaagaaggcagatgtggagaaggtggccctgctgctgctggagaaggaggtgctggacaagaatgacatggtggagctgctgggcccccggccctttgctgagaagagcacctatgaggagtttgtggagggcaccggcagcctggatgaggacaccagcctgcctgagggcctgaaggactggaacaaggagcgggagaaggagaaggaggagcccccaggagagaaggtggccaactag

SEQ ID NO: 143131 - DNA, 7251 bp, Artificial Sequence
  Description of Artificial Sequence: Synthetic coding sequence
atgaccaccctgctgtgggtgtttgtgaccctgcgggtcatcacagctgctgtgacagtggagaccagtgaccatgacaacagcctgtctgtgtccatcccccagcccagccccctgcgggtgctgctgggcaccagcctgaccatcccctgctacttcatcgaccccatgcaccctgtgaccacagcccccagcacagcccccctggccccccgcatcaagtggagccgggtgtccaaggagaaggaggtggtgctgctggtggccacagagggccgggtgcgggtgaacagcgcctaccaggacaaggtgtccctgcccaactacccagccatccccagtgatgccaccctggaggtgcagagcctgcggagcaatgacagcggcgtgtaccgctgtgaggtgatgcatggaattgaggacagcgaggccaccctggaggtggtggtgaagggcatcgtgttccactaccgggccatcagcacccgctacaccctggactttgaccgggcccagagggcctgcctgcagaacagcgccatcatcgccaccccagagcagctgcaggccgcctatgaagatggcttccaccagtgtgatgctggctggctggccgaccagacagtgcgctaccccatccacaccccccgggagggctgctatggagacaaggatgagttccctggggtgaggacctacggcatccgggacaccaatgagacctatgatgtgtactgctttgctgaggagatggagggggaggtgttctacgccaccagccctgagaagttcaccttccaggaggccgccaatgaatgtcggcggctgggcgcccggctggccaccaccggccagctgtacctggcctggcaggccggcatggacatgtgcagcgctggctggctggccgacagatctgtgcgctaccccatcagcaaggcccggcccaactgtggcggcaacctgctgggcgtgaggacagtgtatgtgcacgccaaccagacaggctacccagaccccagcagccgctatgatgccatctgctacaccggggaggactttgtggacatccctgagaacttcttcggcgtgggcggggaggaggacatcaccgtgcagacagtgacctggccagacatggagctgcccctgcccaggaacatcacagaaggagaggcccggggcagcgtcatcctgactgtgaagcccatctttgaggtgagccccagccccctggagcctgaggagcccttcacctttgcccctgagatcggggccacagcctttgctgaggtggagaatgagaccggggaggccacccggccctggggcttccccaccccaggcctgggccctgccacagccttcaccagcgaggacctggtggtgcaggtgacagctgtgcccggccagccccacctgcctggaggagtggtgttccactaccggcccggccccacccgctacagcctgacctttgaggaggcccagcaggcctgcctgaggactggagctgtgattgccagccctgagcagctgcaggccgcctatgaagctggctatgagcagtgtgatgctggctggctgcgggaccagacagtgcgctaccccatcgtgagccccaggaccccctgtgtgggggacaaggacagcagccctggggtgaggacctacggcgtgcggcccagcacagagacctatgatgtgtactgctttgtggaccggctggagggggaggtgttctttgccacccggctggagcagttcaccttccaggaggccctggagttctgtgagagccacaatgccaccctggccaccaccggccagctgtatgctgcctggagccggggcctggacaagtgctacgccggctggctggctgatggcagcctgcgctaccccatcgtgacccccaggcctgcctgtggcggggacaagccaggagtgaggacagtgtacctgtaccccaaccagacaggcctgcctgaccccctgagccgccaccacgccttctgcttccggggcatctctgctgtgcccagccctggagaggaggagggcggcacccccaccagccccagcggcgtggaggagtggatcgtgacccaggtggtgcctggggtggccgctgtgcctgtggaggaggagaccacagctgtgcccagcggggagaccacagccatcctggagttcaccacagagcctgagaaccagacagagtgggagcccgcctacacccctgtgggcaccagccccctgcccggcatcctgcccacctggccacccaccggggccgccacagaggagagcacagagggccccagcgccacagaggtgcccagcgccagcgaggagcccagccccagcgaggtgcccttccccagcgaggagcccagccccagcgaggagcccttccccagcgtgcggcccttccccagcgtggagctgttccccagcgaggagcccttccccagcaaggagcccagccccagcgaggagcccagcgccagcgaggagccctacacccccagcccccctgtgcccagctggacagagctgcccagcagtggagaggagagcggggccccagatgtgtctggggacttcaccggcagcggagatgtgtctggccacctggacttcagcggccagctgagcggggaccgggccagcggcctgcccagcggggacctggacagcagcggcctgaccagcacagtgggcagcggcctgcctgtggagagcggcctgcccagcggagatgaggagcgcatcgagtggcccagcacccccaccgtgggggagctgcccagcggggctgagatcctggagggcagcgccagcggcgtgggggacctgagcggcctgcccagcggggaggtgctggagaccagcgccagcggcgtgggggacctgagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagaccacagcccctggggtggaggagatcagcggcctgcccagcggggaggtgctggagaccacagcccctggggtggatgagatcagcggcctgcccagcggggaggtgctggagaccacagcccctggggtggaggagatcagcggcctgcccagcggggaggtgctggagaccagcaccagcgctgtgggggacctgagcggcctgcccagcggcggggaggtgctggagatctctgtgtctggagtggaggacatcagcggcctgcccagcggggaggtggtggagaccagcgccagcggcattgaagatgtgtctgagctgcccagcggggagggcctggagaccagcgccagcggcgtggaggacctgagccggctgcccagcggggaggaggtgctggagatcagcgccagcggctttggagacctgagcggcctgcccagcggcggggagggcctggagaccagcgccagcgaggtgggcacagacctgagcggcctgcccagcggccgggagggcctggagaccagcgccagcggggctgaggacctgagcggcctgcccagcggcaaggaggacctggtgggcagcgccagcggggacctggacctgggcaagctgcccagcggcaccctgggcagcggccaggcccctgagaccagcggcctgcccagcggcttcagcggggagtacagcggcgtggacctgggcagcggcccccccagcggcctgcctgacttcagcggcctgcccagcggcttccccaccgtgtccctggtggacagcaccctggtggaggtggtgacagccagcacagccagcgagctggagggccggggcaccatcggcatctctggagctggggagatcagcggcctgcccagcagcgagctggacatcagcggccgggccagcggcctgcccagcggcacagagctgagcggccaggccagcggcagcccagatgtgtctggagagatccctggcctgtttggagtgtctggccagcccagcggcttcccagacaccagcggggagaccagcggcgtgacagagctgagcggcctgagcagcggccagcccggcatcagcggggaggccagcggcgtgctgtatggcaccagccagcccttcggcatcacagacctgagcggggagaccagcggcgtgcctgacctgagcggccagcccagcggcctgcccggcttcagcggggccaccagcggcgtgcctgacctggtgtctggcaccaccagcggcagcggggagagcagcggcatcacctttgtggacaccagcctggtggaggtggcccccaccaccttcaaggaggaggagggcctgggctctgtggagctgagcggcctgcccagcggggaggccgacctgagcggcaagagcggcatggtggatgtgtctggccagttctctggaacagtggacagcagcggcttcaccagccagaccccagagttcagcggcctgcccagcggcattgctgaggtgtctggagagagcagcagagctgagatcggcagcagcctgcccagcggggcctactacggcagcggcacccccagcagcttccccaccgtgtccctggtggacaggaccctggtggagagcgtgacccaggcccccacagcccaggaggccggggagggccccagcggcatcctggagctgagcggggcccacagcggggccccagacatgtctggagagcacagcggcttcctggacctgagcggcctgcagagcggcctcatcgagcccagcggggagcccccaggcaccccctacttcagcggggactttgccagcaccaccaacgtgtctggagagagctctgtggccatgggcaccagcggggaggccagcggcctgcctgaggtgaccctcatcaccagcgagtttgtggagggcgtgacagagcccaccatcagccaggagctgggccagaggcctcctgtgacccacaccccccagctgtttgagagcagcggcaaggtgtccacagctggggacatcagcggggccacccctgtgctgcccggcagcggcgtggaggtgtcctctgtgcctgagagcagcagcgagaccagcgcctacccagaggccggctttggagccagcgctgcccctgaggccagccgggaggacagcggcagcccagacctgtctgagaccaccagcgccttccacgaggccaacctggagaggagcagcggcctgggcgtgtctggcagcaccctgaccttccaggagggggaggccagcgctgcccctgaggtgtctggagagagcaccaccaccagtgatgtgggcacagaggcccctggcctgcccagcgccacccccacagccagcggggacagaacagagatcagcggggacctgagcggccacaccagccagctgggcgtggtgatcagcaccagcatccctgagagcgagtggacccagcagacccagaggcctgctgagacccacctggagattgagagcagcagcctgctgtacagcggggaggagacccacacagtggagacagccaccagccccacagatgccagcatcccagccagccctgagtggaagcgggagagcgagagcacagctgctgccccagcccggagctgtgccgaggagccctgtggggccggcacctgcaaggagacagagggccacgtgatctgcctgtgccccccaggctacacaggagagcactgcaacatcgaccaggaggtgtgtgaggagggctggaacaagtaccagggccactgctaccgccacttcccagaccgggagacctgggtggatgctgagcggcgctgccgggagcagcagagccacctgagcagcatcgtgaccccagaggagcaggagtttgtgaacaacaatgcccaggactaccagtggattggcctgaatgacaggaccatcgagggggacttccgctggagcgatggccaccccatgcagtttgagaactggaggcccaaccagcctgacaacttctttgctgctggggaggactgtgtggtgatgatctggcatgagaagggggagtggaatgatgtgccctgcaactaccacctgcccttcacctgcaagaagggcaccgtggcctgtggggagccccctgtggtggagcacgcccggaccttcggccagaagaaggacagatatgagatcaacagcctggtgcgctaccagtgcacagagggctttgtgcagaggcacatgcccaccatccgctgccagcccagcggccactgggaggagccccagatcacctgcacagaccccaccacctacaagaggcggctgcagaagaggagcagccgccacccccggcgcagccggcccagcacagcccactag

SEQ ID NO: 143132 - DNA, 7296 bp, Artificial Sequence
  Description of Artificial Sequence: Synthetic coding sequence
atgaccaccctgctgtgggtgtttgtgaccctgcgggtcatcacagctgctgtgacagtggagaccagtgaccatgacaacagcctgtctgtgtccatcccccagcccagccccctgcgggtgctgctgggcaccagcctgaccatcccctgctacttcatcgaccccatgcaccctgtgaccacagcccccagcacagcccccctggccccccgcatcaagtggagccgggtgtccaaggagaaggaggtggtgctgctggtggccacagagggccgggtgcgggtgaacagcgcctaccaggacaaggtgtccctgcccaactacccagccatccccagtgatgccaccctggaggtgcagagcctgcggagcaatgacagcggcgtgtaccgctgtgaggtgatgcatggaattgaggacagcgaggccaccctggaggtggtggtgaagggcatcgtgttccactaccgggccatcagcacccgctacaccctggactttgaccgggcccagagggcctgcctgcagaacagcgccatcatcgccaccccagagcagctgcaggccgcctatgaagatggcttccaccagtgtgatgctggctggctggccgaccagacagtgcgctaccccatccacaccccccgggagggctgctatggagacaaggatgagttccctggggtgaggacctacggcatccgggacaccaatgagacctatgatgtgtactgctttgctgaggagatggagggggaggtgttctacgccaccagccctgagaagttcaccttccaggaggccgccaatgaatgtcggcggctgggcgcccggctggccaccaccggccagctgtacctggcctggcaggccggcatggacatgtgcagcgctggctggctggccgacagatctgtgcgctaccccatcagcaaggcccggcccaactgtggcggcaacctgctgggcgtgaggacagtgtatgtgcacgccaaccagacaggctacccagaccccagcagccgctatgatgccatctgctacaccggggaggactttgtggacatccctgagaacttcttcggcgtgggcggggaggaggacatcaccgtgcagacagtgacctggccagacatggagctgcccctgcccaggaacatcacagaaggagaggcccggggcagcgtcatcctgactgtgaagcccatctttgaggtgagccccagccccctggagcctgaggagcccttcacctttgcccctgagatcggggccacagcctttgctgaggtggagaatgagaccggggaggccacccggccctggggcttccccaccccaggcctgggccctgccacagccttcaccagcgaggacctggtggtgcaggtgacagctgtgcccggccagccccacctgcctggaggagtggtgttccactaccggcccggccccacccgctacagcctgacctttgaggaggcccagcaggcctgcctgaggactggagctgtgattgccagccctgagcagctgcaggccgcctatgaagctggctatgagcagtgtgatgctggctggctgcgggaccagacagtgcgctaccccatcgtgagccccaggaccccctgtgtgggggacaaggacagcagccctggggtgaggacctacggcgtgcggcccagcacagagacctatgatgtgtactgctttgtggaccggctggagggggaggtgttctttgccacccggctggagcagttcaccttccaggaggccctggagttctgtgagagccacaatgccaccctggccaccaccggccagctgtatgctgcctggagccggggcctggacaagtgctacgccggctggctggctgatggcagcctgcgctaccccatcgtgacccccaggcctgcctgtggcggggacaagccaggagtgaggacagtgtacctgtaccccaaccagacaggcctgcctgaccccctgagccgccaccacgccttctgcttccggggcatctctgctgtgcccagccctggagaggaggagggcggcacccccaccagccccagcggcgtggaggagtggatcgtgacccaggtggtgcctggggtggccgctgtgcctgtggaggaggagaccacagctgtgcccagcggggagaccacagccatcctggagttcaccacagagcctgagaaccagacagagtgggagcccgcctacacccctgtgggcaccagccccctgcccggcatcctgcccacctggccacccaccggggccgccacagaggagagcacagagggccccagcgccacagaggtgcccagcgccagcgaggagcccagccccagcgaggtgcccttccccagcgaggagcccagccccagcgaggagcccttccccagcgtgcggcccttccccagcgtggagctgttccccagcgaggagcccttccccagcaaggagcccagccccagcgaggagcccagcgccagcgaggagccctacacccccagcccccctgtgcccagctggacagagctgcccagcagtggagaggagagcggggccccagatgtgtctggggacttcaccggcagcggagatgtgtctggccacctggacttcagcggccagctgagcggggaccgggccagcggcctgcccagcggggacctggacagcagcggcctgaccagcacagtgggcagcggcctgcctgtggagagcggcctgcccagcggagatgaggagcgcatcgagtggcccagcacccccaccgtgggggagctgcccagcggggctgagatcctggagggcagcgccagcggcgtgggggacctgagcggcctgcccagcggggaggtgctggagaccagcgccagcggcgtgggggacctgagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagaccacagcccctggggtggaggagatcagcggcctgcccagcggggaggtgctggagaccacagcccctggggtggatgagatcagcggcctgcccagcggggaggtgctggagaccacagcccctggggtggaggagatcagcggcctgcccagcggggaggtgctggagaccagcaccagcgctgtgggggacctgagcggcctgcccagcggcggggaggtgctggagatctctgtgtctggagtggaggacatcagcggcctgcccagcggggaggtggtggagaccagcgccagcggcattgaagatgtgtctgagctgcccagcggggagggcctggagaccagcgccagcggcgtggaggacctgagccggctgcccagcggggaggaggtgctggagatcagcgccagcggctttggagacctgagcggcctgcccagcggcggggagggcctggagaccagcgccagcgaggtgggcacagacctgagcggcctgcccagcggccgggagggcctggagaccagcgccagcggggctgaggacctgagcggcctgcccagcggcaaggaggacctggtgggcagcgccagcggggacctggacctgggcaagctgcccagcggcaccctgggcagcggccaggcccctgagaccagcggcctgcccagcggcttcagcggggagtacagcggcgtggacctgggcagcggcccccccagcggcctgcctgacttcagcggcctgcccagcggcttccccaccgtgtccctggtggacagcaccctggtggaggtggtgacagccagcacagccagcgagctggagggccggggcaccatcggcatctctggagctggggagatcagcggcctgcccagcagcgagctggacatcagcggccgggccagcggcctgcccagcggcacagagctgagcggccaggccagcggcagcccagatgtgtctggagagatccctggcctgtttggagtgtctggccagcccagcggcttcccagacaccagcggggagaccagcggcgtgacagagctgagcggcctgagcagcggccagcccggcatcagcggggaggccagcggcgtgctgtatggcaccagccagcccttcggcatcacagacctgagcggggagaccagcggcgtgcctgacctgagcggccagcccagcggcctgcccggcttcagcggggccaccagcggcgtgcctgacctggtgtctggcaccaccagcggcagcggggagagcagcggcatcacctttgtggacaccagcctggtggaggtggcccccaccaccttcaaggaggaggagggcctgggctctgtggagctgagcggcctgcccagcggggaggccgacctgagcggcaagagcggcatggtggatgtgtctggccagttctctggaacagtggacagcagcggcttcaccagccagaccccagagttcagcggcctgcccagcggcattgctgaggtgtctggagagagcagcagagctgagatcggcagcagcctgcccagcggggcctactacggcagcggcacccccagcagcttccccaccgtgtccctggtggacaggaccctggtggagagcgtgacccaggcccccacagcccaggaggccggggagggccccagcggcatcctggagctgagcggggcccacagcggggccccagacatgtctggagagcacagcggcttcctggacctgagcggcctgcagagcggcctcatcgagcccagcggggagcccccaggcaccccctacttcagcggggactttgccagcaccaccaacgtgtctggagagagctctgtggccatgggcaccagcggggaggccagcggcctgcctgaggtgaccctcatcaccagcgagtttgtggagggcgtgacagagcccaccatcagccaggagctgggccagaggcctcctgtgacccacaccccccagctgtttgagagcagcggcaaggtgtccacagctggggacatcagcggggccacccctgtgctgcccggcagcggcgtggaggtgtcctctgtgcctgagagcagcagcgagaccagcgcctacccagaggccggctttggagccagcgctgcccctgaggccagccgggaggacagcggcagcccagacctgtctgagaccaccagcgccttccacgaggccaacctggagaggagcagcggcctgggcgtgtctggcagcaccctgaccttccaggagggggaggccagcgctgcccctgaggtgtctggagagagcaccaccaccagtgatgtgggcacagaggcccctggcctgcccagcgccacccccacagccagcggggacagaacagagatcagcggggacctgagcggccacaccagccagctgggcgtggtgatcagcaccagcatccctgagagcgagtggacccagcagacccagaggcctgctgagacccacctggagattgagagcagcagcctgctgtacagcggggaggagacccacacagtggagacagccaccagccccacagatgccagcatcccagccagccctgagtggaagcgggagagcgagagcacagctgctgaccaggaggtgtgtgaggagggctggaacaagtaccagggccactgctaccgccacttcccagaccgggagacctgggtggatgctgagcggcgctgccgggagcagcagagccacctgagcagcatcgtgaccccagaggagcaggagtttgtgaacaacaatgcccaggactaccagtggattggcctgaatgacaggaccatcgagggggacttccgctggagcgatggccaccccatgcagtttgagaactggaggcccaaccagcctgacaacttctttgctgctggggaggactgtgtggtgatgatctggcatgagaagggggagtggaatgatgtgccctgcaactaccacctgcccttcacctgcaagaagggcacagccaccacctacaagaggcggctgcagaagaggagcagccgccaccccaggaggagccggcccagcacagcccactag

SEQ ID NO: 143133 - DNA, 7593 bp, Artificial Sequence
  Description of Artificial Sequence: Synthetic coding sequence
atgaccaccctgctgtgggtgtttgtgaccctgcgggtcatcacagctgctgtgacagtggagaccagtgaccatgacaacagcctgtctgtgtccatcccccagcccagccccctgcgggtgctgctgggcaccagcctgaccatcccctgctacttcatcgaccccatgcaccctgtgaccacagcccccagcacagcccccctggccccccgcatcaagtggagccgggtgtccaaggagaaggaggtggtgctgctggtggccacagagggccgggtgcgggtgaacagcgcctaccaggacaaggtgtccctgcccaactacccagccatccccagtgatgccaccctggaggtgcagagcctgcggagcaatgacagcggcgtgtaccgctgtgaggtgatgcatggaattgaggacagcgaggccaccctggaggtggtggtgaagggcatcgtgttccactaccgggccatcagcacccgctacaccctggactttgaccgggcccagagggcctgcctgcagaacagcgccatcatcgccaccccagagcagctgcaggccgcctatgaagatggcttccaccagtgtgatgctggctggctggccgaccagacagtgcgctaccccatccacaccccccgggagggctgctatggagacaaggatgagttccctggggtgaggacctacggcatccgggacaccaatgagacctatgatgtgtactgctttgctgaggagatggagggggaggtgttctacgccaccagccctgagaagttcaccttccaggaggccgccaatgaatgtcggcggctgggcgcccggctggccaccaccggccagctgtacctggcctggcaggccggcatggacatgtgcagcgctggctggctggccgacagatctgtgcgctaccccatcagcaaggcccggcccaactgtggcggcaacctgctgggcgtgaggacagtgtatgtgcacgccaaccagacaggctacccagaccccagcagccgctatgatgccatctgctacaccggggaggactttgtggacatccctgagaacttcttcggcgtgggcggggaggaggacatcaccgtgcagacagtgacctggccagacatggagctgcccctgcccaggaacatcacagaaggagaggcccggggcagcgtcatcctgactgtgaagcccatctttgaggtgagccccagccccctggagcctgaggagcccttcacctttgcccctgagatcggggccacagcctttgctgaggtggagaatgagaccggggaggccacccggccctggggcttccccaccccaggcctgggccctgccacagccttcaccagcgaggacctggtggtgcaggtgacagctgtgcccggccagccccacctgcctggaggagtggtgttccactaccggcccggccccacccgctacagcctgacctttgaggaggcccagcaggcctgcctgaggactggagctgtgattgccagccctgagcagctgcaggccgcctatgaagctggctatgagcagtgtgatgctggctggctgcgggaccagacagtgcgctaccccatcgtgagccccaggaccccctgtgtgggggacaaggacagcagccctggggtgaggacctacggcgtgcggcccagcacagagacctatgatgtgtactgctttgtggaccggctggagggggaggtgttctttgccacccggctggagcagttcaccttccaggaggccctggagttctgtgagagccacaatgccaccctggccaccaccggccagctgtatgctgcctggagccggggcctggacaagtgctacgccggctggctggctgatggcagcctgcgctaccccatcgtgacccccaggcctgcctgtggcggggacaagccaggagtgaggacagtgtacctgtaccccaaccagacaggcctgcctgaccccctgagccgccaccacgccttctgcttccggggcatctctgctgtgcccagccctggagaggaggagggcggcacccccaccagccccagcggcgtggaggagtggatcgtgacccaggtggtgcctggggtggccgctgtgcctgtggaggaggagaccacagctgtgcccagcggggagaccacagccatcctggagttcaccacagagcctgagaaccagacagagtgggagcccgcctacacccctgtgggcaccagccccctgcccggcatcctgcccacctggccacccaccggggccgccacagaggagagcacagagggccccagcgccacagaggtgcccagcgccagcgaggagcccagccccagcgaggtgcccttccccagcgaggagcccagccccagcgaggagcccttccccagcgtgcggcccttccccagcgtggagctgttccccagcgaggagcccttccccagcaaggagcccagccccagcgaggagcccagcgccagcgaggagccctacacccccagcccccctgtgcccagctggacagagctgcccagcagtggagaggagagcggggccccagatgtgtctggggacttcaccggcagcggagatgtgtctggccacctggacttcagcggccagctgagcggggaccgggccagcggcctgcccagcggggacctggacagcagcggcctgaccagcacagtgggcagcggcctgcctgtggagagcggcctgcccagcggagatgaggagcgcatcgagtggcccagcacccccaccgtgggggagctgcccagcggggctgagatcctggagggcagcgccagcggcgtgggggacctgagcggcctgcccagcggggaggtgctggagaccagcgccagcggcgtgggggacctgagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagaccacagcccctggggtggaggagatcagcggcctgcccagcggggaggtgctggagaccacagcccctggggtggatgagatcagcggcctgcccagcggggaggtgctggagaccacagcccctggggtggaggagatcagcggcctgcccagcggggaggtgctggagaccagcaccagcgctgtgggggacctgagcggcctgcccagcggcggggaggtgctggagatctctgtgtctggagtggaggacatcagcggcctgcccagcggggaggtggtggagaccagcgccagcggcattgaagatgtgtctgagctgcccagcggggagggcctggagaccagcgccagcggcgtggaggacctgagccggctgcccagcggggaggaggtgctggagatcagcgccagcggctttggagacctgagcggcctgcccagcggcggggagggcctggagaccagcgccagcgaggtgggcacagacctgagcggcctgcccagcggccgggagggcctggagaccagcgccagcggggctgaggacctgagcggcctgcccagcggcaaggaggacctggtgggcagcgccagcggggacctggacctgggcaagctgcccagcggcaccctgggcagcggccaggcccctgagaccagcggcctgcccagcggcttcagcggggagtacagcggcgtggacctgggcagcggcccccccagcggcctgcctgacttcagcggcctgcccagcggcttccccaccgtgtccctggtggacagcaccctggtggaggtggtgacagccagcacagccagcgagctggagggccggggcaccatcggcatctctggagctggggagatcagcggcctgcccagcagcgagctggacatcagcggccgggccagcggcctgcccagcggcacagagctgagcggccaggccagcggcagcccagatgtgtctggagagatccctggcctgtttggagtgtctggccagcccagcggcttcccagacaccagcggggagaccagcggcgtgacagagctgagcggcctgagcagcggccagcccggcatcagcggggaggccagcggcgtgctgtatggcaccagccagcccttcggcatcacagacctgagcggggagaccagcggcgtgcctgacctgagcggccagcccagcggcctgcccggcttcagcggggccaccagcggcgtgcctgacctggtgtctggcaccaccagcggcagcggggagagcagcggcatcacctttgtggacaccagcctggtggaggtggcccccaccaccttcaaggaggaggagggcctgggctctgtggagctgagcggcctgcccagcggggaggccgacctgagcggcaagagcggcatggtggatgtgtctggccagttctctggaacagtggacagcagcggcttcaccagccagaccccagagttcagcggcctgcccagcggcattgctgaggtgtctggagagagcagcagagctgagatcggcagcagcctgcccagcggggcctactacggcagcggcacccccagcagcttccccaccgtgtccctggtggacaggaccctggtggagagcgtgacccaggcccccacagcccaggaggccggggagggccccagcggcatcctggagctgagcggggcccacagcggggccccagacatgtctggagagcacagcggcttcctggacctgagcggcctgcagagcggcctcatcgagcccagcggggagcccccaggcaccccctacttcagcggggactttgccagcaccaccaacgtgtctggagagagctctgtggccatgggcaccagcggggaggccagcggcctgcctgaggtgaccctcatcaccagcgagtttgtggagggcgtgacagagcccaccatcagccaggagctgggccagaggcctcctgtgacccacaccccccagctgtttgagagcagcggcaaggtgtccacagctggggacatcagcggggccacccctgtgctgcccggcagcggcgtggaggtgtcctctgtgcctgagagcagcagcgagaccagcgcctacccagaggccggctttggagccagcgctgcccctgaggccagccgggaggacagcggcagcccagacctgtctgagaccaccagcgccttccacgaggccaacctggagaggagcagcggcctgggcgtgtctggcagcaccctgaccttccaggagggggaggccagcgctgcccctgaggtgtctggagagagcaccaccaccagtgatgtgggcacagaggcccctggcctgcccagcgccacccccacagccagcggggacagaacagagatcagcggggacctgagcggccacaccagccagctgggcgtggtgatcagcaccagcatccctgagagcgagtggacccagcagacccagaggcctgctgagacccacctggagattgagagcagcagcctgctgtacagcggggaggagacccacacagtggagacagccaccagccccacagatgccagcatcccagccagccctgagtggaagcgggagagcgagagcacagctgctgccccagcccggagctgtgccgaggagccctgtggggccggcacctgcaaggagacagagggccacgtgatctgcctgtgccccccaggctacacaggagagcactgcaacatcgaccaggaggtgtgtgaggagggctggaacaagtaccagggccactgctaccgccacttcccagaccgggagacctgggtggatgctgagcggcgctgccgggagcagcagagccacctgagcagcatcgtgaccccagaggagcaggagtttgtgaacaacaatgcccaggactaccagtggattggcctgaatgacaggaccatcgagggggacttccgctggagcgatggccaccccatgcagtttgagaactggaggcccaaccagcctgacaacttctttgctgctggggaggactgtgtggtgatgatctggcatgagaagggggagtggaatgatgtgccctgcaactaccacctgcccttcacctgcaagaagggcaccgtggcctgtggggagccccctgtggtggagcacgcccggaccttcggccagaagaaggacagatatgagatcaacagcctggtgcgctaccagtgcacagagggctttgtgcagaggcacatgcccaccatccgctgccagcccagcggccactgggaggagccccagatcacctgcacagaccccaccacctacaagaggcggctgcagaagaggagcagccgccacccccggcgcagccggcccagcacagcccactag

SEQ ID NO: 143134 - DNA, 7479 bp, Artificial Sequence
  Description of Artificial Sequence: Synthetic coding sequence
atgaccaccctgctgtgggtgtttgtgaccctgcgggtcatcacagctgctgtgacagtggagaccagtgaccatgacaacagcctgtctgtgtccatcccccagcccagccccctgcgggtgctgctgggcaccagcctgaccatcccctgctacttcatcgaccccatgcaccctgtgaccacagcccccagcacagcccccctggccccccgcatcaagtggagccgggtgtccaaggagaaggaggtggtgctgctggtggccacagagggccgggtgcgggtgaacagcgcctaccaggacaaggtgtccctgcccaactacccagccatccccagtgatgccaccctggaggtgcagagcctgcggagcaatgacagcggcgtgtaccgctgtgaggtgatgcatggaattgaggacagcgaggccaccctggaggtggtggtgaagggcatcgtgttccactaccgggccatcagcacccgctacaccctggactttgaccgggcccagagggcctgcctgcagaacagcgccatcatcgccaccccagagcagctgcaggccgcctatgaagatggcttccaccagtgtgatgctggctggctggccgaccagacagtgcgctaccccatccacaccccccgggagggctgctatggagacaaggatgagttccctggggtgaggacctacggcatccgggacaccaatgagacctatgatgtgtactgctttgctgaggagatggagggggaggtgttctacgccaccagccctgagaagttcaccttccaggaggccgccaatgaatgtcggcggctgggcgcccggctggccaccaccggccagctgtacctggcctggcaggccggcatggacatgtgcagcgctggctggctggccgacagatctgtgcgctaccccatcagcaaggcccggcccaactgtggcggcaacctgctgggcgtgaggacagtgtatgtgcacgccaaccagacaggctacccagaccccagcagccgctatgatgccatctgctacaccggggaggactttgtggacatccctgagaacttcttcggcgtgggcggggaggaggacatcaccgtgcagacagtgacctggccagacatggagctgcccctgcccaggaacatcacagaaggagaggcccggggcagcgtcatcctgactgtgaagcccatctttgaggtgagccccagccccctggagcctgaggagcccttcacctttgcccctgagatcggggccacagcctttgctgaggtggagaatgagaccggggaggccacccggccctggggcttccccaccccaggcctgggccctgccacagccttcaccagcgaggacctggtggtgcaggtgacagctgtgcccggccagccccacctgcctggaggagtggtgttccactaccggcccggccccacccgctacagcctgacctttgaggaggcccagcaggcctgcctgaggactggagctgtgattgccagccctgagcagctgcaggccgcctatgaagctggctatgagcagtgtgatgctggctggctgcgggaccagacagtgcgctaccccatcgtgagccccaggaccccctgtgtgggggacaaggacagcagccctggggtgaggacctacggcgtgcggcccagcacagagacctatgatgtgtactgctttgtggaccggctggagggggaggtgttctttgccacccggctggagcagttcaccttccaggaggccctggagttctgtgagagccacaatgccaccctggccaccaccggccagctgtatgctgcctggagccggggcctggacaagtgctacgccggctggctggctgatggcagcctgcgctaccccatcgtgacccccaggcctgcctgtggcggggacaagccaggagtgaggacagtgtacctgtaccccaaccagacaggcctgcctgaccccctgagccgccaccacgccttctgcttccggggcatctctgctgtgcccagccctggagaggaggagggcggcacccccaccagccccagcggcgtggaggagtggatcgtgacccaggtggtgcctggggtggccgctgtgcctgtggaggaggagaccacagctgtgcccagcggggagaccacagccatcctggagttcaccacagagcctgagaaccagacagagtgggagcccgcctacacccctgtgggcaccagccccctgcccggcatcctgcccacctggccacccaccggggccgccacagaggagagcacagagggccccagcgccacagaggtgcccagcgccagcgaggagcccagccccagcgaggtgcccttccccagcgaggagcccagccccagcgaggagcccttccccagcgtgcggcccttccccagcgtggagctgttccccagcgaggagcccttccccagcaaggagcccagccccagcgaggagcccagcgccagcgaggagccctacacccccagcccccctgtgcccagctggacagagctgcccagcagtggagaggagagcggggccccagatgtgtctggggacttcaccggcagcggagatgtgtctggccacctggacttcagcggccagctgagcggggaccgggccagcggcctgcccagcggggacctggacagcagcggcctgaccagcacagtgggcagcggcctgcctgtggagagcggcctgcccagcggagatgaggagcgcatcgagtggcccagcacccccaccgtgggggagctgcccagcggggctgagatcctggagggcagcgccagcggcgtgggggacctgagcggcctgcccagcggggaggtgctggagaccagcgccagcggcgtgggggacctgagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagaccacagcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagacagctgcccctggggtggaggacatcagcggcctgcccagcggggaggtgctggagaccacagcccctggggtggaggagatcagcggcctgcccagcggggaggtgctggagaccacagcccctggggtggatgagatcagcggcctgcccagcggggaggtgctggagaccacagcccctggggtggaggagatcagcggcctgcccagcggggaggtgctggagaccagcaccagcgctgtgggggacctgagcggcctgcccagcggcggggaggtgctggagatctctgtgtctggagtggaggacatcagcggcctgcccagcggggaggtggtggagaccagcgccagcggcattgaagatgtgtctgagctgcccagcggggagggcctggagaccagcgccagcggcgtggaggacctgagccggctgcccagcggggaggaggtgctggagatcagcgccagcggctttggagacctgagcggcctgcccagcggcggggagggcctggagaccagcgccagcgaggtgggcacagacctgagcggcctgcccagcggccgggagggcctggagaccagcgccagcggggctgaggacctgagcggcctgcccagcggcaaggaggacctggtgggcagcgccagcggggacctggacctgggcaagctgcccagcggcaccctgggcagcggccaggcccctgagaccagcggcctgcccagcggcttcagcggggagtacagcggcgtggacctgggcagcggcccccccagcggcctgcctgacttcagcggcctgcccagcggcttccccaccgtgtccctggtggacagcaccctggtggaggtggtgacagccagcacagccagcgagctggagggccggggcaccatcggcatctctggagctggggagatcagcggcctgcccagcagcgagctggacatcagcggccgggccagcggcctgcccagcggcacagagctgagcggccaggccagcggcagcccagatgtgtctggagagatccctggcctgtttggagtgtctggccagcccagcggcttcccagacaccagcggggagaccagcggcgtgacagagctgagcggcctgagcagcggccagcccggcatcagcggggaggccagcggcgtgctgtatggcaccagccagcccttcggcatcacagacctgagcggggagaccagcggcgtgcctgacctgagcggccagcccagcggcctgcccggcttcagcggggccaccagcggcgtgcctgacctggtgtctggcaccaccagcggcagcggggagagcagcggcatcacctttgtggacaccagcctggtggaggtggcccccaccaccttcaaggaggaggagggcctgggctctgtggagctgagcggcctgcccagcggggaggccgacctgagcggcaagagcggcatggtggatgtgtctggccagttctctggaacagtggacagcagcggcttcaccagccagaccccagagttcagcggcctgcccagcggcattgctgaggtgtctggagagagcagcagagctgagatcggcagcagcctgcccagcggggcctactacggcagcggcacccccagcagcttccccaccgtgtccctggtggacaggaccctggtggagagcgtgacccaggcccccacagcccaggaggccggggagggccccagcggcatcctggagctgagcggggcccacagcggggccccagacatgtctggagagcacagcggcttcctggacctgagcggcctgcagagcggcctcatcgagcccagcggggagcccccaggcaccccctacttcagcggggactttgccagcaccaccaacgtgtctggagagagctctgtggccatgggcaccagcggggaggccagcggcctgcctgaggtgaccctcatcaccagcgagtttgtggagggcgtgacagagcccaccatcagccaggagctgggccagaggcctcctgtgacccacaccccccagctgtttgagagcagcggcaaggtgtccacagctggggacatcagcggggccacccctgtgctgcccggcagcggcgtggaggtgtcctctgtgcctgagagcagcagcgagaccagcgcctacccagaggccggctttggagccagcgctgcccctgaggccagccgggaggacagcggcagcccagacctgtctgagaccaccagcgccttccacgaggccaacctggagaggagcagcggcctgggcgtgtctggcagcaccctgaccttccaggagggggaggccagcgctgcccctgaggtgtctggagagagcaccaccaccagtgatgtgggcacagaggcccctggcctgcccagcgccacccccacagccagcggggacagaacagagatcagcggggacctgagcggccacaccagccagctgggcgtggtgatcagcaccagcatccctgagagcgagtggacccagcagacccagaggcctgctgagacccacctggagattgagagcagcagcctgctgtacagcggggaggagacccacacagtggagacagccaccagccccacagatgccagcatcccagccagccctgagtggaagcgggagagcgagagcacagctgctgaccaggaggtgtgtgaggagggctggaacaagtaccagggccactgctaccgccacttcccagaccgggagacctgggtggatgctgagcggcgctgccgggagcagcagagccacctgagcagcatcgtgaccccagaggagcaggagtttgtgaacaacaatgcccaggactaccagtggattggcctgaatgacaggaccatcgagggggacttccgctggagcgatggccaccccatgcagtttgagaactggaggcccaaccagcctgacaacttctttgctgctggggaggactgtgtggtgatgatctggcatgagaagggggagtggaatgatgtgccctgcaactaccacctgcccttcacctgcaagaagggcaccgtggcctgtggggagccccctgtggtggagcacgcccggaccttcggccagaagaaggacagatatgagatcaacagcctggtgcgctaccagtgcacagagggctttgtgcagaggcacatgcccaccatccgctgccagcccagcggccactgggaggagccccagatcacctgcacagaccccaccacctacaagaggcggctgcagaagaggagcagccgccacccccggcgcagccggcccagcacagcccactag

SEQ ID NO: 143135 - DNA, 7593 bp, Artificial Sequence; identical to SEQ ID NO: 143133
  Description of Artificial Sequence: Synthetic coding sequence

SEQ ID NO: 143136 - DNA, 399 bp, Artificial Sequence
  Description of Artificial Sequence: Synthetic coding sequence
atgctgacagctgctgtgctgagctgtgccctgctgctggccctgcctgccaccaggggggcccagatgggcctggcccccatggagggcatccggcggccagaccaggccctgctgcctgagctgcccggcctgggcctgcgggcccccctgaagaagaccacagctgagcaggccgaggaggacctgctgcaggaggcccaggccctggccgaggtgctggacctgcaggaccgggagcccaggagcagcagaagatgtgtgcggctgcacgagagctgcctgggccagcaggtgccctgctgtgacccctgtgccacctgctactgccgcttcttcaatgccttctgctactgcaggaagctgggcacagccatgaacccctgcagcaggacatag

SEQ ID NO: 143137 - DNA, 399 bp, Artificial Sequence
  Description of Artificial Sequence: Synthetic coding sequence
atggatgtgacccggctgctgctggccaccctgctggtgttcctgtgcttcttcaccgccaacagccacctgcccccagaggagaagctgagagatgacaggagcctgcggagcaacagctctgtgaacctgctggatgtgcccagcgtgtccatcgtggccctgaacaagaagagcaagcagatcggcaggaaggctgctgagaagaagaggagcagcaagaaggaggcctccatgaagaaggtggtgcggcccaggacccccctgagcgccccctgtgtggccaccaggaacagctgcaagcccccagccccagcctgctgtgacccctgtgccagctgccagtgccgcttcttccgcagcgcctgcagctgccgggtgctgagcctgaactgctag

SEQ ID NO: 143138 - DNA, 936 bp, Artificial Sequence
  Description of Artificial Sequence: Synthetic coding sequence
atggccctggaggtggtgttcctggcccggggccccagcggcctgctgctgtacaacggccagaagacagatggcaagggggactttgtgtccctggccctgcgggaccggcggctggagttccgctatgacctgggcaaaggagctgctgtgatccgcagccgggagcctgtgaccctgggcgcctggaccagggtgtccctggagagaaatggaaggaagggggccctgcgggtgggagatggcccccgggtgctgggggagagccccaagagcaggaaggtgccccacacagtgctgaacctgaaggagcccctgtatgtgggcggggccccagacttcagcaagctggcccgggctgctgctgtgagcagcggctttgatggagccatccagctggtgtccctgggcggccggcagctgctgaccccagagcacgtgctgcggcaggtggatgtgaccagctttgctggccacccctgcacccgggccagcggccacccctgcctgaatggagccagctgtgtgccccgggaggccgcctacgtgtgcctgtgccctgggggcttcagcggcccccactgtgagaagggcctggtggagaagtctgctggagatgtggacaccctggcctttgatggccgcacctttgtggagtacctgaatgctgtgacagaaagtgagctggccaatgagatccctgtgcctgagaccctggacagcggggccctgcacagcgagaaggccctgcagagcaaccactttgagctgagcctgaggacagaggccacccagggcctggtgctgtggagcggcaaggccacagaaagagctgactatgtggccctggccatcgtggatggccacctgcagctgagctacaacctgggcagccagcctgtggtgctgcggagcacagtgcctgtgaacacctag

SEQ ID NO: 143139 - DNA, 6138 bp, Artificial Sequence
  Description of Artificial Sequence: Synthetic coding sequence
atggccggccgcagccaccctggccccctgcggcccctgctgcccctgctggtggtggccgcctgtgtgctgcctggagctgggggcacctgcccagagcgggccctggagcggcgggaggaggaggccaacgtggtgctgaccggcaccgtggaggagatcctgaatgtggaccctgtgcagcacacctacagctgcaaggtgcgggtgtggagatacctgaagggcaaggacctggtggcccgggagagcctgctggatggcggcaacaaggtggtgatcagcggctttggagaccccctcatctgtgacaaccaggtgtccactggagacacccgcatcttctttgtgaacccagccccaccctacctgtggccagcccacaagaatgagctgatgctgaacagcagcctgatgaggatcaccctgaggaacctggaggaggtggagttctgtgtggaggacaagccaggcacccacttcacccctgtgccccccaccccaccagatgcctgccggggcatgctgtgtggctttggagctgtgtgtgagcccaatgctgagggccctggccgggccagctgtgtgtgcaagaagagcccctgccccagcgtggtggcccctgtgtgtggcagtgatgccagcacctacagcaatgaatgtgagctgcagagggcccagtgcagccagcagaggcgcatccggctgctgagccggggcccctgtggcagccgggacccctgcagcaatgtgacctgcagctttggcagcacctgtgcccggtctgcagatggcctgacagccagctgcctgtgcccagccacctgccgcggggcccctgagggcaccgtgtgtggcagtgatggagctgactacccaggagagtgccagctgctgcggcgggcctgtgcccggcaggagaatgtgttcaagaagtttgatggcccctgtgacccctgccagggcgccctgcctgaccccagccgcagctgccgggtgaaccccaggacccggcggcctgagatgctgctgcggcctgagagctgcccagcccggcaggcccctgtgtgtggagatgatggagtgacctatgaaaatgactgtgtgatgggccgctctggagctgcccggggcctgctgctgcagaaggtgcgcagcggccagtgccagggccgggaccagtgcccagagccctgccgcttcaatgctgtgtgcctgagccggcggggccggccccgctgcagctgtgacagagtgacctgtgatggagcctacagacctgtgtgtgcccaggacggccgcacctatgacagcgactgctggaggcagcaggccgagtgccggcagcagagggccatccccagcaagcaccagggcccctgtgaccaggcccccagcccctgcctgggcgtgcagtgtgcctttggagccacctgtgctgtgaagaatggccaggccgcctgtgaatgtctgcaggcctgcagcagcctgtatgaccctgtgtgtggcagtgatggagtgacctacggcagcgcctgtgagctggaggccacagcctgcaccctgggccgggagatccaggtggccaggaagggcccctgtgacagatgtggccagtgccgctttggagccctgtgtgaggccgagaccggccgctgtgtgtgccccagtgaatgtgtggccctggcccagcctgtgtgtggcagtgatggccacacctaccccagcgagtgcatgctgcacgtgcacgcctgcacccaccagatcagcctgcacgtggccagcgctggcccctgtgagacctgtggagatgctgtgtgtgcctttggagctgtgtgcagcgctggccagtgtgtgtgcccccgctgtgagcaccccccacctggccctgtgtgtggcagtgatggagtgacctacggcagcgcctgtgagctgcgggaggccgcctgcctgcagcagacccagatcgaggaggcccgggccggcccctgtgagcaggccgagtgtggcagcggcggcagcggcagcggggaggatggagactgtgagcaggagctgtgccggcagagaggaggcatctgggatgaggacagtgaagatggcccctgtgtgtgtgacttcagctgccagagcgtgcccggcagccctgtgtgtggcagtgatggagtgacctacagcacagaatgtgagctgaagaaggcccgctgtgagagccagaggggcctgtatgtggccgcccagggcgcctgccggggccccacctttgcccccctgccccctgtggcccccctgcactgtgcccagaccccctacggctgctgccaggacaacatcacagctgcccggggcgtgggcctggccggctgccccagcgcctgccagtgcaacccccacggcagctatggaggcacctgtgaccctgccaccggccagtgcagctgcaggcctggggtgggcggcctgcgctgtgacagatgtgagcccggcttctggaacttccggggcatcgtgacagatggccgcagcggctgcaccccctgcagctgtgacccccagggcgctgtgagagatgactgtgagcagatgacaggcctgtgcagctgcaagccaggagtggccggccccaagtgtggccagtgcccagatggccgggccctgggccctgctggctgtgaggctgatgccagcgccccagccacctgtgccgagatgagatgtgaatttggagcccgctgtgtggaggagagcggcagcgcccactgtgtgtgccccatgctgacctgcccagaggccaatgccaccaaggtgtgtggcagtgatggagtgacctatggaaatgaatgccagctgaagaccatcgcctgccggcagggcctgcagatcagcatccagagcctgggcccctgccaggaggccgtggcccccagcacccaccccaccagcgcctctgtgacagtgaccaccccaggcctgctgctgagccaggccctgcctgcccctcctggggccctgcccctggcccccagcagcacagcccacagccagaccaccccaccacccagcagccggcccaggaccacagcctctgtgcccaggaccaccgtgtggcctgtgctgactgtgcccccaacagcccccagccctgcccccagcctggtggccagcgcctttggagagagcggcagcacagatggcagcagtgatgaggagctgagcggggaccaggaggccagcggcggcggcagcggcggcctggagcccctggagggcagctctgtggccaccccaggcccccctgtggagcgggccagctgctacaacagcgccctgggctgctgcagtgatggcaagacccccagcctggatgctgagggcagcaactgcccagccaccaaggtgttccagggcgtgctggagctggagggcgtggagggccaggagctgttctacaccccagagatggctgaccccaagtctgagctgtttggagaaacagcccggagcattgagagcaccctggatgacctcttcaggaacagtgatgtgaagaaggacttccgctctgtgcggctgcgggacctgggccctgggaagtctgtgcgggccatcgtggatgtgcactttgaccccaccacagccttccgggccccagatgtggcccgggccctgctgcggcagatccaggtgtccagaagaagaagcctgggcgtgcggcggcccctgcaggagcacgtgcgcttcatggactttgactggttccctgccttcatcaccggggccaccagcggggccatcgctgctggggccacagcccgggccaccacagccagccggctgcccagcagcgctgtgaccccccgggccccccaccccagccacaccagccagcctgtggccaagaccacagctgcccccaccacccggcggccccccaccacagcccccagccgggtgcctggaagaagacctccagccccccagcagccccccaagccctgtgacagccagccctgcttccacggcggcacctgccaggactgggccctgggcggcggcttcacctgcagctgcccagctggccggggcggcgctgtgtgtgagaaggtgctgggcgcccctgtgcctgcctttgagggccgctccttcctggccttccccaccctgcgggcctaccacaccctgcggctggccctggagttccgggccctggagccccagggcctgctgctgtacaatggaaatgcccggggcaaggacttcctggccctggccctgctggatggccgggtgcagctgcgctttgacaccggcagcggccctgctgtgctgaccagcgctgtgcctgtggagcccggccagtggcaccggctggagctgagccgccactggaggcggggcaccctgtctgtggatggagagacccctgtgctgggggagagccccagcggcacagatggcctgaacctggacacagacctgtttgtgggcggcgtgcctgaggaccaggccgctgtggccctggagaggacctttgtgggcgccggcctgcggggctgcatccggctgctggatgtgaacaaccagaggctggagctgggcatcggccctggggccgccacccggggcagcggcgtgggagaatgtggggaccacccctgcctgcccaacccctgccacggcggggccccctgccagaacctggaggccggccgcttccactgccagtgccccccaggccgggtgggccccacctgtgctgatgagaagagcccctgccagcccaacccctgccacggggccgccccctgccgggtgctgcctgagggcggggcccagtgtgagtgccccctgggccgggagggcaccttctgccagacagccagcggccaggacggcagcggccccttcctggccgacttcaacggcttcagccacctggagctgcggggcctgcacacctttgcccgggacctgggggagaagatggccctggaggtggtgttcctggcccggggccccagcggcctgctgctgtacaacggccagaagacagatggaaaaggagactttgtgtccctggccctgcgggaccggcggctggagttccgctatgacctgggcaaaggagctgctgtgatccgcagccgggagcctgtgaccctgggcgcctggaccagggtgtccctggagagaaatggaagaaaaggagccctgcgggtgggagatggcccccgggtgctgggggagagccctgtgccccacacagtgctgaacctgaaggagcccctgtatgtgggcggggccccagacttcagcaagctggcccgggctgctgctgtgagcagcggctttgatggagccatccagctggtgtccctgggcggccggcagctgctgaccccagagcacgtgctgcggcaggtggatgtgaccagctttgctggccacccctgcacccgggccagcggccacccctgcctgaatggagccagctgtgtgccccgggaggccgcctacgtgtgcctgtgccctgggggcttcagcggcccccactgtgagaagggcctggtggagaagtctgctggagatgtggacaccctggcctttgatggccgcacctttgtggagtacctgaatgctgtgacagagagcgagaaggccctgcagagcaaccactttgagctgagcctgaggacagaggccacccagggcctggtgctgtggagcggcaaggccacagaaagagctgactatgtggccctggccatcgtggatggccacctgcagctgagctacaacctgggcagccagcctgtggtgctgcggagcacagtgcctgtgaacaccaaccgctggctgcgggtggtggcccaccgggagcagcgggagggcagcctgcaggtgggcaatgaggcccctgtgacaggcagcagccccctgggcgccacccagctggacacagatggagccctgtggctgggcggcctgcctgagctgcctgtgggccctgccctgcccaaggcctatggaactggatttgtgggctgcctgagagatgtggtggtgggccgccaccccctgcacctgctggaggatgctgtgaccaagccagagctgcggccctgccccaccccctag

SEQ ID NO: 143140 - DNA, 816 bp, Artificial Sequence
  Description of Artificial Sequence: Synthetic coding sequence
tgaagatatgacctgggcaaaggagctgctgtgatccgcagccgggagcctgtgaccctgggcgcctggaccagggtgtccctggagagaaatggaaggaagggggccctgcgggtgggagatggcccccgggtgctgggggagagccccaagagcaggaaggtgccccacacagtgctgaacctgaaggagcccctgtatgtgggcggggccccagacttcagcaagctggcccgggctgctgctgtgagcagcggctttgatggagccatccagctggtgtccctgggcggccggcagctgctgaccccagagcacgtgctgcggcaggtggatgtgaccagctttgctggccacccctgcacccgggccagcggccacccctgcctgaatggagccagctgtgtgccccgggaggccgcctacgtgtgcctgtgccctgggggcttcagcggcccccactgtgagaagggcctggtggagaagtctgctggagatgtggacaccctggcctttgatggccgcacctttgtggagtacctgaatgctgtgacagaaagtgagctggccaatgagatccctgtgcctgagaccctggacagcggggccctgcacagcgagaaggccctgcagagcaaccactttgagctgagcctgaggacagaggccacccagggcctggtgctgtggagcggcaaggccacagaaagagctgactatgtggccctggccatcgtggatggccacctgcagctgagctacaacctgggcagccagcctgtggtgctgcggagcacagtgcctgtgaacacctag

SEQ ID NO: 143141 - DNA, 462 bp, Artificial Sequence
  Description of Artificial Sequence: Synthetic coding sequence
atggccctggtgtttgtgtatggcaccctgaagaggggccagcccaaccaccgggtgctgagagatggagcccacggcagcgctgccttccgggcccggggccgcaccctggagccctaccccctggtgattgctggggagcacaacatcccctggctgctgcacctgcccggcagcggccgcctggtggagggggaggtgtatgctgtggatgagaggatgctgcgcttcctggatgactttgagagctgcccagccctgtaccagaggacagtgctgcgggtgcagctgctggaggaccgggcccctggagctgaggagcccccagcccccacagctgtgcagtgctttgtgtacagccgggccaccttccccccagagtgggcccagctgccccaccacgacagctatgattctgagggcccccacggcctgcgctacaaccccagagaaaatagatag

SEQ ID NO: 143142 - DNA, 462 bp, Artificial Sequence; identical to SEQ ID NO: 143141
  Description of Artificial Sequence: Synthetic coding sequence

SEQ ID NO: 143143 - DNA, 879 bp, Artificial Sequence
  Description of Artificial Sequence: Synthetic coding sequence
atgaaccccttctggagcatgagcaccagctctgtgaggaagaggtctgagggggaggagaagaccctgactggagatgtgaagaccagcccccccaggacagcccccaagaagcagctgcccagcatccccaagaatgccctgcccatcaccaagcccaccagccctgccccagctgcccagagcaccaacggcacccacgccagctatggccccttctacctggagtacagcctgctggccgagttcaccctggtggtgaagcagaagctgcccggggtgtatgtgcagcccagctaccgcagcgccctgatgtggtttggagtcatcttcatccgccacggcctgtaccaggatggagtcttcaagttcaccgtgtacatcccagacaactacccagatggagactgcccccggctggtgtttgacatccctgtgttccaccccctggtggaccccaccagcggggagctggatgtgaagagggcctttgccaagtggaggaggaaccacaaccacatctggcaggtgctgatgtatgcccggcgggtcttctacaagattgacacagccagccccctgaaccctgaggccgctgtgctgtatgagaaggacatccagctgttcaagagcaaggtggtggacagcgtgaaggtgtgcacagcccggctgtttgaccagcccaagattgaggacccctatgccatctccttcagcccctggaaccccagcgtgcatgatgaggcccgggagaagatgctgacccagaagaagccagaggagcagcacaacaagtctgtgcacgtggccggcctgtcctgggtgaagccaggctctgtgcagcccttcagcaaggaggagaagacagtggccacctag

SEQ ID NO: 143144 - DNA, 879 bp, Artificial Sequence; identical to SEQ ID NO: 143143
  Description of Artificial Sequence: Synthetic coding sequence

SEQ ID NO: 143145 - DNA, 1179 bp, Artificial Sequence
  Description of Artificial Sequence: Synthetic coding sequence
atggccagccacaagctgctggtgaccccacccaaggccctgctgaagcccctgagcatccccaaccagctgctgctgggccctggccccagcaacctgcccccacgcatcatggccgccggcggcctgcagatgattggctccatgagcaaggacatgtaccagatcatggatgagatcaaggagggcatccagtatgtgttccagaccaggaaccccctgaccctggtgatcagcggcagcggccactgtgccctggaggccgccctggtgaatgtgctggagcccggggacagcttcctggtgggcgccaacggcatctggggccagagagctgtggacattggagagagaattggagcccgggtgcaccccatgaccaaggaccccggcggccactacaccctgcaggaggtggaggagggcctggcccagcacaagcctgtgctgctcttcctgacccatggagagagcagcactggagtgctgcagcccctggatggctttggagagctgtgccaccgctacaagtgcctgctgctggtggacagcgtggccagcctgggcggcacccccctgtacatggaccggcagggcatcgacatcctgtacagcggcagccagaaggccctgaatgcccctcctggcaccagcctcatctccttcagtgacaaggccaagaagaagatgtacagcaggaagaccaagcccttctccttctacctggacatcaagtggctggccaacttctggggctgtgatgaccagcccaggatgtaccaccacaccatccctgtgatcagcctgtacagcctgcgggagagcctggccctgattgctgagcagggcctggagaacagctggaggcagcaccgggaggccgccgcctacctgcacggccgcctgcaggccctgggcctgcagctgtttgtgaaggaccctgccctgcggctgcccaccgtgaccaccgtggccgtgcctgctggctatgactggagggacatcgtgtcctatgtgattgaccactttgatattgagatcatgggcggcctgggccccagcacaggcaaggtgctgagaattggcctgctgggctgcaatgccaccagagaaaatgtggacagagtgacagaggccctgcgggccgccctgcagcactgccccaagaagaagctgtag

SEQ ID NO: 143146 - DNA, 3078 bp, Artificial Sequence
  Description of Artificial Sequence: Synthetic coding sequence
atggagcccttcaccaatgaccggctgcagctgcccaggaacatgattgaaaattccatgtttgaggaggagccagatgtggtggacctggccaaggagccctgcctgcaccccctggagccagatgaggtggagtatgagccccggggcagccggctgctggtgcggggcctgggggagcacgagatggaggaggatgaggaggactatgagagcagcgccaagctgctgggcatgtccttcatgaacagaagcagcggcctgagaaattctgccaccggctaccggcagagcccagatggagcctgcagcgtgcccagcgcccggaccatggtggtgtgtgccttcgtcatcgtggtggccgtgtctgtcatcatggtgatctacctgctgccccgctgcaccttcaccaaggagggctgccacaagaagaaccagagcatcggcctcatccagccctttgccaccaacgggaagctgttcccctgggcccagatccggctgcccacagctgtggtgcccctgcgctatgagctgagcctgcaccccaacctgacctccatgaccttccggggctctgtgaccatctctgtgcaggccctgcaggtgacctggaacatcatcctgcacagcacaggccacaacatcagccgggtgaccttcatgtctgctgtgagcagccaggagaagcaggccgagatcctggagtatgcctaccacggccagatcgccatcgtggcccctgaggccctgctggccggccacaactacaccctgaagattgagtacagcgccaacatcagcagcagctactacggcttctacggcttctcctacacagatgagagcaatgagaagaagtactttgctgccacccagtttgagcccctggccgcccggagcgccttcccctgctttgatgagcccgccttcaaggccaccttcatcatcaagatcatcagagatgagcagtacacagccctgagcaacatgcccaagaagagctctgtggtgctggatgatggcctggtgcaggatgagttcagcgagagcgtgaagatgagcacctacctggtggccttcatcgtgggggagatgaagaacctgagccaggatgtgaatggcaccctggtgtccatctatgctgtgcctgagaagattggccaggtgcactacgccctggagaccaccgtgaagctgctggagttcttccagaactactttgagatccagtaccccctgaagaagctggacctggtggccatcccagactttgaagctggggccatggagaactggggcctgctgaccttccgggaggagaccctgctgtatgacagcaacaccagctccatggctgacaggaagctggtgaccaagatcatcgcccacgagctggcccaccagtggtttggaaacctggtgaccatgaagtggtggaatgacctgtggctgaatgaaggatttgccaccttcatggagtacttcagcctggagaagatcttcaaggagctgagcagctatgaggacttcctggatgcccgcttcaagaccatgaagaaggacagcctgaacagcagccaccccatcagcagctctgtgcagagcagcgagcagatcgaggagatgtttgacagcctgagctacttcaagggcagcagcctgctgctgatgctgaagacctacctgtctgaagatgtgttccagcacgctgtggtgctgtacctgcacaaccacagctatgccagcatccagagtgatgacctgtgggacagcttcaatgaggtgaccaaccagaccctggatgtgaagaggatgatgaagacctggaccctgcagaagggcttccccctggtgacagtgcagaagaagggcaaggagctgttcatccagcaggagcgcttcttcctgaacatgaagccagagatccagcccagcgacaccagctacctgtggcacatccccctgtcctatgtgacagagggcaggaactacagcaagtaccagagcgtgtccctgctggacaagaagagcggggtcatcaacctgacagaggaggtgctgtgggtgaaggtgaacatcaacatgaatggctactacatcgtgcactatgcagatgatgactgggaggccctgatccaccagctgaagatcaacccctacgtgctgagtgacaaggaccgggccaacctgatcaacaacatctttgagctggccggcctgggcaaggtgcccctgaagagggcctttgacctgatcaactacctgggcaatgaaaaccacacagcccccatcacagaggccctcttccagacagacctgatctacaacctgctggagaagctgggctacatggacctggccagccggctggtgaccagggtcttcaagctgctgcagaaccagatccagcagcagacctggacagatgagggcacccccagcatgagggagctgcggagcgccctgctggagtttgcctgcacccacaacctgggcaactgcagcaccacagccatgaagctgtttgatgactggatggccagcaatggcacccagagcctgcccacagatgtgatgaccaccgtcttcaaggtgggcgccaagacagacaagggctggagcttcctgctgggcaagtacatcagcatcggcagcgaggccgagaagaacaagatcctggaggccctggccagcagtgaagatgtgaggaagctgtactggctgatgaagagcagcctgaatggagacaacttccgcacccagaagctgtccttcatcatcagaacagtgggccgccacttccctggccacctgctggcctgggactttgtgaaggagaactggaacaagctggtgcagaagttccccctgggcagctacaccatccagaacatcgtggccggcagcacctacctgttcagcaccaagacccacctgtctgaggtgcaggccttctttgagaaccagagcgaggccaccttccggctgcgctgtgtgcaggaggccctggaggtgatccagctgaacatccagtggatggagaagaacctgaagagcctgacctggtggctgtag

SEQ ID NO: 143147 - DNA, 2907 bp, Artificial Sequence
  Description of Artificial Sequence: Synthetic coding sequence
atggacagcaccctgacagccagcgagatccggcagcgcttcatcgacttcttcaagagaaatgagcacacctacgtgcacagcagcgccaccatccccctggatgaccccaccctgctgtttgccaatgccggcatgaaccagttcaagcccatcttcctgaacaccatcgaccccagccaccccatggccaagctgagcagagctgccaacacccagaagtgcatccgggccggcggcaagcacaatgacctggatgatgtgggcaaggatgtgtaccaccacaccttctttgagatgctgggctcctggagctttggagactacttcaaggagctggcctgcaagatggccctggagctgctgacccaggagtttggcatccccatcgagcggctgtatgtgacctactttggaggagatgaagctgctggcctggaggccgacctggagtgcaagcagatctggcagaacctgggcctggatgacaccaagatcctgcccggcaacatgaaggacaacttctgggagatgggagacaccggcccctgtggcccctgcagcgagatccactatgacagaattggaggaagagatgctgcccacctggtgaaccaggatgaccccaacgtgctggagatctggaacctggtgttcatccagtacaaccgggaggctgatggcatcctgaagcccctgcccaagaagagcattgacaccggcatgggcctggagcggctggtgtctgtgctgcagaacaagatgagcaactatgacacagacctgtttgtgccctactttgaggccatccagaagggcaccggggcccggccctacaccgggaaggtgggcgcagaagatgctgatggcatcgacatggcctacagagtgctggccgaccacgcccggaccatcaccgtggccctggctgatggcggccgcccagacaacacaggccggggctacgtgctgcggcgcatcctgcggcgggctgtgcgctatgcccacgagaagctgaatgccagccggggcttctttgccaccctggtggatgtggtggtgcagagcctgggagatgccttccctgagctgaagaaggaccctgacatggtgaaggacatcatcaatgaggaggaggtgcagttcctgaagaccctgagccggggccgccgcatcctggacaggaagatccagagcctgggggacagcaagaccatccctggggacacagcctggctgctgtatgacacctacggcttccctgtggacctgaccggcctgattgctgaggagaagggcctggtggtggacatggatggctttgaggaggagaggaagctggcccagctgaagagccagggcaaaggagctggaggagaggacctgatcatgctggacatctatgccatcgaggagctgcgggcccggggcctggaggtgacagatgacagccccaagtacaactaccacctggacagcagcggcagctatgtgtttgagaacacagtggccaccgtgatggccctgcggcgggagaagatgtttgtggaggaggtgtccacaggccaggagtgtggggtggtgctggacaagacctgcttctacgccgagcagggcggccagatctatgatgagggctacctggtgaaggtggatgacagcagcgaggacaagacagagttcaccgtgaagaatgcccaggtgcggggcggctacgtgctgcacatcggcaccatctacggggacctgaaggtgggggaccaggtgtggctgttcattgatgagccccggcggcggcccatcatgagcaaccacacagccacccacatcctgaactttgccctgcggtctgtgctgggggaggccgaccagaagggcagcctggtggccccagaccggctgcgctttgacttcaccgccaagggggccatgagcacccagcagatcaagaaggccgaggagatcgccaatgagatgattgaggccgccaaggctgtgtacacccaggactgccccctggccgccgccaaggccatccagggcctgcgggctgtgtttgatgagacctacccagaccctgtgcgggtggtgtccattggagtgcctgtgtctgagctgctggatgaccccagcggccctgctggcagcctgacctctgtggagttctgtggcggcacccacctgaggaacagcagccacgccggggcctttgtgattgtgacagaggaggccatcgccaagggcatccgccgcatcgtggccgtgactggagctgaggcccagaaggccctgaggaaggccgagagcctgaagaagtgcctgtctgtgatggaggccaaggtgaaggcccagacagcccccaacaaggatgtgcagcgggagattgctgacctgggggaggccctggccacagctgtgatcccccagtggcagaaggatgagctgcgggagaccctgaagagcctgaagaaggtgatggatgacctggaccgggccagcaaggcagatgtgcagaagagggtgctggagaagaccaagcagttcatcgacagcaaccccaaccagcccctggtgatcctggagatggagagcggggccagcgccaaggccctgaatgaggccctgaagctgttcaagatgcacagcccccagaccagcgccatgctgttcaccgtggacaatgaggccggcaagatcacctgcctgtgccaggtgccccagaatgctgccaacagaggcctgaaggccagcgagtgggtgcagcaggtgtctggcctgatggatggcaagggcggcggcaaggatgtgtctgcccaggccaccgggaagaatgtgggctgcctgcaggaggccctgcagctggccaccagctttgcccagctgcggctgggagatgtgaagaactag

SEQ ID NO: 143148 - DNA, 2958 bp, Artificial Sequence
  Description of Artificial Sequence: Synthetic coding sequence
atggccgcctctgtggccgccgccgcccggcggctgcggcgggccatcagaagaagccctgcctggaggggcctgagccaccggcccctgagcagcgagcccccagctgccaaggccagcgctgtgcgggccgccttcctgaacttcttccgggacagacatggccaccggctggtgcccagcgcctctgtgcggcccaggggggaccccagcctgctgtttgtgaatgccggcatgaaccagttcaagcccatcttcctgggcaccgtggaccccaggtctgagatggccggcttccggcgggtggccaacagccagaagtgtgtgcgggccggcggccaccacaatgacctggaggatgtgggccgggacctgagccaccacaccttctttgagatgctgggcaactgggcctttggaggagagtacttcaaggaggaggcctgcaacatggcctgggagctgctgacccaggtgtatggcatccctgaggagcggctgtggatctcctactttgatggagaccccaaggccggcctggaccctgacctggagacccgggacatctggctgagcctgggcgtgcctgccagccgggtgctgagctttggcccccaggagaacttctgggagatgggagacaccggcccctgtggcccctgcacagagatccactatgacctggccggcggcgtgggcgccccccagctggtggagctgtggaacctggtgttcatgcagcacaaccgggaggctgatggcagcctgcagcccctgccccagagacatgtggacaccggcatgggcctggagcggctggtggccgtgctgcagggcaagcacagcacctatgacacagacctcttcagccccctgctgaatgccatccagcagggctgccgggccccaccctacctgggccgggtgggcgtggctgatgagggccgcacagacacagcctacagagtggtggccgaccacatccgcaccctgtctgtgtgcatcagtgatggcatcttccctggcatgagcggcccccccctggtgctgcggcgcatcctgcggcgggctgtgcgcttctccatggagatcctgaaggcccctcctggcttcctgggcagcctggtgcctgtggtggtggagaccctgggagatgcctacccagagctgcagaggaacagcgcccagatcgccaacctggtgtctgaagatgaggccgccttcctggccagcctggagcggggccgccgcatcatcgacaggaccctgcggaccctgggccccagcgacatgtttcctgctgaggtggcctggagcctgagcctgtgtggggacctgggcctgcccctggacatggtggagctgatgctggaggagaagggcgtgcagctggacagcgctggcctggagcggctggcccaggaggaggcccagcaccgggcccggcaggccgagcctgtgcagaagcagggcctgtggctggatgtgcacgccctgggggagctgcagaggcagggcgtgcccccaacagatgacagccccaagtacaactacagcctgcggcccagcggcagctatgaatttggcacctgtgaggcccaggtgctgcagctgtacacagaagatggaacagctgtggcctctgtgggcaagggccagagatgtggcctgctgctggacaggaccaacttctacgccgagcagggcggccaggccagtgaccggggctacctggtgcgggccggccaggaggatgtgctcttccctgtggcccgggcccaggtgtgtggcggcttcatcctgcacgaggccgtggcccctgagtgcctgcggctgggggaccaggtgcagctgcacgtggatgaggcctggaggctgggctgcatggccaagcacacagccacccacctgctgaactgggccctgcggcagaccctgggccctggaacagagcagcagggcagccacctgaaccctgagcagctgcggctggatgtgaccacccagacccccctgaccccagagcagctgcgggctgtggagaacacagtgcaggaggccgtgggccaggatgaagctgtgtacatggaggaggtgcccctggccctgacagcccaggtgcccggcctgcggagcctggatgaggtgtacccagaccctgtgcgggtggtgtctgtgggcgtgcctgtggcccacgccctggaccctgccagccaggccgccctgcagacctctgtggagctgtgctgcggcacccacctgctgaggactggagctgtgggggacctggtgatcatcggggaccggcagctgagcaagggcaccacccggctgctggccgtgactggagagcaggcccagcaggcccgggagctgggccagagcctggcccaggaggtgaaggccgccacagagcggctgagcctgggcagcagagatgtggccgaggccctgcggctgagcaaggacatcggccgcctcatcgaggccgtggagacagctgtgatgccccagtggcagaggcgggagctgctggccaccgtgaagatgctgcagaggcgggccaacacagccatcaggaagctgcagatgggccaggccgccaagaagacccaggagctgctggagcggcacagcaagggccccctcatcgtggacacagtgtctgctgagagcctgtctgtgctggtgaaggtggtgcggcagctgtgtgagcaggcccccagcacctctgtgctgctgctgagcccccagcccatgggcaaggtgctgtgtgcctgccaggtggcccagggcgccatgcccaccttcaccgctgaggcctgggccctggccgtgtgcagccacatgggcggcaaggcctggggcagccgggtggtggcccagggcaccggcagcaccacagacctggaggccgccctgagcatcgcccagacctacgccctgagccagctgtag

SEQ ID NO: 143149 - DNA, 1578 bp, Artificial Sequence
  Description of Artificial Sequence: Synthetic coding sequence
atggagttctgtgtggaggacagcacagatgtgcacgtgctgattgaggaccaccgcatcgtgttcagctgcaagaatgctgatggagtggagctgtacaatgaaattgagttctacgccaaggtgaacagcaaggacagccaggacaagaggagcagccgcagcatcacctgctttgtgaggaagtggaaggagaaggtggcctggccccggctgaccaaggaggacatcaagcctgtgtggctgtctgtggactttgacaactggagggactgggagggagatgaggagatggagctggcccacgtggagcactatgcagagctgctgaagaaggtgtccaccaagaggcctcctccagccatggatgacctggacttcaccaccaccgtggtgtcctgctgcccagctgagctgcagacagagggcagcaatggcaagaaggaggtgctgagcggcttccaggtggtgctggaggacacagtgctcttccctgagggcggcggccagccagatgaccggggcaccatcaatgacatctctgtgctgcgggtgaccaggagaggagagcaggccgaccacttcacccagacccccctggaccccggcagccaggtgctggtgcgggtggactgggagaggagatttgaccacatgcagcagcacagcggccagcacctgatcacagctgtggccgaccacctgttcaagctgaagaccacctcctgggagctgggccgcttccgcagcgccatcgagctggacacccccagcatgacagctgagcaggtggccgccatcgagcagagcgtgaatgagaagatccgggaccggctgcctgtgaatgtgcgggagctgagcctggatgatcctgaggtggagcaggtgtctggccggggcctgcctgatgaccacgccggccccatccgggtggtgaacatcgagggcgtggacagcaacatgtgctgcggcacccacgtgagcaacctgagtgacctgcaggtgatcaagatcctgggcacagagaagggcaagaagaacagaaccaacctgatcttcctgagcggcaacagagtgctgaagtggatggagaggagccatggaacagagaaggccctgacagccctgctgaagtgtggggctgaggaccacgtggaggccgtgaagaagctgcagaacagcaccaagatcctgcagaagaacaacctgaacctgctgcgggacctggccgtgcacatcgcccacagcctgaggaacagcccagactggggcggcgtggtgatcctgcacaggaaggagggggacagcgagttcatgaacatcatcgccaatgagatcggcagcgaggagaccctgctcttcctgactgtgggagatgagaagggcggcggcctcttcctgctggccggccccccagcctctgtggagaccctgggcccccgggtggccgaggtgctggagggcaaaggagctgggaagaagggccgcttccagggcaaggccaccaagatgagcaggaggatggaggcccaggccctgctgcaggactacatcagcacccagagcgccaaggagtag

SEQ ID NO: 143150 - DNA, 1761 bp, Artificial Sequence
  Description of Artificial Sequence: Synthetic coding sequence
atgttcagcctgcccctgaactgcagcccagaccacatccggcggggcagctgctggggccggccccaggacctgaagattgctgccccagcctggaacagcaagtgccaccctggggccggggccgccatggcccggcagcacgcccggaccctgtggtatgaccggcccaggtatgtgttcatggagttctgtgtggaggacagcacagatgtgcacgtgctgattgaggaccacagaattgtgttcagctgcaagaatgctgatggagtggagctgtacaatgaaattgagttctacgccaaggtgaacagcaaggacagccaggacaagaggagcagccgcagcatcacctgctttgtgaggaagtggaaggagaaggtggcctggccccggctgaccaaggaggacatcaagcctgtgtggctgtctgtggactttgacaactggagggactgggagggagatgaggagatggagctggcccacgtggagcactacgccgagctgctgaagaaggtgtccaccaagaggcctcctccagccatggatgacctggacttcaccaccaccgtggtgtcctgctgcccagctgagctgcagacagagggcagcaatggcaagaaggaggtgctgagcggcttccaggtggtgctggaggacacagtgctcttccctgagggcggcggccagccagatgaccggggcaccatcaatgacatctctgtgctgcgggtgacccggcggggggagcaggccgaccacttcacccagacccccctggaccccggcagccaggtgctggtgcgggtggactgggagaggagatttgaccacatgcagcagcacagcggccagcacctgatcacagctgtggccgaccacctgttcaagctgaagaccacctcctgggagctgggccgcttccgcagcgccatcgagctggacacccccagcatgacagctgagcaggtggccgccatcgagcagagcgtgaatgagaagatccgggaccggctgcctgtgaatgtgcgggagctgagcctggatgatcctgaggtggagcaggtgtctggccggggcctgcctgatgaccatgctggccccatccgggtggtgaacattgaaggagtggacagcaacatgtgctgcggcacccacgtgagcaacctgagtgacctgcaggtgatcaagatcctgggcacagagaagggcaagaagaacagaaccaacctgatcttcctgagcggcaacagagtgctgaagtggatggagaggagccacggcacagagaaggccctgacagccctgctgaagtgtggggctgaagatcatgtggaggccgtgaagaagctgcagaacagcaccaagatcctgcagaagaacaacctgaacctgctgcgggacctggccgtgcacatcgcccacagcctgaggaacagcccagactggggcggcgtggtgatcctgcacaggaaggagggggacagcgagttcatgaacatcatcgccaatgaaattggcagcgaggagaccctgctcttcctgactgtgggagatgagaagggcggcggcctcttcctgctggccggccccccagcctctgtggagaccctgggcccccgggtggccgaggtgctggagggcaagggggccggcaagaagggccgcttccagggcaaggccaccaagatgagcaggaggatggaggcccaggccctgctgcaggactacatcagcacccagagcgccaaggagtag

SEQ ID NO: 143151 - DNA, 1761 bp, Artificial Sequence; identical to SEQ ID NO: 143150
  Description of Artificial Sequence: Synthetic coding sequence

SEQ ID NO: 143152 - DNA, 1239 bp, Artificial Sequence
  Description of Artificial Sequence: Synthetic coding sequence
atggccttctggtgccagagggacagctatgcccgggagttcaccaccaccgtggtgtcctgctgcccagctgagctgcagacagagggcagcaatggcaagaaggaggtgctgagcggcttccaggtggtgctggaggacacagtgctcttccctgagggcggcggccagccagatgaccggggcaccatcaatgacatctctgtgctgcgggtgacccggcggggggagcaggccgaccacttcacccagacccccctggaccccggcagccaggtgctggtgcgggtggactgggagaggagatttgaccacatgcagcagcacagcggccagcacctgatcacagctgtggccgaccacctgttcaagctgaagaccacctcctgggagctgggccgcttccgcagcgccatcgagctggacacccccagcatgacagctgagcaggtggccgccatcgagcagagcgtgaatgagaagatccgggaccggctgcctgtgaatgtgcgggagctgagcctggatgatcctgaggtggagcaggtgtctggccggggcctgcctgatgaccatgctggccccatccgggtggtgaacattgaaggagtggacagcaacatgtgctgcggcacccacgtgagcaacctgagtgacctgcaggtgatcaagatcctgggcacagagaagggcaagaagaacagaaccaacctgatcttcctgagcggcaacagagtgctgaagtggatggagaggagccacggcacagagaaggccctgacagccctgctgaagtgtggggctgaagatcatgtggaggccgtgaagaagctgcagaacagcaccaagatcctgcagaagaacaacctgaacctgctgcgggacctggccgtgcacatcgcccacagcctgaggaacagcccagactggggcggcgtggtgatcctgcacaggaaggagggggacagcgagttcatgaacatcatcgccaatgaaattggcagcgaggagaccctgctcttcctgactgtgggagatgagaagggcggcggcctcttcctgctggccggccccccagcctctgtggagaccctgggcccccgggtggccgaggtgctggagggcaagggggccggcaagaagggccgcttccagggcaaggccaccaagatgagcaggaggatggaggcccaggccctgctgcaggactacatcagcacccagagcgccaaggagtag

SEQ ID NO: 143153 - DNA, 501 bp, Artificial Sequence
  Description of Artificial Sequence: Synthetic coding sequence
atgttcagcctgcccctgaactgcagcccagaccacatccggcggggcagctgctggggccggccccaggacctgaagattgctgccccagcctggaacagcaagtgccaccctggggccggggccgccatggcccggcagcacgcccggaccctgtggtatgaccggcccaggtatgtgttcatggagttctgtgtggaggacagcacagatgtgcacgtgctgattgaggaccacagaattgtgttcagctgcaagaatgctgatggagtggagctgtacaatgaaattgagttctacgccaaggtgaacagcaagcctgtgtggctgtctgtggactttgacaactggagggactgggagggagatgaggagatggagctggcccacgtggagcactatgcagagctgctgaagaaggtgtccaccaagaggcctcctccagccatggatgacctggatgatgacagcgacagcgcagatgatgccaccagcaactag

SEQ ID NO: 143154 - DNA, 399 bp, Artificial Sequence
  Description of Artificial Sequence: Synthetic coding sequence
atggagttctgtgtggaggacagcacagatgtgcacgtgctgattgaggaccaccgcatcgtgttcagctgcaagaatgctgatggagtggagctgtacaatgaaattgagttctacgccaaggtgaacagcaaggacagccaggacaagaggagcagccgcagcatcacctgctttgtgaggaagtggaaggagaaggtggcctggccccggctgaccaaggaggacatcaagcctgtgtggctgtctgtggactttgacaactggagggactgggagggagatgaggagatggagctggcccacgtggagcactatgcagagctgctgaagaaggtgtccaccaagaggcctcctccagccatggatgacctggacttcaccaccaccgtggtgtag

SEQ ID NO: 143155 - DNA, 1830 bp, Artificial Sequence
  Description of Artificial Sequence: Synthetic coding sequence
atgaagtgggtgaccttcatcagcctgctcttcctgttcagcagcgcctacagccggggcgtcttcagaagagatgcccacaagtctgaggtggcccaccgcttcaaggacctgggggaggagaacttcaaggccctggtgctgattgcctttgcccagtacctgcagcagtgcccctttgaagatcatgtgaagctggtgaatgaggtgacagaatttgccaagacctgtgtggctgatgagagcgctgagaactgtgacaagagcctgcacaccctgtttggagacaagctgtgcaccgtggccaccctgcgggagacctacggggagatggctgactgctgtgccaagcaggagcctgagagaaatgaatgcttcctgcagcacaaggatgacaaccccaacctgccccggctggtgcggcctgaggtggatgtgatgtgcacagccttccatgacaatgaggagaccttcctgaagaagtacctgtatgagatcgcccggcggcacccctacttctacgcccctgagctgctcttctttgccaagcgctacaaggccgccttcacagagtgctgccaggccgctgacaaggccgcctgcctgctgcccaagctggatgagctgagagatgagggcaaggccagcagcgccaagcagaggctgaagtgtgccagcctgcagaagtttggagagcgggccttcaaggcctgggccgtggcccggctgagccagcgcttccccaaggccgagtttgctgaggtgtccaagctggtgacagacctgaccaaggtgcacacagagtgctgccacggggacctgctggagtgtgctgatgacagagctgacctggccaagtacatctgtgagaaccaggacagcatcagcagcaagctgaaggagtgctgtgagaagcccctgctggagaagagccactgcatcgccgaggtggagaatgatgagatgcctgctgacctgcccagcctggccgctgactttgtggagagcaaggatgtgtgcaagaactatgcagaggccaaggatgtgttcctgggcatgttcctgtatgaatatgcccggcggcacccagactacagcgtggtgctgctgctgcggctggccaagacctatgagaccaccctggagaagtgctgtgccgctgctgacccccatgagtgctacgccaaggtgtttgatgagttcaagcccctggtggaggagccccagaacctgatcaagcagaactgtgagctgtttgagcagctgggggagtacaagttccagaatgccctgctggtgcgctacaccaagaaggtgccccaggtgtccacccccaccctggtggaggtgtccaggaacctgggcaaggtgggcagcaagtgctgcaagcaccctgaggccaagaggatgccctgtgccgaggactacctgtctgtggtgctgaaccagctgtgtgtgctgcacgagaagacccctgtgtctgacagagtgaccaagtgctgcacagagagcctggtgaacagaagaccctgcttcagcgccctggaggtggatgagacctacgtgcccaaggagttcaatgctgagaccttcaccttccacgccgacatctgcaccctgtctgagaaggagcggcagatcaagaagcagacagccctggtggagctggtgaagcacaagcccaaggccaccaaggagcagctgaaggctgtgatggatgactttgctgcctttgtggagaagtgctgcaaggcagatgacaaggagacctgctttgctgaggagggcaagaagctggtggccgccagccaggccgccctgggcctgtag

SEQ ID NO: 143156 - DNA, 1191 bp, Artificial Sequence
  Description of Artificial Sequence: Synthetic coding sequence
atgaagtgggtgaccttcatcagcctgctcttcctgttcagcagcgcctacagccggggcgtcttcagaagagatgcccacaagtctgaggtggcccaccgcttcaaggacctgggggaggagaacttcaaggccctggtgctgattgcctttgcccagtacctgcagcagtgcccctttgaagatcatgtgaagctggtgaatgaggtgacagaatttgccaagacctgtgtggctgatgagagcgctgagaactgtgacaagagcctgcacaccctgtttggagacaagctgtgcaccgtggccaccctgcgggagacctacggggagatggctgactgctgtgccaagcaggagcctgagagaaatgaatgcttcctgcagcacaaggatgacaaccccaacctgccccggctggtgcggcctgaggtggatgtgatgtgcacagccttccatgacaatgaggagaccttcctgaagaagtacctgtatgagaccaccctggagaagtgctgtgccgctgctgacccccatgaatgttatgccaaggtgtttgatgagttcaagcccctggtggaggagccccagaacctgatcaagcagaactgtgagctgtttgagcagctgggggagtacaagttccagaatgccctgctggtgcgctacaccaagaaggtgccccaggtgtccacccccaccctggtggaggtgtccaggaacctgggcaaggtgggcagcaagtgctgcaagcaccctgaggccaagaggatgccctgtgccgaggactacctgtctgtggtgctgaaccagctgtgtgtgctgcacgagaagacccctgtgtctgacagagtgaccaagtgctgcacagagagcctggtgaacagaagaccctgcttcagcgccctggaggtggatgagacctacgtgcccaaggagttcaatgctgagaccttcaccttccacgccgacatctgcaccctgtctgagaaggagcggcagatcaagaagcagacagccctggtggagctggtgaagcacaagcccaaggccaccaaggagcagctgaaggctgtgatggatgactttgctgcctttgtggagaagtgctgcaaggcagatgacaaggagacctgctttgctgaggagggcaagaagctggtggccgccagccaggccgccctgggcctgtag

SEQ ID NO: 143157 - DNA, 1254 bp, Artificial Sequence
  Description of Artificial Sequence: Synthetic coding sequence
atgaagtgggtgaccttcatcagcctgctcttcctgttcagcagcgcctacagccggggcgtcttcagaagagatgcccacaagtctgaggtggcccaccgcttcaaggacctgggggaggagaacttcaaggccctggccgtggcccggctgagccagcgcttccccaaggccgagtttgctgaggtgtccaagctggtgacagacctgaccaaggtgcacacagagtgctgccacggggacctgctggagtgtgctgatgacagagctgacctggccaagtacatctgtgagaaccaggacagcatcagcagcaagctgaaggagtgctgtgagaagcccctgctggagaagagccactgcatcgccgaggtggagaatgatgagatgcctgctgacctgcccagcctggccgctgactttgtggagagcaaggatgtgtgcaagaactatgcagaggccaaggatgtgttcctgggcatgttcctgtatgaatatgcccggcggcacccagactacagcgtggtgctgctgctgcggctggccaagacctatgagaccaccctggagaagtgctgtgccgctgctgacccccatgagtgctacgccaaggtgtttgatgagttcaagcccctggtggaggagccccagaacctgatcaagcagaactgtgagctgtttgagcagctgggggagtacaagttccagaatgccctgctggtgcgctacaccaagaaggtgccccaggtgtccacccccaccctggtggaggtgtccaggaacctgggcaaggtgggcagcaagtgctgcaagcaccctgaggccaagaggatgccctgtgccgaggactacctgtctgtggtgctgaaccagctgtgtgtgctgcacgagaagacccctgtgtctgacagagtgaccaagtgctgcacagagagcctggtgaacagaagaccctgcttcagcgccctggaggtggatgagacctacgtgcccaaggagttcaatgctgagaccttcaccttccacgccgacatctgcaccctgtctgagaaggagcggcagatcaagaagcagacagccctggtggagctggtgaagcacaagcccaaggccaccaaggagcagctgaaggctgtgatggatgactttgctgcctttgtggagaagtgctgcaaggcagatgacaaggagacctgctttgctgaggagggcaagaagctggtggccgccagccaggccgccctgggcctgtag

SEQ ID NO: 143158 - DNA, 1857 bp, Artificial Sequence
  Description of Artificial Sequence: Synthetic coding sequence
atgaagtgggtgaccttcatcagcctgctcttcctgttcagcagcgcctacagccggggcgtcttcagaagagatgccctcttcctgttcttcttcccctgcccagacaagtctgaggtggcccaccgcttcaaggacctgggggaggagaacttcaaggccctggtgctgattgcctttgcccagtacctgcagcagtgcccctttgaggaccacgtgaagctggtgaatgaggtgacagaatttgccaagacctgtgtggctgatgaatctgctgagaactgtgacaagagcctgcacaccctgtttggagacaagctgtgcaccgtggccaccctgcgggagacctatggagagatggctgactgctgtgccaagcaggagcctgagagaaatgaatgcttcctgcagcacaaggatgacaaccccaacctgccccggctggtgcggcctgaggtggatgtgatgtgcacagccttccatgacaatgaggagaccttcctgaagaagtacctgtatgaaattgcccggcggcacccctacttctacgcccctgagctgctcttctttgccaagcgctacaaggccgccttcacagagtgctgccaggccgctgacaaggccgcctgcctgctgcccaagctggatgagctgagagatgagggcaaggccagcagcgccaagcagaggctgaagtgtgccagcctgcagaagtttggagagcgggccttcaaggcctgggccgtggcccggctgagccagcgcttccccaaggccgagtttgctgaggtgtccaagctggtgacagacctgaccaaggtgcacacagagtgctgccacggggacctgctggagtgtgctgatgacagagctgacctggccaagtacatctgtgagaaccaggacagcatcagcagcaagctgaaggagtgctgtgagaagcccctgctggagaagagccactgcatcgccgaggtggagaatgatgagatgcctgctgacctgcccagcctggccgctgactttgtggagagcaaggatgtgtgcaagaactatgcagaggccaaggatgtgttcctgggcatgttcctgtatgaatatgcccggcggcacccagactacagcgtggtgctgctgctgcggctggccaagacctatgagaccaccctggagaagtgctgtgccgctgctgacccccatgaatgttatgccaaggtgtttgatgagttcaagcccctggtggaggagccccagaacctgatcaagcagaactgtgagctgtttgagcagctgggggagtacaagttccagaatgccctgctggtgcgctacaccaagaaggtgccccaggtgtccacccccaccctggtggaggtgtccaggaacctgggcaaggtgggcagcaagtgctgcaagcaccctgaggccaagaggatgccctgtgccgaggactacctgtctgtggtgctgaaccagctgtgtgtgctgcacgagaagacccctgtgtctgacagagtgaccaagtgctgcacagagagcctggtgaacagaagaccctgcttcagcgccctggaggtggatgagacctacgtgcccaaggagttcaatgctgagaccttcaccttccacgccgacatctgcaccctgtctgagaaggagcggcagatcaagaagcagacagccctggtggagctggtgaagcacaagcccaaggccaccaaggagcagctgaaggctgtgatggatgactttgctgcctttgtggagaagtgctgcaaggcagatgacaaggagacctgctttgctgaggagggcaagaagctggtggccgccagccaggccgccctgggcctgtag

SEQ ID NO: 143159 - DNA, 1161 bp, Artificial Sequence
  Description of Artificial Sequence: Synthetic coding sequence
atgtttgctgagatccagatccaggacaaggacaggatgggcacagctgggaaggtgatcaagtgcaaggctgctgtgctgtgggagcagaagcagcccttcagcattgaggagattgaggtggccccacccaagaccaaggaggtgcgcatcaagatcctggccaccggcatctgcaggacagatgaccacgtgatcaagggcaccatggtgtccaagtttcctgtgattgtgggccacgaggccactggaattgtggagagcattggagagggcgtgaccaccgtgaagccaggggacaaggtgatccccctcttcctgccccagtgccgggagtgcaatgcctgcagaaatccagatggcaacctgtgcatccgcagtgacatcaccggccggggcgtgctggctgatggcaccacccgcttcacctgcaagggcaagcctgtgcaccacttcatgaacaccagcaccttcacagagtacacagtggtggatgagagctctgtggccaagattgatgatgctgcccctcctgagaaggtgtgcctgattggctgcggcttcagcacaggctacggggctgctgtgaagacaggcaaggtgaagccaggcagcacctgtgtggtgtttggcctgggcggcgtgggcctgagcgtcatcatgggctgcaagtctgctggggccagccgcatcatcggcatcgacctgaacaaggacaagtttgagaaggccatggctgtgggcgccacagagtgcatcagccccaaggacagcaccaagcccatcagcgaggtgctgtctgagatgacaggcaacaacgtgggctacacctttgaggtgattggccacctggagaccatgattgatgccctggccagctgccacatgaactacggcacctctgtggtggtgggcgtgcccccatctgccaagatgctgacctatgaccccatgctgctcttcaccggccgcacctggaagggctgtgtgtttggaggcctgaagagcagagatgatgtgcccaagctggtgacagagttcctggccaagaagtttgacctggaccagctgatcacccacgtgctgcccttcaagaagatcagcgagggctttgagctgctgaacagcggccagagcatcagaacagtgctgaccttctag

SEQ ID NO: 143160 - DNA, 1128 bp, Artificial Sequence
  Description of Artificial Sequence: Synthetic coding sequence
atgagcacagctgggaaggtgatcaagtgcaaggctgctgtgctgtgggaggtgaagaagcccttcagcattgaagatgtggaggtggccccacccaaggcctatgaggtgcgcatcaagatggtggccgtgggcatctgccacacagatgaccacgtggtgtctggcaacctggtgacccccctgcctgtgatcctgggccacgaggccgccggcatcgtggagagcgtgggggagggcgtgaccaccgtgaagccaggggacaaggtgatccccctcttcaccccccagtgtgggaagtgccgggtgtgcaagaaccctgagagcaactactgcctgaagaatgacctgggcaacccccggggcaccctgcaggacggcacccggcgcttcacctgccggggcaagcccatccaccacttcctgggcaccagcaccttcagccagtacacagtggtggatgaaaatgctgtggccaagattgatgctgccagccccctggagaaggtgtgcctgattggctgcggcttcagcacaggctacggcagcgctgtgaatgtggccaaggtgaccccaggcagcacctgtgctgtgtttggcctgggcggcgtgggcctgtctgctgtgatgggctgcaaggctgctggagctgcccgcatcatcgctgtggacatcaacaaggacaagtttgccaaggccaaggagctgggcgccacagagtgcatcaacccccaggactacaagaagcccatccaggaggtgctgaaggagatgacagatggcggcgtggacttctcctttgaagtcatcggccgcctggacaccatgatggccagcctgctgtgctgccacgaggcctgtggcaccagcgtcatcgtgggcgtgcccccagccagccagaacctgagcatcaaccccatgctgctgctgactggaagaacctggaagggagctgtgtatggaggcttcaagagcaaggagggcatccccaagctggtggccgacttcatggccaagaagttcagcctggatgccctgatcacccacgtgctgccctttgagaagatcaatgaaggatttgacctgctgcacagcggcaagagcatcagaacagtgctgaccttctag

SEQ ID NO: 143161 - DNA, 1008 bp, Artificial Sequence
  Description of Artificial Sequence: Synthetic coding sequence
atggtggccgtgggcatctgccacacagatgaccacgtggtgtctggcaacctggtgacccccctgcctgtgatcctgggccacgaggccgccggcatcgtggagagcgtgggggagggcgtgaccaccgtgaagccaggggacaaggtgatccccctcttcaccccccagtgtgggaagtgccgggtgtgcaagaaccctgagagcaactactgcctgaagaatgacctgggcaacccccggggcaccctgcaggacggcacccggcgcttcacctgccggggcaagcccatccaccacttcctgggcaccagcaccttcagccagtacacagtggtggatgaaaatgctgtggccaagattgatgctgccagccccctggagaaggtgtgcctgattggctgcggcttcagcacaggctacggcagcgctgtgaatgtggccaaggtgaccccaggcagcacctgtgctgtgtttggcctgggcggcgtgggcctgtctgctgtgatgggctgcaaggctgctggagctgcccgcatcatcgctgtggacatcaacaaggacaagtttgccaaggccaaggagctgggcgccacagagtgcatcaacccccaggactacaagaagcccatccaggaggtgctgaaggagatgacagatggcggcgtggacttctcctttgaagtcatcggccgcctggacaccatgatggccagcctgctgtgctgccacgaggcctgtggcaccagcgtcatcgtgggcgtgcccccagccagccagaacctgagcatcaaccccatgctgctgctgactggaagaacctggaagggagctgtgtatggaggcttcaagagcaaggagggcatccccaagctggtggccgacttcatggccaagaagttcagcctggatgccctgatcacccacgtgctgccctttgagaagatcaatgaaggatttgacctgctgcacagcggcaagagcatcagaacagtgctgaccttctag

SEQ ID NO: 143162 - DNA, 1089 bp, Artificial Sequence
  Description of Artificial Sequence: Synthetic coding sequence
atgagcacagctgggaaggtgatcaagtgcaaggctgctgtgctgtgggaggtgaagaagcccttcagcattgaagatgtggaggtggccccacccaaggcctatgaggtgcgcatcaagatggtggccgtgggcatctgccacacagatgaccacgtggtgtctggcaacctggtgacccccctgcctgtgatcctgggccacgaggccgccggcatcgtggagagcgtgggggagggcgtgaccaccgtgaagccaggggacaaggtgatccccctcttcaccccccagtgtgggaagtgccgggtgtgcaagaaccctgagagcaactactgcctgaagaatgacctgggcaacccccggggcaagcccatccaccacttcctgggcaccagcaccttcagccagtacacagtggtggatgaaaatgctgtggccaagattgatgctgccagccccctggagaaggtgtgcctgattggctgcggcttcagcacaggctacggcagcgctgtgaatgtggccaaggtgaccccaggcagcacctgtgctgtgtttggcctgggcggcgtgggcctgtctgctgtgatgggctgcaaggccgccggggccgcccgcatcatcgctgtggacatcaacaaggacaagtttgccaaggccaaggagctgggcgccacagagtgcatcaacccccaggactacaagaagcccatccaggaggtgctgaaggagatgacagatggaggagtggacttctcctttgaggtgattggccgcctggacaccatgatggccagcctgctgtgctgccacgaggcctgtggcacctctgtgattgtgggcgtgcccccagccagccagaacctgagcatcaaccccatgctgctgctgaccggccgcacctggaagggagctgtgtatggaggcttcaagagcaaggagggcatccccaagctggtggccgacttcatggccaagaagttcagcctggatgccctgatcacccacgtgctgccctttgagaagatcaatgaaggatttgacctgctgcacagcggcaagagcatcagaacagtgctgaccttctag

SEQ ID NO: 143163 - DNA, 1143 bp, Artificial Sequence
  Description of Artificial Sequence: Synthetic coding sequence
atgggcaccaagggcaaggtgatcaagtgcaaggccgccatcgcctgggaggccggcaagcccctgtgcatcgaggaggtggaggtggccccacccaaggcccacgaggtgcgcatccagatcatcgccaccagcctgtgccacacagatgccaccgtcatcgacagcaagtttgagggcctggccttccctgtgattgtgggccatgaagctgctggcatcgtggagagcatcggccctggggtgaccaacgtgaagccaggggacaaggtgatccccctgtatgcccccctgtgcaggaagtgcaagttctgcctgagccccctgaccaacctgtgtgggaagatcagcaacctgaagagccctgccagtgaccagcagctgatggaggacaagaccagccgcttcacctgcaagggcaagcctgtgtaccacttcttcggcaccagcaccttcagccagtacacagtggtgtctgacatcaacctggccaagattgatgatgatgccaacctggagcgggtgtgcctgctgggctgcggcttcagcacaggctacggggccgccatcaacaatgccaaggtgaccccaggcagcacctgtgctgtgtttggcctgggcggcgtgggcctgtctgctgtgatgggctgcaaggccgccggggccagccgcatcatcggcatcgacatcaacagcgagaagtttgtgaaggccaaggccctgggcgccacagactgcctgaacccccgggacctgcacaagcccatccaggaggtgatcatcgagctgaccaagggcggcgtggactttgccctggactgtgccggcggcagcgagaccatgaaggccgccctggactgcaccacagctggctggggcagctgcaccttcatcggcgtggccgccggcagcaagggcctgaccatcttccctgaggagctgatcatcggccgcaccatcaatggcaccttctttggaggctggaagtctgtggacagcatccccaagctggtgacagactacaagaacaagaagttcaacctggatgccctggtgacccacaccctgccctttgacaagatcagcgaggcctttgacctgatgaaccagggcaagtctgtgaggaccatcctgatcttctag

SEQ ID NO: 143164 - DNA, 1200 bp, Artificial Sequence
  Description of Artificial Sequence: Synthetic coding sequence
atgctggtgcggggcccccactttgagctgcagcgctgcaagacccacctgttcagcagcaactacctgacccaggtgatcaagtgcaaggccgccatcgcctgggaggccggcaagcccctgtgcatcgaggaggtggaggtggccccacccaaggcccacgaggtgcgcatccagatcatcgccaccagcctgtgccacacagatgccaccgtgattgacagcaagtttgagggcctggccttccctgtgattgtgggccacgaggccgccggcatcgtggagagcatcggccctggggtgaccaacgtgaagccaggggacaaggtgatccccctgtatgcccccctgtgcaggaagtgcaagttctgcctgagccccctgaccaacctgtgtgggaagatcagcaacctgaagagccctgccagtgaccagcagctgatggaggacaagaccagccgcttcacctgcaagggcaagcctgtgtaccacttcttcggcaccagcaccttcagccagtacacagtggtgtctgacatcaacctggccaagattgatgatgatgccaacctggagcgggtgtgcctgctgggctgcggcttcagcacaggctatggagctgccatcaacaatgccaaggtgaccccaggcagcacctgtgctgtgtttggcctgggcggcgtgggcctgtctgctgtgatgggctgcaaggctgctggggccagccgcatcattggaattgacatcaacagcgagaagtttgtgaaggccaaggccctgggcgccacagactgcctgaacccccgggacctgcacaagcccatccaggaggtgatcatcgagctgaccaagggcggcgtggactttgccctggactgtgccggcggcagcgagaccatgaaggccgccctggactgcaccacagctggctggggcagctgcaccttcatcggcgtggccgccggcagcaagggcctgaccatcttccctgaggagctgatcattggaagaaccatcaatggcaccttcttcggcggctggaagtctgtggacagcatccccaagctggtgacagactacaagaacaagaagttcaacctggatgccctggtgacccacaccctgccctttgacaagatcagcgaggcctttgacctgatgaaccagggcaagtctgtgaggaccatcctgatcttctag

SEQ ID NO: 143165 - DNA, 1125 bp, Artificial Sequence
  Description of Artificial Sequence: Synthetic coding sequence
atggccaatgaagtcatcaagtgcaaggctgctgtggcctgggaggccggcaagcccctgagcattgaggagattgaggtggccccacccaaggcccacgaggtgcgcatcaagatcatcgccacagctgtgtgccacacagatgcctacaccctgtctggagctgaccctgagggctgcttccctgtgatcctgggccatgaaggagctggcatcgtggagagcgtgggggagggcgtgaccaagctgaaggccggggacaccgtcatccccctgtacatcccccagtgtggggagtgcaagttctgcctgaaccccaagaccaacctgtgccagaagatccgggtgacccagggcaagggcctgatgccagatggcaccagccgcttcacctgcaagggcaagaccatcctgcactacatgggcaccagcaccttcagcgagtacacagtggtggccgacatctctgtggccaagattgaccccctggcccccctggacaaggtgtgcctgctgggctgcggcatcagcacaggctacggggctgctgtgaacacagccaagctggagcccggctctgtgtgtgctgtgtttggcctgggcggcgtgggcctggccgtcatcatgggctgcaaggtggccggggccagccgcatcatcggcgtggacatcaacaaggacaagtttgcccgggccaaggagtttggagccacagagtgcatcaacccccaggacttcagcaagcccatccaggaggtgctgattgagatgacagatggaggagtggactacagctttgaatgtattggaaatgtgaaggtgatgagagctgccctggaggcctgccacaagggctggggcgtgtctgtggtggtgggcgtggccgccagcggggaggagatcgccacccggcccttccagctggtgacaggccgcacctggaagggcacagcctttggaggctggaagtctgtggagagcgtgcccaagctggtgtctgagtacatgagcaagaagatcaaggtggatgaatttgtgacccacaacctgagctttgatgagatcaacaaggcctttgagctgatgcacagcggcaagagcatcagaacagtggtgaagatctag

SEQ ID NO: 143166 - DNA, 1107 bp, Artificial Sequence
  Description of Artificial Sequence: Synthetic coding sequence
atgtgcaccaccggccaggtgatccgctgcaaggccgccatcctgtggaagccaggggcccccttcagcattgaggaggtggaggtggccccacccaaggccaaggaggtgcgcatcaaggtggtggccaccggcctgtgtggcacagagatgaaggtgctgggcagcaagcacctggacctgctgtaccccaccatcctgggccatgaaggagctggcatcgtggagagcatcggggagggcgtgtccacagtgaagccaggggacaaggtgatcaccctcttcctgccccagtgtggagaatgtaccagctgcctgaacagcgagggcaacttctgcatccagttcaagcagagcaagacccagctgatgtctgatggcaccagccgcttcacctgcaagggcaagagcatctaccactttggaaacaccagcaccttctgtgagtacaccgtcatcaaggagatctctgtggccaagattgatgctgtggcccccctggagaaggtgtgcctgatcagctgtggcttcagcactggatttggagctgccatcaacacagccaaggtgaccccaggcagcacctgtgctgtgtttggcctgggcggcgtgggcctgtctgtggtgatgggctgcaaggctgctggagctgcccgcatcattggagtggatgtgaacaaggagaagttcaagaaggcccaggagctgggcgccacagagtgcctgaacccccaggacctgaagaagcccatccaggaggtgctgtttgacatgacagatgctggcatcgacttctgctttgaggccatcggcaacctggatgtgctggccgccgccctggccagctgcaatgaaagctatggagtgtgtgtggtggtgggcgtgctgcctgcctctgtgcagctgaagatcagcggccagctgttcttcagcggccgcagcctgaagggctctgtgtttggaggctggaagagccggcagcacatccccaagctggtggccgactacatggccgagaagctgaacctggaccccctcatcacccacaccctgaacctggacaagatcaatgaagctgtggagctgatgaagacaggcaagtggtag

SEQ ID NO: 143167 - DNA, 1128 bp, Artificial Sequence
  Description of Artificial Sequence: Synthetic coding sequence
atgtgcaccaccggccaggtgatccgctgcaaggccgccatcctgtggaagccaggggcccccttcagcattgaggaggtggaggtggccccacccaaggccaaggaggtgcgcatcaaggtggtggccaccggcctgtgtggcacagagatgaaggtgctgggcagcaagcacctggacctgctgtaccccaccatcctgggccatgaaggagctggcatcgtggagagcatcggggagggcgtgtccacagtgaagccaggggacaaggtgatcaccctcttcctgccccagtgtggagaatgtaccagctgcctgaacagcgagggcaacttctgcatccagttcaagcagagcaagacccagctgatgtctgatggcaccagccgcttcacctgcaagggcaagagcatctaccactttggaaacaccagcaccttctgtgagtacaccgtcatcaaggagatctctgtggccaagattgatgctgtggcccccctggagaaggtgtgcctgatcagctgtggcttcagcactggatttggagctgccatcaacacagccaaggtgaccccaggcagcacctgtgctgtgtttggcctgggcggcgtgggcctgtctgtggtgatgggctgcaaggctgctggagctgcccgcatcattggagtggatgtgaacaaggagaagttcaagaaggcccaggagctgggcgccacagagtgcctgaacccccaggacctgaagaagcccatccaggaggtgctgtttgacatgacagatgctggcatcgacttctgctttgaggccatcggcaacctggatgtgctggccgccgccctggccagctgcaatgaaagctatggagtgtgtgtggtggtgggcgtgctgcctgcctctgtgcagctgaagatcagcggccagctgttcttcagcggccgcagcctgaagggctctgtgtttggaggctggaagagccggcagcacatccccaagctggtggccgactacatggccgagaagctgaacctggaccccctcatcacccacaccctgaacctggacaagatcaatgaagctgtggagctgatgaagacaggcaagtgcatccgctgcatcctgctgctgtag

SEQ ID NO: 143168 - DNA, 501 bp, Artificial Sequence
  Description of Artificial Sequence: Synthetic coding sequence
atgggctgcaaggccgccggggccgcccgcatcatcggcgtggatgtgaacaaggagaagttcaagaaggcccaggagctgggcgccacagaatgtctgaacccccaggacctgaagaagcccatccaggaggtgctgtttgacatgacagatgctggcatcgacttctgctttgaggccatcggcaacctggatgtgctggccgccgccctggccagctgcaatgaaagctatggagtgtgtgtggtggtgggcgtgctgcctgcctctgtgcagctgaagatcagcggccagctgttcttcagcggccgcagcctgaagggctctgtgtttggaggctggaagagccggcagcacatccccaagctggtggccgactacatggccgagaagctgaacctggaccccctcatcacccacaccctgaacctggacaagatcaatgaggccgtggagctgatgaagacaggcaagtgcatccgctgcatcctgctgctgtag

SEQ ID NO: 143169 - DNA, 1068 bp, Artificial Sequence
  Description of Artificial Sequence: Synthetic coding sequence
atggagcctgagaagcagacagagatcagcgagttcttcctgcagggcctgtctgagaagccagagcaccagaccctgctcttcaccatgttcctgagcacctacctggtgaccatcattggaaatgccctgatcatcctggccatcatcacagacagccacctgcacacccccatgtacttcttcctgttcaacctgagcctggtggacaccctgctgagcagcaccaccgtgcccaagatgctggccaacatccaggcccagagccgggccatcccctttgtgggctgcctgacccagatgtatgccttccacctgtttggcaccatggacagcttcctgctggccgtgatggccatcgacagatttgtggccatcgtgcacccccagcgctacctggtgctgatgtgcagccctgtgtgtggcctgctgctgggcgcctcctggatgatcaccaacctgcagagcctcatccacacctgcctgatggcccagctgaccttctgtgccggcagcgagatcagccacttcttctgtgacctgatgcccctgctgaagctgagcggcagtgacacccacaccaatgagctggtgatctttgccttcggcatcgtggtgggcaccagccccttcagctgcatcctgctgagctacatccgcatcttctggacagtgttcaagatccccagcacccggggcaagtggaaggccttcagcacctgtggcctgcacctgactgtggtgtccctgtcctatggcaccatctttgctgtgtacctgcagcccaccagccccagcagcagccagaaggacaaggccgccgccctgatgtgtggggtcttcatccccatgctgaaccccttcatctacagcatccggaacaaggacatgaaggccgccctgggcaagctgattggcaaggtggccgtgccctgccccaggcctgagcagctgctggatgtgtaccacgtgcccggcagcctgctggccgcccgggacacagagatgcaccccatcccctacccaggcggcgtgcagagcctggccggcaacagagacatggagtag

SEQ ID NO: 143170 - DNA, 1125 bp, Artificial Sequence
  Description of Artificial Sequence: Synthetic coding sequence
atgggcacagctgggaaggtgatcaagtgcaaggctgctgtgctgtgggagcagaagcagcccttcagcattgaggagattgaggtggccccacccaagaccaaggaggtgcgcatcaagatcctggccaccggcatctgcaggacagatgaccacgtgatcaagggcaccatggtgtccaagtttcctgtgattgtgggccacgaggccactggaattgtggagagcattggagagggcgtgaccaccgtgaagccaggggacaaggtgatccccctcttcctgccccagtgccgggagtgcaatgcctgcagaaatccagatggcaacctgtgcatccgcagtgacatcaccggccggggcgtgctggctgatggcaccacccgcttcacctgcaagggcaagcctgtgcaccacttcatgaacaccagcaccttcacagagtacacagtggtggatgagagctctgtggccaagattgatgatgctgcccctcctgagaaggtgtgcctgattggctgcggcttcagcacaggctacggggctgctgtgaagacaggcaaggtgaagccaggcagcacctgtgtggtgtttggcctgggcggcgtgggcctgagcgtcatcatgggctgcaagtctgctggggccagccgcatcatcggcatcgacctgaacaaggacaagtttgagaaggccatggctgtgggcgccacagagtgcatcagccccaaggacagcaccaagcccatcagcgaggtgctgtctgagatgacaggcaacaacgtgggctacacctttgaggtgattggccacctggagaccatgattgatgccctggccagctgccacatgaactacggcacctctgtggtggtgggcgtgcccccatctgccaagatgctgacctatgaccccatgctgctcttcaccggccgcacctggaagggctgtgtgtttggaggcctgaagagcagagatgatgtgcccaagctggtgacagagttcctggccaagaagtttgacctggaccagctgatcacccacgtgctgcccttcaagaagatcagcgagggctttgagctgctgaacagcggccagagcatcagaacagtgctgaccttctag

SEQ ID NO: 143171 - DNA, 1185 bp, Artificial Sequence
  Description of Artificial Sequence: Synthetic coding sequence
atgaagtgcctggtgagccgccacacagtgcgggagaccctggacatggtgttccagaggatgtctgtggaggccggggtcatcaagtgcaaggctgctgtgctgtgggagcagaagcagcccttcagcattgaggagattgaggtggccccacccaagaccaaggaggtgcgcatcaagatcctggccaccggcatctgcaggacagatgaccacgtgatcaagggcaccatggtgtccaagtttcctgtgattgtgggccacgaggccactggaattgtggagagcattggagagggcgtgaccaccgtgaagccaggggacaaggtgatccccctcttcctgccccagtgccgggagtgcaatgcctgcagaaatccagatggcaacctgtgcatccgcagtgacatcaccggccggggcgtgctggctgatggcaccacccgcttcacctgcaagggcaagcctgtgcaccacttcatgaacaccagcaccttcacagagtacacagtggtggatgagagctctgtggccaagattgatgatgctgcccctcctgagaaggtgtgcctgattggctgcggcttcagcacaggctacggggctgctgtgaagacaggcaaggtgaagccaggcagcacctgtgtggtgtttggcctgggcggcgtgggcctgagcgtcatcatgggctgcaagtctgctggggccagccgcatcatcggcatcgacctgaacaaggacaagtttgagaaggccatggctgtgggcgccacagagtgcatcagccccaaggacagcaccaagcccatcagcgaggtgctgtctgagatgacaggcaacaacgtgggctacacctttgaggtgattggccacctggagaccatgattgatgccctggccagctgccacatgaactacggcacctctgtggtggtgggcgtgcccccatctgccaagatgctgacctatgaccccatgctgctcttcaccggccgcacctggaagggctgtgtgtttggaggcctgaagagcagagatgatgtgcccaagctggtgacagagttcctggccaagaagtttgacctggaccagctgatcacccacgtgctgcccttcaagaagatcagcgagggctttgagctgctgaacagcggccagagcatcagaacagtgctgaccttctag

SEQ ID NO: 143172 - DNA, 954 bp, Artificial Sequence
  Description of Artificial Sequence: Synthetic coding sequence
atggtgtccaagtttcctgtgattgtgggccacgaggccaccggcatcgtggagagcatcggggagggcgtgaccaccgtgaagccaggggacaaggtgatccccctcttcctgccccagtgcagagaatgtaatgcctgcaggaacccagatggcaacctgtgcatccgcagtgacatcaccggccggggcgtgctggctgatggcaccacccgcttcacctgcaagggcaagcctgtgcaccacttcatgaacaccagcaccttcacagagtacacagtggtggatgagagctctgtggccaagattgatgatgctgcccctcctgagaaggtgtgcctgattggctgcggcttcagcacaggctatggagctgctgtgaagacaggcaaggtgaagccaggcagcacctgtgtggtgtttggcctgggcggcgtgggcctgagcgtcatcatgggctgcaagtctgctggggccagccgcatcattggaattgacctgaacaaggacaagtttgagaaggccatggctgtgggcgccacagagtgcatcagccccaaggacagcaccaagcccatcagcgaggtgctgtctgagatgactggaaacaacgtgggctacacctttgaagtcatcggccacctggagaccatgattgatgccctggccagctgccacatgaactacggcacctctgtggtggtgggcgtgccccccagcgccaagatgctgacctatgaccccatgctgctcttcaccggccgcacctggaagggctgtgtgtttggaggcctgaagagcagagatgatgtgcccaagctggtgacagagttcctggccaagaagtttgacctggaccagctgatcacccacgtgctgcccttcaagaagatcagcgagggctttgagctgctgaacagcggccagagcatcagaacagtgctgaccttctag

SEQ ID NO: 143173 - DNA, 912 bp, Artificial Sequence
  Description of Artificial Sequence: Synthetic coding sequence
atggctgctgctgcccgggcccgggtggcctacctgctgcggcagctgcagagagctgcctgccagtgccccacccacagccacacctacagccaggcccctggcctgagccccagcggcaagaccacagattatgcctttgagatggctgtgagcaacatccgctacggggctgctgtgaccaaggaggtgggcatggacctgaagaacatgggcgccaagaatgtgtgcctgatgacagacaagaacctgagcaagctgccccctgtgcaggtggccatggacagcctggtgaagaatggcatccccttcaccgtgtatgacaacgtgcgggtggagcccacagacagcagcttcatggaggccattgaatttgcccagaagggggcctttgatgcctacgtggccgtgggcggcggcagcaccatggacacctgcaaggccgccaacctgtatgccagcagcccccacagcgacttcctggactatgtgtctgcccccatcggcaagggcaagcctgtgtctgtgcccctgaagcccctgattgctgtgcccaccaccagcggcaccggcagcgagaccactggagtggccatctttgattatgagcacctgaaggtgaagattggcatcaccagccgggccatcaagcccaccctgggcctgattgaccccctgcacaccctgcacatgcctgcccgggtggtggccaacagcggctttgatgtgctgtgccacgccctggagagctacaccaccctgccctaccacctgcggagcccctgccccagcaaccccatcaccaggcctgcctaccagggcagcaaccccatcagtgacatctgggccatccacgccctgagaattgtggccaagtacctgaagagagctgtgaacagcacagacaagtag

SEQ ID NO: 143174 - DNA, 1404 bp, Artificial Sequence
  Description of Artificial Sequence: Synthetic coding sequence
atggctgctgctgcccgggcccgggtggcctacctgctgcggcagctgcagagagctgcctgccagtgccccacccacagccacacctacagccaggcccctggcctgagccccagcggcaagaccacagattatgcctttgagatggctgtgagcaacatccgctacggggctgctgtgaccaaggaggtgggcatggacctgaagaacatgggcgccaagaatgtgtgcctgatgacagacaagaacctgagcaagctgccccctgtgcaggtggccatggacagcctggtgaagaatggcatccccttcaccgtgtatgacaacgtgcgggtggagcccacagacagcagcttcatggaggccattgaatttgcccagaagggggcctttgatgcctacgtggccgtgggcggcggcagcaccatggacacctgcaaggccgccaacctgtatgccagcagcccccacagcgacttcctggactatgtgtctgcccccatcggcaagggcaagcctgtgtctgtgcccctgaagcccctgattgctgtgcccaccaccagcggcaccggcagcgagaccactggagtggccatctttgattatgagcacctgaaggtgaagattggcatcaccagccgggccatcaagcccaccctgggcctgattgaccccctgcacaccctgcacatgcctgcccgggtggtggccaacagcggctttgatgtgctgtgccacgccctggagagctacaccaccctgccctaccacctgcggagcccctgccccagcaaccccatcaccaggcctgcctaccagggcagcaaccccatcagtgacatctgggccatccacgccctgagaattgtggccaagtacctgaagagagctgtgagaaatccagatgacctggaggcccggagccacatgcacctggccagcgcctttgctggcattggatttggaaatgctggggtgcacctgtgccacggcatgagctaccccatcagcggcctggtgaagatgtacaaggccaaggactacaacgtggaccaccccctggtgccccacggcctgtctgtggtgctgaccagccctgctgtgttcaccttcaccgcccagatgtttcctgagcggcacctggagatggccgagatcctgggcgctgacaccaggacagcccgcatccaggatgctggcctggtgctggccgacaccctgaggaagttcctgtttgacctggatgtggatgatggcctggccgctgtgggctacagcaaggctgacatcccagccctggtgaagggcaccctgccccaggagcgggtgaccaagctggccccctgcccccagagcgaggaggacctggccgccctgtttgaggcctccatgaagctgtactag

SEQ ID NO: 143175 - DNA, 2406 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatccacaactggatcagaggaaatgacaaggtgcctggggcctggacagaggcctgtgagcagaagctgaccttcttcaacagcaccctgaacaccagcggcctggtgcctgaaggagatgccctgcccatccctggggcccacaggcctggggtggtgaccaaggccggcctcatcctgtttggaaatgatgacaagatgctgctggtgaagaacatccagctggaggatggcaagatgatcctggccagcaacttcttcaagggggccgccagctctgtgctggagctgacagaggccgagctggtgacagctgaggccgtgcgctctgtgtggcagaggatcctgcccaaggtgctggaggtggaggacagcacagacttcttcaagtctggagctgcctctgtggatgtggtgcggctggtggaggaggtgaaggagctgtgtgatggcctggagctggagaatgaagatgtgtacatggccagcacctttggagacttcatccagctgctggtgaggaagctgcggggagatgatgaggagggggagtgcagcattgattatgtggagatggctgtgaacaagaggacagtgaggatgccccaccagctgttcatcggcggggagtttgtggatgctgagggcgccaagaccagcgagaccatcaaccccacagatggcagcgtcatctgccaggtgtccctggcccaggtgacagatgtggacaaggctgtggccgccgccaaggatgcctttgaaaatggccgctggggcaagatcagcgcccgggaccggggccgcctgatgtaccgcctggccgacctgatggagcagcaccaggaggagctggccaccatcgaggccctggatgctggagctgtgtacaccctggccctgaagacccacgtgggcatgagcatccagaccttccgctactttgctggctggtgtgacaagatccagggcagcaccatccccatcaaccaggcccggcccaacagaaacctgaccctgaccaggaaggagcctgtgggcgtgtgtggcatcatcatcccctggaactaccccctgatgatgctgtcctggaagacagctgcctgcctggccgccggcaacacagtggtgatcaagccagcccaggtgacccccctgacagccctgaagtttgctgagctgaccctgaaggccggcatccccaagggcgtggtgaatgtgctgcccggcagcggcagcctggtgggccagaggctgagtgaccacccagatgtgaggaagattggcttcaccggcagcacagaggtgggcaagcacatcatgaagagctgtgccatcagcaatgtgaagaaggtgtccctggagctgggcggcaagagccccctcatcatctttgctgactgtgacctgaacaaggctgtgcagatgggcatgagctctgtgttcttcaacaagggggagaactgcatcgctgctggccgcctgtttgtggaggacagcatccatgatgaatttgtgcggcgggtggtggaggaggtgaggaagatgaaggtgggcaaccccctggaccgggacacagaccacggcccccagaaccaccacgcccacctggtgaagctgatggagtactgccagcacggcgtgaaggagggcgccaccctggtgtgtggcggcaaccaggtgcccaggcctggcttcttctttgagcccaccgtcttcacagatgtggaggaccacatgtttattgccaaggaggagagctttggacctgtgatgatcatcagcagatttgctgatggagacctggatgctgtgctgagccgggccaatgccacagaatttggcctggccagcggggtcttcacccgggacatcaacaaggccctgtatgtgtctgacaagctgcaggccggcaccgtgtttgtgaacacctacaacaagacagatgtggccgccccctttggaggcttcaagcagagcggctttgggaaggacctgggggaggccgccctgaatgagtacctgcgggtgaagacagtgacctttgagtactag

SEQ ID NO: 143176 - DNA, 1506 bp, Artificial Sequence
  Description of Artificial Sequence: Synthetic coding sequence
atgagcagcagcggcaccccagacctgcctgtgctgctgacagacctgaagatccagtacaccaagatcttcatcaacaatgagtggcatgacagcgtgtctgggaagaagtttcctgtgttcaacccagccacagaggaggagctgtgccaggtggaggagggggacaaggaggatgtggacaaggctgtgaaggccgcccggcaggccttccagatcggcagcccctggaggaccatggatgccagcgagcggggccgcctgctgtacaagctggccgacctgattgaaagagaccggctgctgctggccaccatggagagcatgaatggaggcaagctgtacagcaatgcctacctgaatgacctggccggctgcatcaagaccctgcgctactgtgccggctgggccgacaagatccagggccgcaccatccccattgatggcaacttcttcacctacaccaggcatgagcccatcggcgtgtgtggccagatcatcccctggaacttccccctggtgatgctgatctggaagattggccctgccctgagctgtggcaacacagtggtggtgaagccagctgagcagacccccctgacagccctgcacgtggccagcctcatcaaggaggccggcttccccccaggagtggtgaacatcgtgcccggctacggccccacagctggagctgccatcagcagccacatggacatcgacaaggtggccttcaccggcagcacagaggtgggcaagctgatcaaggaggccgccggcaagagcaacctgaagagggtgaccctggagctgggcggcaagagcccctgcatcgtgctggctgatgctgacctggacaatgctgtggagtttgcccaccacggcgtcttctaccaccagggccagtgctgcatcgccgccagccgcatctttgtggaggagagcatctatgatgaatttgtgagaagatctgtggagcgggccaagaagtacatcctgggcaaccccctgaccccaggagtgacccagggcccccagattgacaaggagcagtatgacaagatcctggacctgattgagagcggcaagaaggagggcgccaagctggagtgtggcggcggcccctggggcaacaagggctactttgtgcagcccaccgtcttcagcaatgtgacagatgagatgagaattgccaaggaggagatcttcggccctgtgcagcagatcatgaagttcaagagcctggatgatgtgatcaagagggccaacaacaccttctacggcctgtctgctggggtcttcaccaaggacatcgacaaggccatcaccatcagcagcgccctgcaggccggcaccgtgtgggtgaactgctatggagtggtgtctgcccagtgcccctttggaggcttcaagatgtctggaaatggccgggagctgggggagtatggcttccacgagtacacagaggtgaagacagtgacagtgaagatcagccagaagaacagctag

SEQ ID NO: 143177 - DNA, 693 bp, Artificial Sequence
  Description of Artificial Sequence: Synthetic coding sequence
atgagcagcagcggcaccccagacctgcctgtgctgctgacagacctgaagatccagtacaccaagatcttcatcaacaatgagtggcatgacagcgtgtctgggaagaagtttcctgtgttcaacccagccacagaggaggagctgtgccaggtggaggagggggacaaggaggatgtggacaaggctgtgaaggccgcccggcaggccttccagatcggcagcccctggaggaccatggatgccagcgagcggggccgcctgctgtacaagctggccgacctgattgaaagagaccggctgctgctggccaccatggagagcatgaatggaggcaagctgtacagcaatgcctacctgaatgacctggccggctgcatcaagaccctgcgctactgtgccggctgggccgacaagatccagggccgcaccatccccattgatggcaacttcttcacctacaccaggcatgagcccatcggcgtgtgtggccagatcatcccctggaacttccccctggtgatgctgatctggaagattggccctgccctgagctgtggcaacacagtggtggtgaagccagctgagcagacccccctgacagccctgcacgtggccagcctcatcaaggaggccggcttccccccaggagtggtgaacatcgtgcccggctatggagcctctgtggtgtag

SEQ ID NO: 143178 - DNA, 717 bp, Artificial Sequence
  Description of Artificial Sequence: Synthetic coding sequence
atgagcagcagcggcaccccagacctgcctgtgctgctgacagacctgaagatccagtacaccaagatcttcatcaacaatgagtggcatgacagcgtgtctgggaagaagtttcctgtgttcaacccagccacagaggaggagctgtgccaggtggaggagggggacaaggaggatgtggacaaggctgtgaaggccgcccggcaggccttccagatcggcagcccctggaggaccatggatgccagcgagcggggccgcctgctgtacaagctggccgacctgattgaaagagaccggctgctgctggccaccatggagagcatgaatggaggcaagctgtacagcaatgcctacctgaatgacctggccggctgcatcaagaccctgcgctactgtgccggctgggccgacaagatccagggccgcaccatccccattgatggcaacttcttcacctacaccaggcatgagcccatcggcgtgtgtggccagatcatcccctggaacttccccctggtgatgctgatctggaagattggccctgccctgagctgtggcaacacagtggtggtgaagccagctgagcagacccccctgacagccctgcacgtggccagcctcatcaaggaggccggcttccccccaggagtggtgaacatcgtgcccggctacggccccacagctggagctgccatcagcagccacatggactag

SEQ ID NO: 143179 - DNA, 990 bp, Artificial Sequence
  Description of Artificial Sequence: Synthetic coding sequence
attgctgagcctgtgacctgtgtgcctggagctgagagcgagatgagcagcagcggcaccccagacctgcctgtgctgctgacagacctgaagatccagtacaccaagatcttcatcaacaatgagtggcatgacagcgtgtctgggaagaagtttcctgtgttcaacccagccacagaggaggagctgtgccaggtggaggagggggacaaggaggatgtggacaaggctgtgaaggccgcccggcaggccttccagatcggcagcccctggaggaccatggatgccagcgagcggggccgcctgctgtacaagctggccgacctgattgaaagagaccggctgctgctggccaccatggagagcatgaatggaggcaagctgtacagcaatgcctacctgaatgacctggccggctgcatcaagaccctgcgctactgtgccggctgggccgacaagatccagggccgcaccatccccattgatggcaacttcttcacctacaccaggcatgagcccatcggcgtgtgtggccagatcatcccctggaacttccccctggtgatgctgatctggaagattggccctgccctgagctgtggcaacacagtggtggtgaagccagctgagcagacccccctgacagccctgcacgtggccagcctcatcaaggaggccggcttccccccaggagtggtgaacatcgtgcccggctacggccccacagctggagctgccatcagcagccacatggacatcgacaaggtggccttcaccggcagcacagaggtgggcaagctgatcaaggaggccgccggcaagagcaacctgaagagggtgaccctggagctgggcggcaagagcccctgcatcgtgctggctgatgctgacctggacaatgctgtggagtttgcccaccacggcgtcttctaccaccagggccagtgctgcatcgccgccagccgcttctgtggccgcatcaacctgtag

SEQ ID NO: 143180 - DNA, 612 bp, Artificial Sequence
  Description of Artificial Sequence: Synthetic coding sequence
atgagcagcagcggcaccccagacctgcctgtgctgctgacagacctgaagatccagtacaccaagatcttcatcaacaatgagtggcatgacagcgtgtctgggaagaagtttcctgtgttcaacccagccacagaggaggagctgtgccaggtggaggagggggacaaggaggatgtggacaaggctgtgaaggccgcccggcaggccttccagatcggcagcccctggaggaccatggatgccagcgagcggggccgcctgctgtacaagctggccgacctgattgaaagagaccggctgctgctggccaccatggagagcatgaatggaggcaagctgtacagcaatgcctacctgaatgacctggccggctgcatcaagaccctgcgctactgtgccggctgggccgacaagatccagggccgcaccatccccattgatggcaacttcttcacctacaccaggcatgagcccatcggcgtgtgtggccagatcatcccctggaacttccccctggtgatgctgatctggaagattggccctgccctgagctgtggcaacacagtggtggtgaagccagctgagcagacccccctgacagccctgtag

SEQ ID NO: 143181 - DNA, 1557 bp, Artificial Sequence
  Description of Artificial Sequence: Synthetic coding sequence
atgaccagcagcaagattgagatgcctggagaggtgaaggctgaccctgctgccctgatggccagcctgcacctgctgcccagccccacccccaacctggagatcaagtacaccaagatcttcatcaacaatgagtggcagaacagcgagagcggccgggtcttccctgtgtacaacccagccaccggggagcaggtgtgtgaggtgcaggaggccgacaaggctgacatcgacaaggctgtgcaggccgcccggctggccttcagcctgggctctgtgtggaggaggatggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggccggcttccccccaggagtcatcaacatcctgcccggctacggccccacagctggggccgccatcgccagccacatcggcatcgacaagatcgccttcaccggcagcacagaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgcggcgctctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatctttggacctgtgcaggagatcctgcgcttcaagaccatggatgaggtgattgagcgggccaacaacagcgactttggcctggtggccgctgtgttcaccaatgacatcaacaaggccctgactgtgagcagcgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143182 - DNA, 1443 bp, Artificial Sequence
  Description of Artificial Sequence: Synthetic coding sequence
atgaccagcagcaagattgagatgcctggagaggtgaaggctgaccctgctgccctgatggccagcctgcacctgctgcccagccccacccccaacctggagatcaagtacaccaagatcttcatcaacaatgagtggcagaacagcgagagcggccgggtcttccctgtgtacaacccagccaccggggagcaggtgtgtgaggtgcaggaggccgacaaggctgacatcgacaaggctgtgcaggccgcccggctggccttcagcctgggctctgtgtggaggaggatggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgcggcgctctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatctttggacctgtgcaggagatcctgcgcttcaagaccatggatgaggtgattgagcgggccaacaacagcgactttggcctggtggccgctgtgttcaccaatgacatcaacaaggccctgactgtgagcagcgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143183 - DNA, 1494 bp, Artificial Sequence
  Description of Artificial Sequence: Synthetic coding sequence
atgaagaaccagtgtgaaacagtgtggctgaagagccccatcaagctgaagctgatcttcatcaacaatgagtggcagaacagcgagagcggccgggtcttccctgtgtacaacccagccactggagagcaggtgtgtgaggtgcaggaggccgacaaggctgacatcgacaaggctgtgcaggccgcccggctggccttcagcctgggctctgtgtggaggaggatggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggccggcttccccccaggagtcatcaacatcctgcccggctacggccccacagctggagctgccatcgccagccacatcggcatcgacaagatcgccttcaccggcagcacagaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgagaagatctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatcttcggccctgtgcaggagatcctgcgcttcaagaccatggatgaagtcatcgagcgggccaacaacagcgactttggcctggtggccgctgtgttcaccaatgacatcaacaaggccctgactgtgtcctctgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143184 - DNA, 1470 bp, Artificial Sequence
  Description of Artificial Sequence: Synthetic coding sequence
atgaagggcaagaactgcaatgatgtgaagatcttcatcaacaatgagtggcagaacagcgagagcggccgggtcttccctgtgtacaacccagccactggagagcaggtgtgtgaggtgcaggaggccgacaaggctgacatcgacaaggctgtgcaggccgcccggctggccttcagcctgggctctgtgtggaggaggatggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggccggcttccccccaggagtcatcaacatcctgcccggctacggccccacagctggagctgccatcgccagccacatcggcatcgacaagatcgccttcaccggcagcacagaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgagaagatctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatcttcggccctgtgcaggagatcctgcgcttcaagaccatggatgaagtcatcgagcgggccaacaacagcgactttggcctggtggccgctgtgttcaccaatgacatcaacaaggccctgactgtgtcctctgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143185 - DNA, 30 bp, Artificial Sequence
  Description of Artificial Sequence: Synthetic coding sequence
atggatgccagcgagcggggccgcctgtag

SEQ ID NO: 143186 - DNA, 1470 bp, Artificial Sequence
  Description of Artificial Sequence: Synthetic coding sequence
atgaagggcaggaactggaagaccaccaagatcttcatcaacaatgagtggcagaacagcgagagcggccgggtcttccctgtgtacaacccagccactggagagcaggtgtgtgaggtgcaggaggccgacaaggctgacatcgacaaggctgtgcaggccgcccggctggccttcagcctgggctctgtgtggaggaggatggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggccggcttccccccaggagtcatcaacatcctgcccggctacggccccacagctggagctgccatcgccagccacatcggcatcgacaagatcgccttcaccggcagcacagaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgagaagatctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatcttcggccctgtgcaggagatcctgcgcttcaagaccatggatgaagtcatcgagcgggccaacaacagcgactttggcctggtggccgctgtgttcaccaatgacatcaacaaggccctgactgtgtcctctgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143187 - DNA, 78 bp, Artificial Sequence
  Description of Artificial Sequence: Synthetic coding sequence
atggatgccagcgagcggggccgcctgctggacaagctggccgacctggtggagcgggacagagctgtgctggcctag

SEQ ID NO: 143188 - DNA, 1269 bp, Artificial Sequence
  Description of Artificial Sequence: Synthetic coding sequence
atggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggccagatcatcccctggaacttccccctgctgatgtttgcctggaagatcgccccagccctgtgctgcggcaacacagtggtgatcaagccagctgagcagacccccctgagcgccctgtacatgggcgccctgatcaaggaggccggcttccccccaggagtcatcaacatcctgcccggctacggccccacagctggggccgccatcgccagccacatcggcatcgacaagatcgccttcaccggcagcacagaggtgggcaagctgatccaggaggccgccggccgcagcaacctgaagagggtgaccctggagctgggcggcaagagccccaacatcatctttgctgatgctgacctggactatgctgtggagcaggcccaccagggcgtcttcttcaaccagggccagtgctgcacagctggcagccgcatctttgtggaggagagcatctatgaggagtttgtgcggcgctctgtggagcgggccaagagaagagtggtgggcagcccctttgaccccaccacagagcagggcccccagattgacaagaagcagtacaacaagatcctggagctgatccagagcggcgtggccgagggcgccaagctggagtgtggcggcaagggcctgggcaggaagggcttcttcatcgagcccaccgtcttcagcaatgtgacagatgacatgagaattgccaaggaggagatctttggacctgtgcaggagatcctgcgcttcaagaccatggatgaggtgattgagcgggccaacaacagcgactttggcctggtggccgctgtgttcaccaatgacatcaacaaggccctgactgtgagcagcgccatgcaggccggcaccgtgtggatcaactgctacaatgccctgaatgcccagagcccctttggaggcttcaagatgtctggaaatggccgggagatgggagaatttggcctgcgggagtacagcgaggtgaagacagtgacagtgaagatcccccagaagaacagctag

SEQ ID NO: 143189 - DNA, 258 bp, Artificial Sequence
  Description of Artificial Sequence: Synthetic coding sequence
atggatgccagcgagcggggccgcctgctggacaagctggccgacctggtggagcgggacagagctgtgctggccaccatggagagcctgaatggaggcaagcccttcctgcaggccttctacgtggacctgcagggcgtcatcaagaccttccgctactatgccggctgggccgacaagatccacggcatgaccatccctgtggatggagactacttcaccttcaccaggcatgagcccatcggcgtgtgtggctag

SEQ ID NO: 143190 - DNA, 1539 bp, Artificial Sequence
  Description of Artificial Sequence: Synthetic coding sequence
atggccacagccaatggagctgtggagaatggccagcctgacaggaagcccccagccctgccccggcccatccggaacctggaggtgaagttcaccaagatcttcatcaacaatgagtggcatgagagcaagagcggcaagaagtttgccacctgcaaccccagcacccgggagcagatctgtgaggtggaggagggggacaagccagatgtggacaaggctgtggaggccgcccaggtggccttccagaggggcagcccctggaggcggctggatgccctgagccggggccgcctgctgcaccagctggccgacctggtggagcgggaccgggccaccctggccgccctggagaccatggacaccgggaagcccttcctgcacgccttcttcatcgacctggagggctgcatccgcaccctgcgctactttgctggctgggccgacaagatccagggcaagaccatccccacagatgacaacgtggtgtgcttcaccaggcatgagcccatcggcgtgtgtggggccatcaccccctggaacttccccctgctgatgctggtgtggaagctggccccagccctgtgctgcggcaacaccatggtgctgaagccagctgagcagacccccctgacagccctgtacctgggcagcctcatcaaggaggccggcttccccccaggagtggtgaacatcgtgcccggcttcggccccaccgtgggcgccgccatcagcagccacccccagatcaacaagatcgccttcaccggcagcacagaggtgggcaagctggtgaaggaggccgccagccgcagcaacctgaagagggtgaccctggagctgggcggcaagaacccctgcatcgtgtgtgctgatgctgacctggacctggccgtggagtgtgcccaccagggcgtcttcttcaaccagggccagtgctgcacagctgccagccgggtgtttgtggaggagcaggtgtacagcgagtttgtgcggcgctctgtggagtatgccaagaagaggcctgtgggggacccctttgatgtgaagacagagcagggcccccagattgaccagaagcagtttgacaagatcctggagctgattgaaagtggcaagaaggagggcgccaagctggagtgtggcggcagcgccatggaggacaagggcctcttcatcaagcccaccgtcttcagcgaggtgacagacaacatgagaattgccaaggaggagatctttggacctgtgcagcccatcctgaagttcaagagcattgaggaggtgatcaagagggccaacagcacagattatggcctgacagctgctgtgttcaccaagaacctggacaaggccctgaagctggccagcgccctggagagcggcaccgtgtggatcaactgctacaatgccctgtatgcccaggccccctttggaggcttcaagatgtctggaaatggccgggagctgggggagtatgccctggccgagtacacagaggtgaagacagtgaccatcaagctgggggacaagaacccctag

SEQ ID NO: 143191 - DNA, 456 bp, Artificial Sequence
  Description of Artificial Sequence: Synthetic coding sequence
atggccacagccaatggagctgtggagaatggccagcctgacaggaagcccccagccctgccccggcccatccggaacctggaggtgaagttcaccaagatcttcatcaacaatgagtggcatgagagcaagagcggcaagaagtttgccacctgcaaccccagcacccgggagcagatctgtgaggtggaggagggggacaagccagatgtggacaaggctgtggaggccgcccaggtggccttccagaggggcagcccctggaggcggctggatgccctgagccggggccgcctgctgcaccagctggccgacctggtggagcgggaccgggccaccctggccgccctggagaccatggacaccgggaagcccttcctgcacgccttcttcatcgacctggagggctgcatccgcaccctgcggctcatcaagagcagcagcaccaagagctag

SEQ ID NO: 143192 - DNA, 1554 bp, Artificial Sequence
  Description of Artificial Sequence: Synthetic coding sequence
atgctgcgcttcctggccccccggctgctgagcctgcagggccgcacagcccgctacagcagcgctgctgccctgcccagccccatcctgaacccagacatcccctacaaccagctgttcatcaacaatgagtggcaggatgctgtgtccaagaagaccttccccaccgtgaaccccaccactggagaggtgattggacatgtggccgagggggacagagcagatgtggacagagctgtgaaggccgcccgggaggccttccggctgggcagcccctggaggaggatggatgccagcgagcggggccgcctgctgaaccggctggccgacctggtggagcgggacagagtgtacctggccagcctggagaccctggacaatggcaagcccttccaggagagctatgccctggacctggatgaggtgatcaaggtgtaccgctactttgctggctgggccgacaagtggcacggcaagaccatccccatggatggccagcacttctgcttcaccaggcatgagcctgtgggcgtgtgtggccagatcatcccctggaacttccccctggtgatgcagggctggaagctggccccagccctggccaccggcaacacagtggtgatgaaggtggccgagcagacccccctgagcgccctgtacctggccagcctcatcaaggaggccggcttccccccaggagtggtgaacatcatcaccggctacggccccacagctggagctgccatcgcccagcacgtggatgtggacaaggtggccttcaccggcagcacagaggtgggccacctgatccagaaggccgccggggacagcaacctgaagagggtgaccctggagctgggcggcaagagccccagcatcgtgctggctgatgctgacatggagcacgctgtggagcagtgccacgaggccctcttcttcaacatgggccagtgctgctgtgccggcagcaggacctttgtggaggagagcatctacaatgagttcctggagaggacagtggagaaggccaagcagaggaaggtgggcaacccctttgagctggacacccagcagggcccccaggtggacaaggagcagtttgagcgggtgctgggctacatccagctgggccagaaggagggcgccaagctgctgtgtggcggggagagatttggagagcggggcttcttcatcaagcccaccgtgtttggaggagtgcaggatgacatgagaattgccaaggaggagatcttcggccctgtgcagcccctcttcaagttcaagaagattgaggaggtggtggagcgggccaacaacaccaggtatggcctggccgctgctgtgttcacccgggacctggacaaggccatgtacttcacccaggccctgcaggccggcaccgtgtgggtgaacacctacaacatcgtgacctgccacaccccatttggaggcttcaaggagagcggaaatggccgggagctgggggaggatggcctgaaggcctacacagaggtgaagacagtgaccatcaaggtgccccagaagaacagctag

SEQ ID NO: 143193 - DNA, 657 bp, Artificial Sequence
  Description of Artificial Sequence: Synthetic coding sequence
atggagcacgctgtggagcagtgccacgaggccctcttcttcaacatgggccagtgctgctgtgccggcagcaggacctttgtggaggagagcatctacaatgagttcctggagaggacagtggagaaggccaagcagaggaaggtgggcaacccctttgagctggacacccagcagggcccccaggtggacaaggagcagtttgagcgggtgctgggctacatccagctgggccagaaggagggcgccaagctgctgtgtggcggggagagatttggagagcggggcttcttcatcaagcccaccgtgtttggaggagtgcaggatgacatgagaattgccaaggaggagatctttggacctgtgcagcccctcttcaagttcaagaagattgaggaggtggtggagcgggccaacaacaccaggtatggcctggccgctgctgtgttcacccgggacctggacaaggccatgtacttcacccaggccctgcaggccggcaccgtgtgggtgaacacctacaacatcgtgacctgccacaccccatttggaggcttcaaggagagcggaaatggccgggagctgggagaagatggcctgaaggcctacacagaggtgaagacagtgaccatcaaggtgccccagaagaacagctag

SEQ ID NO: 143194 - DNA, 2739 bp, Artificial Sequence
  Description of Artificial Sequence: Synthetic coding sequence
atggccggccccagcaaccccccagccaccatgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgatgacacagtgtccaccctgtacaaccgcttcctgtttcctgagggcatcaagggcatggtgcaggccgtgcggctgattgctgagggcaaggccccccggctgccccagcctgaggagggcgccacctatgagggcatccagaagaaggagacagccaagatcaactgggaccagcctgctgaggccatccacaactggatcagaggaaatgacaaggtgcctggggcctggacagaggcctgtgagcagaagctgaccttcttcaacagcaccctgaacaccagcggcctggtgcctgaaggagatgccctgcccatccctggggcccacaggcctggggtggtgaccaaggccggcctcatcctgtttggaaatgatgacaagatgctgctggtgaagaacatccagctggaggatggcaagatgatcctggccagcaacttcttcaagggagctgccagctctgtgctggagctgacagaagctgagctggtgacagctgaggccgtgcgctctgtgtggcagaggatcctgcccaaggtgctggaggtggaggacagcacagacttcttcaagagcggggccgcctctgtggatgtggtgcggctggtggaggaggtgaaggagctgtgtgatggcctggagctggagaatgaagatgtgtacatggccagcaccttcggggacttcatccagctgctggtgaggaagctgcggggagatgatgaggagggagaatgttccattgattatgtggagatggctgtgaacaagaggacagtgaggatgccccaccagctgttcatcggcggggagtttgtggatgctgagggcgccaagaccagcgagaccatcaaccccacagatggcagcgtcatctgccaggtgtccctggcccaggtgacagatgtggacaaggctgtggccgccgccaaggatgcctttgaaaatggccgctggggcaagatcagcgcccgggaccggggccgcctgatgtaccgcctggccgacctgatggagcagcaccaggaggagctggccaccatcgaggccctggatgctggagctgtgtacaccctggccctgaagacccacgtgggcatgagcatccagaccttccgctactttgctggctggtgtgacaagatccagggcagcaccatccccatcaaccaggcccggcccaacagaaacctgaccctgaccaggaaggagcctgtgggcgtgtgtggcatcatcatcccctggaactaccccctgatgatgctgtcctggaagacagctgcctgcctggccgccggcaacacagtggtgatcaagccagcccaggtgacccccctgacagccctgaagtttgctgagctgaccctgaaggccggcatccccaagggcgtggtgaatgtgctgcccggcagcggcagcctggtgggccagaggctgagtgaccacccagatgtgaggaagattggcttcaccggcagcacagaggtgggcaagcacatcatgaagagctgtgccatcagcaatgtgaagaaggtgtccctggagctgggcggcaagagccccctcatcatctttgctgactgtgacctgaacaaggctgtgcagatgggcatgagcagcgtcttcttcaacaagggggagaactgcatcgccgccggccgcctgtttgtggaggacagcatccatgatgaatttgtgagaagagtggtggaggaggtgaggaagatgaaggtgggcaaccccctggaccgggacacagaccacggcccccagaaccaccacgcccacctggtgaagctgatggagtactgccagcacggcgtgaaggagggcgccaccctggtgtgtggcggcaaccaggtgccccggcccggcttcttctttgagcccaccgtcttcacagatgtggaggaccacatgttcatcgccaaggaggagagctttggacctgtgatgatcatcagcagatttgctgatggagacctggatgctgtgctgagccgggccaatgccacagaatttggcctggccagcggggtcttcacccgggacatcaacaaggccctgtatgtgtctgacaagctgcaggccggcaccgtgtttgtgaacacctacaacaagacagatgtggccgccccctttggaggcttcaagcagagcggctttgggaaggacctgggggaggccgccctgaatgagtacctgcgggtgaagacagtgacctttgagtactag

SEQ ID NO: 143195 - DNA, 1518 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgatgacacagtgtccaccctgtacaaccgcttcctgtttcctgagggcatcaagggcatggtgcaggccgtgcggctgattgctgagggcaaggccccccggctgccccagcctgaggagggcgccacctatgagggcatccagaagaaggagacagccaagatcaactgggaccagcctgctgaggccatccacaactggatcagaggaaatgacaaggtgcctggggcctggacagaggcctgtgagcagaagctgaccttcttcaacagcaccctgaacaccagcggcctggtgcctgaaggagatgccctgcccatccctggggcccacaggcctggggtggtgaccaaggccggcctcatcctgtttggaaatgatgacaagatgctgctggtgaagaacatccagctggaggatggcaagatgatcctggccagcaacttcttcaagggagctgccagctctgtgctggagctgacagaagctgagctggtgacagctgaggccgtgcgctctgtgtggcagaggatcctgcccaaggtgctggaggtggaggacagcacagacttcttcaagagcggggccgcctctgtggatgtggtgcggctggtggaggaggtgaaggagctgtgtgatggcctggagctggagaatgaagatgtgtacatggccagcaccttcggggacttcatccagctgctggtgaggaagctgcggggagatgatgaggagggagaatgttccattgattatgtggagatggctgtgaacaagaggacagtgaggatgccccaccagctgttcatcggcggggagtttgtggatgctgagggcgccaagaccagcgagaccatcaaccccacagatggcagcgtcatctgccaggtgtccctggcccaggtgacagatgtggacaaggctgtggccgccgccaaggatgcctttgaaaatggccgctggggcaagatcagcgcccgggaccggggccgcctgatgtaccgggccccacccagccccagcaccaggccagaccccacagccacctag

SEQ ID NO: 143196 - DNA, 2709 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgatgacacagtgtccaccctgtacaaccgcttcctgtttcctgagggcatcaagggcatggtgcaggccgtgcggctgattgctgagggcaaggccccccggctgccccagcctgaggagggcgccacctatgagggcatccagaagaaggagacagccaagatcaactgggaccagcctgctgaggccatccacaactggatcagaggaaatgacaaggtgcctggggcctggacagaggcctgtgagcagaagctgaccttcttcaacagcaccctgaacaccagcggcctggtgcctgaaggagatgccctgcccatccctggggcccacaggcctggggtggtgaccaaggccggcctcatcctgtttggaaatgatgacaagatgctgctggtgaagaacatccagctggaggatggcaagatgatcctggccagcaacttcttcaagggagctgccagctctgtgctggagctgacagaagctgagctggtgacagctgaggccgtgcgctctgtgtggcagaggatcctgcccaaggtgctggaggtggaggacagcacagacttcttcaagagcggggccgcctctgtggatgtggtgcggctggtggaggaggtgaaggagctgtgtgatggcctggagctggagaatgaagatgtgtacatggccagcaccttcggggacttcatccagctgctggtgaggaagctgcggggagatgatgaggagggagaatgttccattgattatgtggagatggctgtgaacaagaggacagtgaggatgccccaccagctgttcatcggcggggagtttgtggatgctgagggcgccaagaccagcgagaccatcaaccccacagatggcagcgtcatctgccaggtgtccctggcccaggtgacagatgtggacaaggctgtggccgccgccaaggatgcctttgaaaatggccgctggggcaagatcagcgcccgggaccggggccgcctgatgtaccgcctggccgacctgatggagcagcaccaggaggagctggccaccatcgaggccctggatgctggagctgtgtacaccctggccctgaagacccacgtgggcatgagcatccagaccttccgctactttgctggctggtgtgacaagatccagggcagcaccatccccatcaaccaggcccggcccaacagaaacctgaccctgaccaggaaggagcctgtgggcgtgtgtggcatcatcatcccctggaactaccccctgatgatgctgtcctggaagacagctgcctgcctggccgccggcaacacagtggtgatcaagccagcccaggtgacccccctgacagccctgaagtttgctgagctgaccctgaaggccggcatccccaagggcgtggtgaatgtgctgcccggcagcggcagcctggtgggccagaggctgagtgaccacccagatgtgaggaagattggcttcaccggcagcacagaggtgggcaagcacatcatgaagagctgtgccatcagcaatgtgaagaaggtgtccctggagctgggcggcaagagccccctcatcatctttgctgactgtgacctgaacaaggctgtgcagatgggcatgagcagcgtcttcttcaacaagggggagaactgcatcgccgccggccgcctgtttgtggaggacagcatccatgatgaatttgtgagaagagtggtggaggaggtgaggaagatgaaggtgggcaaccccctggaccgggacacagaccacggcccccagaaccaccacgcccacctggtgaagctgatggagtactgccagcacggcgtgaaggagggcgccaccctggtgtgtggcggcaaccaggtgccccggcccggcttcttctttgagcccaccgtcttcacagatgtggaggaccacatgttcatcgccaaggaggagagctttggacctgtgatgatcatcagcagatttgctgatggagacctggatgctgtgctgagccgggccaatgccacagaatttggcctggccagcggggtcttcacccgggacatcaacaaggccctgtatgtgtctgacaagctgcaggccggcaccgtgtttgtgaacacctacaacaagacagatgtggccgccccctttggaggcttcaagcagagcggctttgggaaggacctgggggaggccgccctgaatgagtacctgcgggtgaagacagtgacctttgagtactag

SEQ ID NO: 143197 - DNA, 483 bp, Artificial Sequence
  Description of Artificial Sequence: Synthetic coding sequence
atggtgcaggccgtgcggctgattgctgagggcaaggccccccggctgccccagcctgaggagggcgccacctatgagggcatccagaagaaggagacagccaagatcaactgggaccagcctgctgaggccatccacaactggatcagaggaaatgacaaggtgcctggggcctggacagaggcctgtgagcagaagctgaccttcttcaacagcaccctgaacaccagcggcctggtgcctgaaggagatgccctgcccatccctggggcccacaggcctggggtggtgaccaaggccggcctcatcctgtttggaaatgatgacaagatggtgcgggcccggctgtgggtgacctgcctgctgaaggccacccacgcccctgtgctgggcctgcggccccacaggaagaccctgggcagcagcggggagaatggcaagaaccagacccaggagggcaccctgaccctcatctgcccctag

SEQ ID NO: 143198 - DNA, 507 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgatgacacagtgtccaccctgtacaaccgcttcctgtag

SEQ ID NO: 143199 - DNA, 2709 bp, Artificial Sequence; identical to SEQ ID NO: 143196
  Description of Artificial Sequence: Synthetic coding sequence

SEQ ID NO: 143200 - DNA, 474 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgactag

SEQ ID NO: 143201 - DNA, 534 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcatggcagcatcatctaccaccccagcctgctgcccaggcacagaggagccagcgccatcaactggaccctcatccatggagacaagaagggcggcttcagcatcttctgggcagatgatggcctggacacaggagacctgctgctgcagaaggaatgtgaggtgctgcctgatgacacagtgtccaccctgtacaaccgcttcctgtttcctgagggcatcaagggcatggtgtag

SEQ ID NO: 143202 - DNA, 303 bp, Artificial Sequence
  Description of Artificial Sequence: Synthetic coding sequence
atgaagattgctgtgattggccagagcctgtttggccaggaggtgtactgccacctgaggaaggagggccacgaggtggtgggcgtcttcaccgtgcctgacaaggatggcaaggctgaccccctgggcctggaggccgagaaggatggagtgcctgtgttcaagtacagccgctggagggccaagggccaggccctgcctgatgtggtggccaagtaccaggccctgggcgctgagctgaatgtgctgcccttctgcagccagttcatccccatggagatcatcagcgcccccaggcactag

SEQ ID NO: 143203 - DNA, 2409 bp, Artificial Sequence
  Description of Artificial Sequence: Synthetic coding sequence
atggccgccacccgggccggcccccgggcccgggagatcttcaccagcctggagtatggccctgtgcctgagagccacgcctgtgccctggcctggctggacacccaggaccgctgcctgggccactacgtgaatggcaagtggctgaagccagagcacaggaacagcgtgccctgccaggaccccatcaccggggagaacctggccagctgcctgcaggcccaggctgaagatgtggccgctgctgtggaggccgccaggatggccttcaagggctggagcgcccaccctggggtggtgcgggcccagcacctgacccggctggccgaggtgatccagaagcaccagaggctgctgtggaccctggagagcctggtgacaggccgggctgtgcgggaggtgagagatggagatgtgcagctggcccagcagctgctgcactaccacgccatccaggccagcacccaggaggaggccctggccggctgggagcccatgggcgtgattggcctcatcctgccccccaccttctccttcctggagatgatgtggaggatctgcccagccctggccgtgggctgcaccgtggtggccctggtgcccccagccagccctgcccccctgctgctggcccagctggccggggagctgggccccttccctggcatcctgaatgtgctgagcggccctgccagcctggtgcccatcctggccagccagcccggcatcaggaaggtggccttctgtggggcccctgaggagggccgggccctgcggcgcagcctggccggagaatgtgccgagctgggcctggccctgggcacagagagcctgctgctgctgacagacacagcagatgtggacagcgctgtggagggcgtggtggatgctgcctggagcgaccggggccctgggggcctgcggctgctgatccaggagagcgtgtgggatgaggccatgaggcggctgcaggagaggatgggccgcctgcggagcggccggggcctggatggagctgtggacatgggcgcccggggagctgctgcctgtgacctggtgcagagatttgtgcgggaggcccagagccagggcgcccaggtgttccaggccggagatgtgcccagcgagcggcccttctacccacccaccctggtgagcaacctgcccccagccagcccctgtgcccaggtggaggtgccctggcctgtggtggtggccagccccttcagaacagccaaggaggccctgctggtggccaacggcaccccccggggcggcagcgcctctgtgtggagcgagcggctgggccaggccctggagctgggctacggcctgcaggtgggcaccgtgtggatcaatgcccacggcctgcgggaccccagcgtgcccaccggcggctgcaaggagagcggctgctcctggcatggaggcccagatggcctgtatgagtacctgcggcccagcggcaccccagcccggctgagctgcctgagcaagaacctgaactatgacaccttcggcctggccgtgcccagcaccctgcctgctggccctgagatcggccccagccctgccccaccctacggcctgtttgtgggcggccgcttccaggcccctggggcccggagcagccggcccatccgggacagcagcggcaacctgcacggctacgtggccgagggcggggccaaggacatcagaggagctgtggaggccgcccaccaggccttccctggctgggccggccagagccctggggcccgggccgccctgctgtgggccctggccgccgccctggagaggaggaagagcaccctggccagccggctggagcggcagggcgctgagctgaaggctgctgaggccgaggtggagctgagcgcccggcggctgcgggcctggggcgcccgggtgcaggcccagggccacaccctgcaggtggccggcctgcggggccctgtgctgcggctgcgggagcccctgggcgtgctggccgtggtgtgcccagatgagtggcccctgctggcctttgtgtccctgctggccccagccctggcctacggcaacacagtggtgatggtgcccagcgctgcctgccccctgctggccctggaggtgtgccaggacatggccaccgtcttccctgctggcctggccaacgtggtgactggagaccgggaccacctgacccgctgcctggccctgcaccaggatgtgcaggccatgtggtactttggaagtgcccagggcagccagtttgtggagtgggccagcgctggcaacctgaagcctgtgtgggccagccggggctgcccccgggcctgggaccaggaggccgagggcgccggccctgagctgggcctgcgggtggcccggaccaaggccctgtggctgcccatgggagactag

SEQ ID NO: 143204 - DNA, 1914 bp, Artificial Sequence
  Description of Artificial Sequence: Synthetic coding sequence
atgggcgtcatcggcctcatcctgccccccaccttctccttcctggagatgatgtggaggatctgcccagccctggccgtgggctgcaccgtggtggccctggtgcccccagccagccctgcccccctgctgctggcccagctggccggggagctgggccccttccctggcatcctgaatgtgctgagcggccctgccagcctggtgcccatcctggccagccagcccggcatcaggaaggtggccttctgtggggcccctgaggagggccgggccctgcggcgcagcctggccggggagtgtgccgagctgggcctggccctgggcacagagagcctgctgctgctgacagacacagcagatgtggacagcgctgtggagggcgtggtggatgctgcctggagcgaccggggccctgggggcctgcggctgctgatccaggagagcgtgtgggatgaggccatgaggcggctgcaggagaggatgggccgcctgcggagcggccggggcctggatggagctgtggacatgggcgcccggggagctgctgcctgtgacctggtgcagagatttgtgcgggaggcccagagccagggcgcccaggtgttccaggccggagatgtgcccagcgagcggcccttctacccacccaccctggtgagcaacctgcccccagccagcccctgtgcccaggtggaggtgccctggcctgtggtggtggccagccccttcagaacagccaaggaggccctgctggtggccaacggcaccccccggggcggcagcgcctctgtgtggagcgagcggctgggccaggccctggagctgggctacggcctgcaggtgggcaccgtgtggatcaatgcccacggcctgcgggaccccagcgtgcccactggaggctgcaaggagagcggctgctcctggcacggcggcccagatggcctgtatgagtacctgcggcccagcggcaccccagcccggctgagctgcctgagcaagaacctgaactatgacaccttcggcctggccgtgcccagcaccctgcctgctggccctgagatcggccccagccctgccccaccctacggcctgtttgtgggcggccgcttccaggcccctggggcccggagcagccggcccatccgggacagcagcggcaacctgcacggctacgtggccgagggcggggccaaggacatcagaggagctgtggaggccgcccaccaggccttccctggctgggccggccagagccctggggcccgggccgccctgctgtgggccctggccgccgccctggagaggaggaagagcaccctggccagccggctggagcggcagggcgctgagctgaaggctgctgaggccgaggtggagctgagcgcccggcggctgcgggcctggggcgcccgggtgcaggcccagggccacaccctgcaggtggccggcctgcggggccctgtgctgcggctgcgggagcccctgggcgtgctggccgtggtgtgcccagatgagtggcccctgctggcctttgtgtccctgctggccccagccctggcctacggcaacacagtggtgatggtgcccagcgctgcctgccccctgctggccctggaggtgtgccaggacatggccaccgtcttccctgctggcctggccaacgtggtgactggagaccgggaccacctgacccgctgcctggccctgcaccaggatgtgcaggccatgtggtacttcggcagcgcccagggcagccagtttgtggagtgggccagcgctggcaacctgaagcctgtgtgggccagccggggctgcccccgggcctgggaccaggaggccgagggcgccggccctgagctgggcctgcgggtggcccggaccaaggccctgtggctgcccatgggagactag

SEQ ID NO: 143205 - DNA, 2256 bp, Artificial Sequence
  Description of Artificial Sequence: Synthetic coding sequence
atggccgccacccgggccggcccccgggcccgggagatcttcaccagcctggagtatggccctgtgcctgagagccacgcctgtgccctggcctggctggacacccaggaccgctgcctgggccactacgtgaatggcaagtggctgaagccagagcacaggaacagcgtgccctgccaggaccccatcaccggggagaacctggccagctgcctgcaggcccaggctgaagatgtggccgctgctgtggaggccgccaggatggccttcaagggctggagcgcccaccctggggtggtgcgggcccagcacctgacccggctggccgaggtgatccagaagcaccagaggctgctgtggaccctggagagcctggtgacaggccgggctgtgcgggaggtgagagatggagatgtgcagctggcccagcagctgctgcactaccacgccatccaggccagcacccaggaggaggccctggccggctgggagcccatgggcgtgattggcctcatcctgccccccaccttctccttcctggagatgatgtggaggatctgcccagccctggccgtgggctgcaccgtggtggccctggtgcccccagccagccctgcccccctgctgctggcccagctggccggggagctgggccccttccctggcatcctgaatgtgctgagcggccctgccagcctggtgcccatcctggccagccagcccggcatcaggaaggtggccttctgtggggcccctgagggcggcctgcggctgctgatccaggagagcgtgtgggatgaggccatgaggcggctgcaggagaggatgggccgcctgcggagcggccggggcctggatggagctgtggacatgggcgcccggggagctgctgcctgtgacctggtgcagagatttgtgcgggaggcccagagccagggcgcccaggtgttccaggccggagatgtgcccagcgagcggcccttctacccacccaccctggtgagcaacctgcccccagccagcccctgtgcccaggtggaggtgccctggcctgtggtggtggccagccccttcagaacagccaaggaggccctgctggtggccaacggcaccccccggggcggcagcgcctctgtgtggagcgagcggctgggccaggccctggagctgggctacggcctgcaggtgggcaccgtgtggatcaatgcccacggcctgcgggaccccagcgtgcccactggaggctgcaaggagagcggctgctcctggcacggcggcccagatggcctgtatgagtacctgcggcccagcggcaccccagcccggctgagctgcctgagcaagaacctgaactatgacaccttcggcctggccgtgcccagcaccctgcctgctggccctgagatcggccccagccctgccccaccctacggcctgtttgtgggcggccgcttccaggcccctggggcccggagcagccggcccatccgggacagcagcggcaacctgcacggctacgtggccgagggcggggccaaggacatcagaggagctgtggaggccgcccaccaggccttccctggctgggccggccagagccctggggcccgggccgccctgctgtgggccctggccgccgccctggagaggaggaagagcaccctggccagccggctggagcggcagggcgctgagctgaaggctgctgaggccgaggtggagctgagcgcccggcggctgcgggcctggggcgcccgggtgcaggcccagggccacaccctgcaggtggccggcctgcggggccctgtgctgcggctgcgggagcccctgggcgtgctggccgtggtgtgcccagatgagtggcccctgctggcctttgtgtccctgctggccccagccctggcctacggcaacacagtggtgatggtgcccagcgctgcctgccccctgctggccctggaggtgtgccaggacatggccaccgtcttccctgctggcctggccaacgtggtgactggagaccgggaccacctgacccgctgcctggccctgcaccaggatgtgcaggccatgtggtacttcggcagcgcccagggcagccagtttgtggagtgggccagcgctggcaacctgaagcctgtgtgggccagccggggctgcccccgggcctgggaccaggaggccgagggcgccggccctgagctgggcctgcgggtggcccggaccaaggccctgtggctgcccatgggagactag

SEQ ID NO: 143206 - DNA, 1920 bp, Artificial Sequence
  Description of Artificial Sequence: Synthetic coding sequence
atgaggactggagtcatcggcctcatcctgccccccaccttctccttcctggagatgatgtggaggatctgcccagccctggccgtgggctgcaccgtggtggccctggtgcccccagccagccctgcccccctgctgctggcccagctggccggggagctgggccccttccctggcatcctgaatgtgctgagcggccctgccagcctggtgcccatcctggccagccagcccggcatcaggaaggtggccttctgtggggcccctgaggagggccgggccctgcggcgcagcctggccggggagtgtgccgagctgggcctggccctgggcacagagagcctgctgctgctgacagacacagcagatgtggacagcgctgtggagggcgtggtggatgctgcctggagcgaccggggccctgggggcctgcggctgctgatccaggagagcgtgtgggatgaggccatgaggcggctgcaggagaggatgggccgcctgcggagcggccggggcctggatggagctgtggacatgggcgcccggggagctgctgcctgtgacctggtgcagagatttgtgcgggaggcccagagccagggcgcccaggtgttccaggccggagatgtgcccagcgagcggcccttctacccacccaccctggtgagcaacctgcccccagccagcccctgtgcccaggtggaggtgccctggcctgtggtggtggccagccccttcagaacagccaaggaggccctgctggtggccaacggcaccccccggggcggcagcgcctctgtgtggagcgagcggctgggccaggccctggagctgggctacggcctgcaggtgggcaccgtgtggatcaatgcccacggcctgcgggaccccagcgtgcccactggaggctgcaaggagagcggctgctcctggcacggcggcccagatggcctgtatgagtacctgcggcccagcggcaccccagcccggctgagctgcctgagcaagaacctgaactatgacaccttcggcctggccgtgcccagcaccctgcctgctggccctgagatcggccccagccctgccccaccctacggcctgtttgtgggcggccgcttccaggcccctggggcccggagcagccggcccatccgggacagcagcggcaacctgcacggctacgtggccgagggcggggccaaggacatcagaggagctgtggaggccgcccaccaggccttccctggctgggccggccagagccctggggcccgggccgccctgctgtgggccctggccgccgccctggagaggaggaagagcaccctggccagccggctggagcggcagggcgctgagctgaaggctgctgaggccgaggtggagctgagcgcccggcggctgcgggcctggggcgcccgggtgcaggcccagggccacaccctgcaggtggccggcctgcggggccctgtgctgcggctgcgggagcccctgggcgtgctggccgtggtgtgcccagatgagtggcccctgctggcctttgtgtccctgctggccccagccctggcctacggcaacacagtggtgatggtgcccagcgctgcctgccccctgctggccctggaggtgtgccaggacatggccaccgtcttccctgctggcctggccaacgtggtgactggagaccgggaccacctgacccgctgcctggccctgcaccaggatgtgcaggccatgtggtacttcggcagcgcccagggcagccagtttgtggagtgggccagcgctggcaacctgaagcctgtgtgggccagccggggctgcccccgggcctgggaccaggaggccgagggcgccggccctgagctgggcctgcgggtggcccggaccaaggccctgtggctgcccatgggagactag

SEQ ID NO: 143207 - DNA, 2382 bp, Artificial Sequence
  Description of Artificial Sequence: Synthetic coding sequence
atgctgagccaggtgtaccgctgtggcttccagcccttcaaccagcacctgctgccctgggtgaagtgcaccaccgtcttccgcagccactgcatccagcccagcgtcatcagacatgtgcgctcctggagcaacatccccttcatcaccgtgcccctgagcaggacccacggcaagagctttgcccacaggtctgagctgaagcacgccaagagaattgtggtgaagctgggcagcgctgtggtgaccagaggagatgaatgtggcctggccctgggccgcctggccagcatcgtggagcaggtgtctgtgctgcagaaccagggccgggagatgatgctggtgaccagcggggctgtggccttcggcaagcagaggctgcggcatgagatcctgctgagccagagcgtgcggcaggccctgcacagcggccagaaccagctgaaggagatggccatccctgtgctggaggcccgggcctgtgccgccgccggccagagcggcctgatggccctgtatgaggccatgttcacccagtacagcatctgtgccgcccagatcctggtgaccaacctggacttccatgatgagcagaagagaagaaacctgaatggcaccctgcacgagctgctgaggatgaacatcgtgcccatcgtgaacaccaatgatgctgtggtgcccccagctgagcccaacagcgacctgcagggcgtcatctctgtgaaggacaatgacagcctggccgcccggctggccgtggagatgaagacagacctgctgattgtgctgagtgatgtggagggcctgtttgacagccccccaggcagtgatgatgccaagctgattgacatcttctacccaggggaccagcagagcgtgaccttcggcaccaagagccgggtgggcatgggcggcatggaggccaaggtgaaggccgccctgtgggccctgcagggcggcacctctgtggtgattgccaacggcacccaccccaaggtgtctggccacgtgatcacagacatcgtggagggcaagaaggtgggcaccttcttcagcgaggtgaagccagctggccccaccgtggagcagcagggcgagatggcccggagcggcggccgcatgctggccaccctggagcctgagcagagagctgagatcatccaccacctggccgacctgctgacagaccagagagatgagatcctgctggccaacaagaaggacctggaggaggccgagggccgcctggccgcccccctgctgaagaggctgagcctgagcaccagcaagctgaacagcctggccatcggcctgcggcagattgctgccagcagccaggacagcgtgggccgggtgctgcggaggacccgcatcgccaagaacctggagctggagcaggtgacagtgcccatcggcgtgctgctggtgatctttgagagcaggccagactgcctgccccaggtggccgccctggccatcgccagcggaaatggcctgctgctgaagggcggcaaggaggccgcccacagcaaccgcatcctgcacctgctgacccaggaggccctgagcatccatggagtgaaggaggccgtgcagctggtgaacacccgggaggaggtggaggacctgtgccgcctggacaagatgattgacctgatcatcccccggggcagcagccagctggtgcgggacatccagaaggccgccaagggcatccctgtgatgggccacagcgagggcatctgccacatgtatgtggacagcgaggcctctgtggacaaggtgacccggctggtgcgggacagcaaatgtgagtacccagctgcctgcaatgccctggagaccctgctgatccaccgggacctgctgcggacccccctgtttgaccagatcatcgacatgctgcgggtggagcaggtgaagatccacgccggccccaagtttgccagctacctgaccttcagccccagcgaggtgaagagcctgaggacagaatatggagacctggagctgtgcatcgaggtggtggacaacgtgcaggatgccatcgaccacatccacaagtatggcagcagccacacagatgtgattgtgacagaagatgagaacacagctgagttcttcctgcagcacgtggacagcgcctgtgtgttctggaatgccagcacccgcttcagtgatggctacagatttggcctgggcgctgaggtgggcatcagcaccagccgcatccacgcccggggccctgtgggcctggagggcctgctgaccaccaagtggctgctgcggggcaaggaccacgtggtgtctgacttcagcgagcacggcagcctgaagtacctgcacgagaacctgcccatcccccagaggaacaccaactag

SEQ ID NO: 143208 - DNA, 2388 bp, Artificial Sequence
  Description of Artificial Sequence: Synthetic coding sequence
atgctgagccaggtgtaccgctgtggcttccagcccttcaaccagcacctgctgccctgggtgaagtgcaccaccgtcttccgcagccactgcatccagcccagcgtcatcagacatgtgcgctcctggagcaacatccccttcatcaccgtgcccctgagcaggacccacggcaagagctttgcccacaggtctgagctgaagcacgccaagagaattgtggtgaagctgggcagcgctgtggtgaccagaggagatgaatgtggcctggccctgggccgcctggccagcatcgtggagcaggtgtctgtgctgcagaaccagggccgggagatgatgctggtgaccagcggggctgtggccttcggcaagcagaggctgcggcatgagatcctgctgagccagagcgtgcggcaggccctgcacagcggccagaaccagctgaaggagatggccatccctgtgctggaggcccgggcctgtgccgccgccggccagagcggcctgatggccctgtatgaggccatgttcacccagtacagcatctgtgccgcccagatcctggtgaccaacctggacttccatgatgagcagaagagaagaaacctgaatggcaccctgcacgagctgctgaggatgaacatcgtgcccatcgtgaacaccaatgatgctgtggtgcccccagctgagcccaacagcgacctgcagggcgtgaatgtcatctctgtgaaggacaatgacagcctggccgcccggctggccgtggagatgaagacagacctgctgattgtgctgagtgatgtggagggcctgtttgacagccccccaggcagtgatgatgccaagctgattgacatcttctacccaggggaccagcagagcgtgaccttcggcaccaagagccgggtgggcatgggcggcatggaggccaaggtgaaggccgccctgtgggccctgcagggcggcacctctgtggtgattgccaacggcacccaccccaaggtgtctggccacgtgatcacagacatcgtggagggcaagaaggtgggcaccttcttcagcgaggtgaagccagctggccccaccgtggagcagcagggcgagatggcccggagcggcggccgcatgctggccaccctggagcctgagcagagagctgagatcatccaccacctggccgacctgctgacagaccagagagatgagatcctgctggccaacaagaaggacctggaggaggccgagggccgcctggccgcccccctgctgaagaggctgagcctgagcaccagcaagctgaacagcctggccatcggcctgcggcagattgctgccagcagccaggacagcgtgggccgggtgctgcggaggacccgcatcgccaagaacctggagctggagcaggtgacagtgcccatcggcgtgctgctggtgatctttgagagcaggccagactgcctgccccaggtggccgccctggccatcgccagcggaaatggcctgctgctgaagggcggcaaggaggccgcccacagcaaccgcatcctgcacctgctgacccaggaggccctgagcatccatggagtgaaggaggccgtgcagctggtgaacacccgggaggaggtggaggacctgtgccgcctggacaagatgattgacctgatcatcccccggggcagcagccagctggtgcgggacatccagaaggccgccaagggcatccctgtgatgggccacagcgagggcatctgccacatgtatgtggacagcgaggcctctgtggacaaggtgacccggctggtgcgggacagcaaatgtgagtacccagctgcctgcaatgccctggagaccctgctgatccaccgggacctgctgcggacccccctgtttgaccagatcatcgacatgctgcgggtggagcaggtgaagatccacgccggccccaagtttgccagctacctgaccttcagccccagcgaggtgaagagcctgaggacagaatatggagacctggagctgtgcatcgaggtggtggacaacgtgcaggatgccatcgaccacatccacaagtatggcagcagccacacagatgtgattgtgacagaagatgagaacacagctgagttcttcctgcagcacgtggacagcgcctgtgtgttctggaatgccagcacccgcttcagtgatggctacagatttggcctgggcgctgaggtgggcatcagcaccagccgcatccacgcccggggccctgtgggcctggagggcctgctgaccaccaagtggctgctgcggggcaaggaccacgtggtgtctgacttcagcgagcacggcagcctgaagtacctgcacgagaacctgcccatcccccagaggaacaccaactag

SEQ ID NO: 143209 - DNA, 1554 bp, Artificial Sequence
  Description of Artificial Sequence: Synthetic coding sequence
atgctgcgggctgctgcccgcttcggcccccggctgggccggcggctgctgtctgctgctgccacccaggccgtgcctgcccccaaccagcagcctgaggtgttctgcaaccagatcttcatcaacaatgagtggcatgatgctgtgtccaggaagaccttccccaccgtgaaccccagcactggagaggtgatctgccaggtggccgagggggacaaggaggatgtggacaaggctgtgaaggccgcccgggccgccttccagctgggcagcccctggaggaggatggatgccagccaccggggccgcctgctgaaccggctggccgacctgattgaaagagacaggacctacctggccgccctggagaccctggacaatggcaagccctacgtgatctcctacctggtggacctggacatggtgctgaagtgcctgcgctactatgccggctgggccgacaagtaccacggcaagaccatccccattgatggagacttcttctcctacaccaggcatgagcctgtgggcgtgtgtggccagatcatcccctggaacttccccctgctgatgcaggcctggaagctgggccctgccctggccactggaaatgtggtggtgatgaaggtggccgagcagacccccctgacagccctgtatgtggccaacctgatcaaggaggccggcttccccccaggagtggtgaacatcgtgcccggcttcggccccacagctggagctgccatcgccagccatgaagatgtggacaaggtggccttcaccggcagcacagagatcggccgggtcatccaggtggccgccggcagcagcaacctgaagagggtgaccctggagctgggcggcaagagccccaacatcatcatgtctgatgctgacatggactgggccgtggagcaggcccactttgccctcttcttcaaccagggccagtgctgctgtgccggcagcaggacctttgtgcaggaggacatctatgatgaatttgtggagaggtctgtggcccgggccaagagccgggtggtgggcaacccctttgacagcaagacagagcagggcccccaggtggatgagacccagttcaagaagatcctgggctacatcaacacaggcaagcaggagggcgccaagctgctgtgtggcggcggcattgctgctgaccggggctacttcatccagcccaccgtgtttggagatgtgcaggacggcatgaccatcgccaaggaggagatcttcggccctgtgatgcagatcctgaagttcaagaccatcgaggaggtggtgggccgggccaacaacagcacctacggcctggccgctgctgtgttcaccaaggacctggacaaggccaactacctgagccaggccctgcaggccggcaccgtgtgggtgaactgctatgatgtgtttggagcccagagcccctttggaggctacaagatgagcggcagcggccgggagctgggggagtatggcctgcaggcctacacagaggtgaagacagtgacagtgaaggtgccccagaagaacagctag

SEQ ID NO: 143210 - DNA, 1413 bp, Artificial Sequence
  Description of Artificial Sequence: Synthetic coding sequence
atgctgcgggctgctgcccgcttcggcccccggctgggccggcggctgctgtctgctgctgccacccaggccgtgcctgcccccaaccagcagcctgaggtgttctgcaaccagatcttcatcaacaatgagtggcatgatgctgtgtccaggaagaccttccccaccgtgaaccccagcactggagaggtgatctgccaggtggccgagggggacaaggccctggagaccctggacaacgggaagccctacgtgatctcctacctggtggacctggacatggtgctgaagtgcctgcgctactatgccggctgggccgacaagtaccacggcaagaccatccccattgatggagacttcttctcctacaccaggcatgagcctgtgggcgtgtgtggccagatcatcccctggaacttccccctgctgatgcaggcctggaagctgggccctgccctggccactggaaatgtggtggtgatgaaggtggccgagcagacccccctgacagccctgtatgtggccaacctgatcaaggaggccggcttccccccaggagtggtgaacatcgtgcccggcttcggccccacagctggggccgccatcgccagccatgaagatgtggacaaggtggccttcaccggcagcacagaaattggccgggtcatccaggtggccgccggcagcagcaacctgaagagggtgaccctggagctgggcggcaagagccccaacatcatcatgtctgatgctgacatggactgggccgtggagcaggcccactttgccctcttcttcaaccagggccagtgctgctgtgccggcagcaggacctttgtgcaggaggacatctatgatgaatttgtggagaggtctgtggcccgggccaagagccgggtggtgggcaacccctttgacagcaagacagagcagggcccccaggtggatgagacccagttcaagaagatcctgggctacatcaacacaggcaagcaggagggcgccaagctgctgtgtggcggcggcattgctgctgaccggggctacttcatccagcccaccgtgtttggagatgtgcaggacggcatgaccatcgccaaggaggagatctttggacctgtgatgcagatcctgaagttcaagaccatcgaggaggtggtgggccgggccaacaacagcacctacggcctggccgctgctgtgttcaccaaggacctggacaaggccaactacctgagccaggccctgcaggccggcaccgtgtgggtgaactgctatgatgtgtttggagcccagagcccctttggaggctacaagatgagcggcagcggccgggagctgggggagtatggcctgcaggcctacacagaggtgaagacagtgacagtgaaggtgccccagaagaacagctag

SEQ ID NO: 143211 - DNA, 1989 bp, Artificial Sequence
  Description of Artificial Sequence: Synthetic coding sequence
atgagaggagctggccccagcccccggcagagccccaggaccctgcggccagaccccggccctgccatgtccttcttccggaggaaggtgaagggcaaggagcaggagaagaccagtgatgtgaagagcatcaaggccagcatctctgtgcacagcccccagaagagcaccaagaaccacgccctgctggaggccgccggccccagccacgtggccatcaatgccatcagcgccaacatggacagcttcagcagcagcaggacagccaccctgaagaagcagcccagccacatggaggccgcccactttggagacctgggccgcagctgcctggactaccagacccaggagaccaagagcagcctgagcaagaccctggagcaggtgctgcatgacaccatcgtgctgccctacttcatccagttcatggagctgcggaggatggagcacctggtgaagttctggctggaggccgagagcttccacagcaccacctggagccgcatccgggcccacagcctgaacacagtgaagcagagcagcctggccgagcctgtgagccccagcaagaagcatgagaccacagccagcttcctgacagacagcctggacaagaggctggaggacagcggcagcgcccagctgttcatgacccacagcgagggcatcgacctgaacaacagaaccaacagcacccagaaccacctgctgctgagccaggagtgtgacagcgcccacagcctgcggctggagatggcccgggccggcacccaccaggtgtccatggagacccaggagagcagcagcaccctgactgtggccagcaggaacagccctgccagccccctgaaggagctgagcggcaagctgatgaagagcattgagcaggatgctgtgaacaccttcaccaagtacatcagcccagatgctgccaagcccatccccatcacagaggccatgagaaatgacatcatcgcccgcatctgtggagaagatggccaggtggaccccaactgctttgtgctggcccagagcatcgtgttttctgccatggagcaggagcacttcagcgagttcctgcggagccaccacttctgcaagtaccagatcgaggtgctgaccagcggcaccgtgtacctggccgacatcctcttctgtgagagcgccctcttctacttcagcgagtacatggagaaggaggatgctgtgaacatcctgcagttctggctggccgctgacaacttccagagccagctggccgccaagaagggccagtatgatggccaggaggcccagaatgatgccatgatcctgtatgacaagtacttcagcctgcaggccacccaccccctgggctttgatgatgtggtgcggctggagattgagagcaacatctgccgggagggcggccccctgcccaactgcttcaccacccccctgcggcaggcctggaccaccatggagaaggtgttcctgcccggcttcctgagcagcaacctgtactacaagtacctgaatgacctgatccacagcgtgagaggagatgagttcctgggcggcaatgtgtccctgacagcccctggctctgtgggccccccagatgagagccaccctggcagcagtgacagcagcgccagccagagctctgtgaagaaggccagcatcaagatcctgaagaactttgatgaggccatcatcgtggatgctgccagcctggaccctgagagcctgtaccagaggacctacgccggcaagatgaccttcggccgggtgtctgacctgggccagttcatccgggagagcgagcctgagccagatgtgaggaagagcaagggctccatgttcagccaggccatgaagaagtgggtgcagggcaacacagatgaggcccaggaggagctggcctggaagatcgccaagatgattgtgtctgacatcatgcagcaggcccagtatgaccagcccctggagaagagcaccaagctgtag

SEQ ID NO: 143212 - DNA, 1536 bp, Artificial Sequence
  Description of Artificial Sequence: Synthetic coding sequence
gaggtgcagaggaccccccaccccacctttgagtacttcttcttcctgagcaggaagctgcccggccaggagctgcagggcctgaatggccgggaggccggcagcctgaacaccagccccctgggcagctgccgcagccgcagccccagctaccgggagcggctgtgccagaggagacatgagcaggaccagaggggccgggaggcccggccccggcggctgcagggccgcacccggcccctgcagttccgcatccagcagctggaggccctgcagaggctcatccaggagcaggagcaggagctggtgggcgccctggccgctgacctgcacaagaatgagtggaatgcctactatgaggaggtggtgtatgtgctggaggagattgagtacatgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgctgctggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgccgccgcatcgcctggggcaagttcatgaacagcggccagacctgtgtggccccagactacatcctgtgtgaccccagcatccagaaccagatcgtggagaagctgaagaagagcctgaaggagttctacggggaggatgccaagaagagccgggactatggccgcatcatcagcgcccggcacttccagagggtgatgggcctcatcgagggccagaaggtggcctatggaggcactggagatgctgccacccgctacatcgcccccaccatcctgacagatgtggacccccagagccctgtgatgcaggaggagatcttcggccctgtgctgcccatcgtgtgtgtgcgcagcctggaggaggccatccagttcatcaaccagcgggagaagcccctggccctgtacatgttcagcagcaatgacaaggtgatcaagaagatgattgctgagaccagcagtggaggagtggccgccaatgatgtgattgtgcacatcaccctgcacagcctgccctttggaggagtgggcaacagcggcatgggcagctaccacggcaagaagagctttgagaccttcagccacagaagaagctgcctggtgcggcccctgatgaatgatgagggcctgaaggtgcgctacccacccagccctgccaagatgacccagcactag

SEQ ID NO: 143213 - DNA, 1170 bp, Artificial Sequence
  Description of Artificial Sequence: Synthetic coding sequence
atgagcaagatcagcgaggccgtgaagagggcccgggccgccttcagcagcggccgcacccggcccctgcagttccgcatccagcagctggaggccctgcagaggctcatccaggagcaggagcaggagctggtgggcgccctggccgctgacctgcacaagaatgagtggaatgcctactatgaggaggtggtgtatgtgctggaggagattgagtacatgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgctgctggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgccgccgcatcgcctggggcaagttcatgaacagcggccagacctgtgtggccccagactacatcctgtgtgaccccagcatccagaaccagatcgtggagaagctgaagaagagcctgaaggagatcttcggccctgtgctgcccatcgtgtgtgtgcgcagcctggaggaggccatccagttcatcaaccagcgggagaagcccctggccctgtacatgttcagcagcaatgacaaggtgatcaagaagatgattgctgagaccagcagtggaggagtggccgccaatgatgtgattgtgcacatcaccctgcacagcctgccctttggaggagtgggcaacagcggcatgggcagctaccacggcaagaagagctttgagaccttcagccacagaagaagctgcctggtgcggcccctgatgaatgatgagggcctgaaggtgcgctacccacccagccctgccaagatgacccagcactag

SEQ ID NO: 143214 - DNA, 693 bp, Artificial Sequence
  Description of Artificial Sequence: Synthetic coding sequence
atgagcaagatcagcgaggccgtgaagagggcccgggccgccttcagcagcggccgcacccggcccctgcagttccgcatccagcagctggaggccctgcagaggctcatccaggagcaggagcaggagctggtgggcgccctggccgctgacctgcacaagaatgagtggaatgcctactatgaggaggtggtgtatgtgctggaggagattgagtacatgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgctgctggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgcaggtag

SEQ ID NO: 143215 - DNA, 1119 bp, Artificial Sequence
  Description of Artificial Sequence: Synthetic coding sequence
atgagcaagatcagcgaggccgtgaagagggcccgggccgccttcagcagcggccgcacccggcccctgcagttccgcatccagcagctggaggccctgcagaggctcatccaggagcaggagcaggagctggtgggcgccctggccgctgacctgcacaagaatgagtggaatgcctactatgaggaggtggtgtatgtgctggaggagattgagtacatgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgctgctggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgccgccgcatcgcctggggcaagttcatgaacagcggccagacctgtgtggccccagactacatcctgtgtgaccccagcatccagaaccagatcgtggagaagctgaagaagagcctgaaggagttctacggggaggatgccaagaagagccgggactatggccgcatcatcagcgcccggcacttccagagggtgatgggcctcatcgagggccagaaggtggcctatggaggcactggagatgctgccacccgctacatcgcccccaccatcctgacagatgtggacccccagagccctgtgatgcaggaggagatcttcggccctgtgctgcccatcgtgtgtgtgcgcagcctggaggaggccatccagttcatcaaccagcgggagaagcccctggccctgtacatgttcagcagcaatgacaagtag

SEQ ID NO: 143216 - DNA, 1362 bp, Artificial Sequence
  Description of Artificial Sequence: Synthetic coding sequence
atgagcaagatcagcgaggccgtgaagagggcccgggccgccttcagcagcggccgcacccggcccctgcagttccgcatccagcagctggaggccctgcagaggctcatccaggagcaggagcaggagctggtgggcgccctggccgctgacctgcacaagaatgagtggaatgcctactatgaggaggtggtgtatgtgctggaggagattgagtacatgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgctgctggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgccgccgcatcgcctggggcaagttcatgaacagcggccagacctgtgtggccccagactacatcctgtgtgaccccagcatccagaaccagatcgtggagaagctgaagaagagcctgaaggagttctacggggaggatgccaagaagagccgggactatggccgcatcatcagcgcccggcacttccagagggtgatgggcctcatcgagggccagaaggtggcctatggaggcactggagatgctgccacccgctacatcgcccccaccatcctgacagatgtggacccccagagccctgtgatgcaggaggagatcttcggccctgtgctgcccatcgtgtgtgtgcgcagcctggaggaggccatccagttcatcaaccagcgggagaagcccctggccctgtacatgttcagcagcaatgacaaggtgatcaagaagatgattgctgagaccagcagtggaggagtggccgccaatgatgtgattgtgcacatcaccctgcacagcctgccctttggaggagtgggcaacagcggcatgggcagctaccacggcaagaagagctttgagaccttcagccacagaagaagctgcctggtgcggcccctgatgaatgatgagggcctgaaggtgcgctacccacccagccctgccaagatgacccagcactag

SEQ ID NO: 143217 - DNA, 1362 bp, Artificial Sequence; identical to SEQ ID NO: 143216
  Description of Artificial Sequence: Synthetic coding sequence

SEQ ID NO: 143218 - DNA, 1203 bp, Artificial Sequence
  Description of Artificial Sequence: Synthetic coding sequence
atgatccagaagctgcctgagtgggccgcagatgagcctgtggagaagaccccccagacccagcaggatgagctgtacatccacagcgagcccctgggcgtggtgctggtgattggcacctggaactaccccttcaacctgaccatccagcccatggtgggcgccatcgccgccggcaacagcgtggtgctgaagcccagcgagctgtctgagaacatggccagcctgctggccaccatcatcccccagtacctggacaaggacctgtaccctgtgatcaatggaggagtgcctgagaccacagagctgctgaaggagagatttgaccacatcctgtacacaggcagcactggagtgggcaagatcatcatgacagctgctgccaagcacctgacccctgtgaccctggagctgggcggcaagagcccctgctacgtggacaagaactgtgacctggatgtggcctgcagaagaattgcctggggcaagttcatgaacagcggccagacctgtgtggccccagactacatcctgtgtgaccccagcatccagaaccagatcgtggagaagctgaagaagagcctgaaggagttctatggagaagatgccaagaagagccgggactatggccgcatcatcagcgcccggcacttccagagggtgatgggcctgattgagggccagaaggtggcctacggcggcactggagatgctgccacccgctacatcgcccccaccatcctgacagatgtggacccccagagccctgtgatgcaggaggagatctttggacctgtgctgcccatcgtgtgtgtgcgcagcctggaggaggccatccagttcatcaaccagcgggagaagcccctggccctgtacatgttcagcagcaatgacaaggtgatcaagaagatgattgctgagaccagcagcggcggcgtggccgccaatgatgtgattgtgcacatcaccctgcacagcctgccctttggaggagtgggcaacagcggcatgggcagctaccacggcaagaagagctttgagaccttcagccaccggcgcagctgcctggtgcggcccctgatgaatgatgagggcctgaaggtgcgctacccacccagccctgccaagatgacccagcactggctgtcctggccctgggagaacagaagctgcagccccagccctgcccccctgctgtgctag

SEQ ID NO: 143219 - DNA, 1458 bp, Artificial Sequence
  Description of Artificial Sequence: Synthetic coding sequence
atggagctggaggtgcggcgggtgcggcaggccttcctgagcggccgcagccggcccctgcgcttccggctgcagcagctggaggccctgcggaggatggtgcaggagcgggagaaggacatcctgacagccatcgctgctgacctgtgcaagtctgagttcaacgtgtacagccaggaggtgatcaccgtgctgggggagattgacttcatgctggagaacctgcctgagtgggtgacagccaagcctgtgaagaagaatgtgctgaccatgctggatgaggcctacatccagccccagcccctgggcgtggtgctgatcatcggggcctggaactacccctttgtgctgaccatccagcccctgattggagccatcgctgctggaaatgctgtgatcatcaagcccagcgagctgtctgaaaatacagccaagatcctggccaagctgctgccccagtacctggaccaggacctgtacatcgtcatcaatggaggagtggaggagaccacagagctgctgaagcagagatttgaccacatcttctacacaggcaacacagctgtgggcaagatcgtgatggaggccgccgccaagcacctgacccctgtgaccctggagctgggcggcaagagcccctgctacatcgacaaggactgtgacctggacatcgtgtgccgccgcatcacctggggcaagtacatgaactgtggccagacctgcatcgccccagactacatcctgtgtgaggccagcctgcagaaccagatcgtgtggaagatcaaggagaccgtgaaggagttctatggagagaacatcaaggagagcccagactatgagcgcatcatcaacctgcggcacttcaagaggatcctgagcctgctggagggccagaagatcgccttcggcggggagacagatgaggccacccgctacatcgcccccaccgtgctgacagatgtggaccccaagaccaaggtgatgcaggaggagatcttcggccccatcctgcccatcgtgcctgtgaagaatgtggatgaggccatcaacttcatcaatgaaagagagaagcccctggccctgtatgtgttcagccacaaccacaagctgatcaagaggatgattgatgagaccagcagcggcggcgtgactggaaatgatgtgatcatgcacttcaccctgaacagcttcccctttggaggagtgggcagcagcggcatgggcgcctaccacggcaagcacagctttgacaccttcagccaccagaggccctgcctgctgaagagcctgaagcgggagggcgccaacaagctgcgctacccacccaacagccagagcaaggtggactggggcaagttcttcctgctgaagcgcttcaacaaggagaagctgggcctgctgctgctgaccttcctgggcatcgtggccgctgtgctggtgaaggccgagtactactag

SEQ ID NO: 143220 - DNA, 1527 bp, Artificial Sequence
  Description of Artificial Sequence: Synthetic coding sequence
atggagctggaggtgcggcgggtgcggcaggccttcctgagcggccgcagccggcccctgcgcttccggctgcagcagctggaggccctgcggaggatggtgcaggagcgggagaaggacatcctgacagccatcgctgctgacctgtgcaagtctgagttcaacgtgtacagccaggaggtgatcaccgtgctgggggagattgacttcatgctggagaacctgcctgagtgggtgacagccaagcctgtgaagaagaatgtgctgaccatgctggatgaggcctacatccagccccagcccctgggcgtggtgctgatcatcggggcctggaactacccctttgtgctgaccatccagcccctgattggagccatcgctgctggaaatgctgtgatcatcaagcccagcgagctgtctgaaaatacagccaagatcctggccaagctgctgccccagtacctggaccaggacctgtacatcgtcatcaatggaggagtggaggagaccacagagctgctgaagcagagatttgaccacatcttctacacaggcaacacagctgtgggcaagatcgtgatggaggccgccgccaagcacctgacccctgtgaccctggagctgggcggcaagagcccctgctacatcgacaaggactgtgacctggacatcgtgtgccgccgcatcacctggggcaagtacatgaactgtggccagacctgcatcgccccagactacatcctgtgtgaggccagcctgcagaaccagatcgtgtggaagatcaaggagaccgtgaaggagttctatggagagaacatcaaggagagcccagactatgagcgcatcatcaacctgcggcacttcaagaggatcctgagcctgctggagggccagaagatcgccttcggcggggagacagatgaggccacccgctacatcgcccccaccgtgctgacagatgtggaccccaagaccaaggtgatgcaggaggagatcttcggccccatcctgcccatcgtgcctgtgaagaatgtggatgaggccatcaacttcatcaatgaaagagagaagcccctggccctgtatgtgttcagccacaaccacaagctgatcaagaggatgattgatgagaccagcagcggcggcgtgactggaaatgatgtgatcatgcacttcaccctgaacagcttcccctttggaggagtgggcagcagcggcatgggcgcctaccacggcaagcacagctttgacaccttcagccaccagaggccctgcctgctgaagagcctgaagcgggagggcgccaacaagctgcgctacccacccaacagccagagcaaggtggactggggcaagttcttcctgctgaagcgcttcaacaaggagaagctgggcctgctgctgctgaccttcctgggcatcgtggccgctgtgctggtgaagaagtaccaggccgtgctgcggaggaaggccctgctgatcttcctggtggtgcaccggctgcgctggagcagcaagcagaggtag

SEQ ID NO: 143221 - DNA, 1458 bp, Artificial Sequence; identical to SEQ ID NO: 143219
  Description of Artificial Sequence: Synthetic coding sequence

SEQ ID NO: 143222 - DNA, 501 bp, Artificial Sequence
  Description of Artificial Sequence: Synthetic coding sequence
atggagctggaggtgcggcgggtgcggcaggccttcctgagcggccgcagccggcccctgcgcttccggctgcagcagctggaggccctgcggaggatggtgcaggagcgggagaaggacatcctgacagccatcgctgctgacctgtgcaagtctgagttcaacgtgtacagccaggaggtgatcaccgtgctgggggagattgacttcatgctggagaacctgcctgagtgggtgacagccaagcctgtgaagaagaatgtgctgaccatgctggatgaggcctacatccagccccagcccctgggcgtggtgctgatcatcggggcctggaactacccctttgtgctgaccatccagcccctgattggagccatcgctgctggaaatgctgtgatcatcaagcccagcgagctgtctgaaaatacagccaagatcctggccaagctgctgccccagtacctggaccaggacctgtacatcgtcatcaatggaggatag

SEQ ID NO: 143223 - DNA, 1158 bp, Artificial Sequence
  Description of Artificial Sequence: Synthetic coding sequence
atgaaggatgagcccaggagcaccaacctcttcatgaagctggacagcgtcttcatctggaaggagcccttcggcctggtgctgatcatcgccccctggaactaccccctgaacctgaccctggtgctgctggtgggcgccctggccgccggcagctgtgtggtgctgaagcccagcgagatcagccagggcacagagaaggtgctggccgaggtgctgccccagtacctggaccagagctgctttgctgtggtgctgggcggcccccaggagaccggccagctgctggagcacaagctggactacatcttcttcaccggcagcccccgggtgggcaagatcgtgatgacagctgccaccaagcacctgacccctgtgaccctggagctgggcggcaagaacccctgctacgtggatgacaactgtgacccccagacagtggccaacagagtggcctggttctgctacttcaatgccggccagacctgtgtggccccagactatgtgctgtgcagccctgagatgcaggagcggctgctgcctgccctgcagagcaccatcacccgcttctatggagatgacccccagagcagccccaacctgggccacatcatcaaccagaagcagttccagaggctgcgggccctgctgggctgcagccgggtggccatcggcggccagagcaatgaaagtgaccgctacatcgcccccaccgtgctggtggatgtgcaggagacagagcctgtgatgcaggaggagatcttcggccccatcctgcccatcgtgaatgtgcagagcgtggatgaggccatcaagttcatcaaccggcaggagaagcccctggccctgtatgccttcagcaacagcagccaggtggtgaaccagatgctggagaggaccagcagcggcagctttggaggaaatgaaggcttcacctacatcagcctgctgtctgtgccctttggaggagtgggccacagcggcatgggccgctaccacggcaagttcacctttgacaccttcagccaccacaggacctgcctgctggcccccagcggcctggagaagctgaaggagatccactacccaccctacacagactggaaccagcagctgctgcgctggggcatgggcagccagagctgcaccctgctgtag

SEQ ID NO: 143224 - DNA, 447 bp, Artificial Sequence
  Description of Artificial Sequence: Synthetic coding sequence
atgaaggatgagcccaggagcaccaacctcttcatgaagctggacagcgtcttcatctggaaggagcccttcggcctggtgctgatcatcgccccctggaactaccccctgaacctgaccctggtgctgctggtgggcgccctggccgccggcagctgtgtggtgctgaagcccagcgagatcagccagggcacagagaaggtgctggccgaggtgctgccccagtacctggaccagagctgctttgctgtggtgctgggcggcccccaggagaccggccagctgctggagcacaagctggactacatcttcttcaccggcagcccccgggtgggcaagatcgtgatgacagctgccaccaagcacctgacccctgtgaccctggagctgggcggcaagaacccctgctacgtggatgacaactgtgacccccagacagtggcctag

SEQ ID NO: 143225 - DNA, 288 bp, Artificial Sequence
  Description of Artificial Sequence: Synthetic coding sequence
atgaaggatgagcccaggagcaccaacctcttcatgaagctggacagcgtcttcatctggaaggagcccttcggcctggtgctgatcatcgccccctggaactaccccctgaacctgaccctggtgctgctggtgggcgccctggccgccggcagctgtgtggtgctgaagcccagcgagatcagccagggcacagagaaggtgctggccgaggtgctgccccagtacctggaccagagctgctttgctgtggtgctgggcggcccccaggagaccggccagctgtag

SEQ ID NO: 143226 - DNA, 1158 bp, Artificial Sequence; identical to SEQ ID NO: 143223
  Description of Artificial Sequence: Synthetic coding sequence

SEQ ID NO: 143227 - DNA, 1692 bp, Artificial Sequence
  Description of Artificial Sequence: Synthetic coding sequence
atgctgctgcctgccccagccctgcggcgggccctgctgagccggccctggacaggagctggcctgcgctggaagcacaccagcagcctgaaggtggccaatgaacctgtgctggccttcacccagggcagccctgagagagatgccctgcagaaggccctgaaggacctgaagggccgcatggaggccatcccctgtgtggtgggagatgaggaggtgtggaccagtgatgtgcagtaccaggtgagccccttcaaccacggccacaaggtggccaagttctgctatgctgacaagagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgggaaatgtggtgctgtggaagcccagcgacacagccatgctggccagctatgctgtgtaccgcatcctgcgggaggccggcctgccccccaacatcatccagtttgtgcctgcagatggccccctgtttggagacacagtgaccagcagcgagcacctgtgtggcatcaacttcaccggctctgtgcccaccttcaagcacctgtggaagcaggtggcccagaacctggaccgcttccacaccttcccccggctggccggggagtgtggcggcaagaacttccactttgtgcacaggtctgcagatgtggagagcgtggtgtctggcaccctgcggagcgcctttgaatatggaggccagaagtgcagcgcctgcagccggctgtatgtgccccacagcctgtggccccagatcaagggccgcctgctggaggagcacagccgcatcaaggtgggggaccctgctgaggactttggcaccttcttctctgctgtgattgatgccaagagctttgcccgcatcaagaagtggctggagcacgcccggagcagccccagcctgaccatcctggccggcggcaaatgtgatgacagcgtgggctactttgtggagccctgcatcgtggagagcaaggacccccaggagcccatcatgaaggaggagatctttggacctgtgctgtctgtgtatgtgtacccagatgacaagtacaaggagaccctgcagctggtggacagcaccaccagctatggcctgactggagctgtgttcagccaggacaaggatgtggtgcaggaggccaccaaggtgctgagaaatgctgctggcaacttctacatcaatgacaagagcacaggcagcatcgtgggccagcagccctttggaggagcccgggccagcggcaccaatgacaagccaggcggcccccactacatcctgcgctggaccagcccccaggtgatcaaggagacccacaagcccctgggggactggagctatgcctacatgcagtag

SEQ ID NO: 143228 - DNA, 588 bp, Artificial Sequence
  Description of Artificial Sequence: Synthetic coding sequence
atggaggccatcccctgtgtggtgggagatgaggaggtgtggaccagtgatgtgcagtaccaggtgagccccttcaaccacggccacaaggtggccaagttctgctatgctgacaagagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgctgcgggagggcgtggtgaccctgcccctgtgccagatgaccaagctgcggcacacagctgtgacctacctggcccggctgagtgactag

SEQ ID NO: 143229 - DNA, 633 bp, Artificial Sequence
  Description of Artificial Sequence: Synthetic coding sequence
atgctgctgcctgccccagccctgcggcgggccctgctgagccggccctggacaggagctggcctgcgctggaagcacaccagcagcctgaaggtggccaatgaacctgtgctggccttcacccagggcagccctgagagagatgccctgcagaaggccctgaaggacctgaagggccgcatggaggccatcccctgtgtggtgggagatgaggaggtgtggaccagtgatgtgcagtaccaggtgagcagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgtag

SEQ ID NO: 143230 - DNA, 1692 bp, Artificial Sequence; identical to SEQ ID NO: 143227
  Description of Artificial Sequence: Synthetic coding sequence

SEQ ID NO: 143231 - DNA, 645 bp, Artificial Sequence
  Description of Artificial Sequence: Synthetic coding sequence
atgctgctgcctgccccagccctgcggcgggccctgctgagccggccctggacaggagctggcctgcgctggaagcacaccagcagcctgaaggtggccaatgaacctgtgctggccttcacccagggcagccctgagagagatgccctgcagaaggccctgaaggacctgaagggccgcatggaggccatcccctgtgtggtgggagatgaggaggtgtggaccagtgatgtgcagtaccaggtgagcagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatggtgcgctgtggctag

SEQ ID NO: 143232 - DNA, 462 bp, Artificial Sequence
  Description of Artificial Sequence: Synthetic coding sequence
aacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgctgcgggagggcgtggtgaccctgcccctgtgccagatgaccaagctgcggcacacagctgtgacctacctggcccggctgagtgactag

SEQ ID NO: 143233 - DNA, 1512 bp, Artificial Sequence
  Description of Artificial Sequence: Synthetic coding sequence
atggaggccatcccctgtgtggtgggagatgaggaggtgtggaccagtgatgtgcagtaccaggtgagccccttcaaccacggccacaaggtggccaagttctgctatgctgacaagagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgggaaatgtggtgctgtggaagcccagcgacacagccatgctggccagctatgctgtgtaccgcatcctgcgggaggccggcctgccccccaacatcatccagtttgtgcctgcagatggccccctgtttggagacacagtgaccagcagcgagcacctgtgtggcatcaacttcaccggctctgtgcccaccttcaagcacctgtggaagcaggtggcccagaacctggaccgcttccacaccttcccccggctggccggggagtgtggcggcaagaacttccactttgtgcacaggtctgcagatgtggagagcgtggtgtctggcaccctgcggagcgcctttgaatatggaggccagaagtgcagcgcctgcagccggctgtatgtgccccacagcctgtggccccagatcaagggccgcctgctggaggagcacagccgcatcaaggtgggggaccctgctgaggactttggcaccttcttctctgctgtgattgatgccaagagctttgcccgcatcaagaagtggctggagcacgcccggagcagccccagcctgaccatcctggccggcggcaaatgtgatgacagcgtgggctactttgtggagccctgcatcgtggagagcaaggacccccaggagcccatcatgaaggaggagatctttggacctgtgctgtctgtgtatgtgtacccagatgacaagtacaaggagaccctgcagctggtggacagcaccaccagctatggcctgactggagctgtgttcagccaggacaaggatgtggtgcaggaggccaccaaggtgctgagaaatgctgctggcaacttctacatcaatgacaagagcacaggcagcatcgtgggccagcagccctttggaggagcccgggccagcggcaccaatgacaagccaggcggcccccactacatcctgcgctggaccagcccccaggtgatcaaggagacccacaagcccctgggggactggagctatgcctacatgcagtag

SEQ ID NO: 143234 - DNA, 1539 bp, Artificial Sequence
  Description of Artificial Sequence: Synthetic coding sequence
atgctgctgcctgccccagccctgcggcgggccctgctgagccggccctggacaggagctggcctgcgctggaagcacaccagcagcctgaaggtggccaatgaacctgtgctggccttcacccagggcagccctgagagagatgccctgcagaaggccctgaaggacctgaagggccgcatggaggccatcccctgtgtggtgggagatgaggaggtgtggaccagtgatgtgcagtaccaggtgagccccttcaaccacggccacaaggtggccaagttctgctatgctgacaagagcctgctgaacaaggccatcgaggccgccctggccgccaggaaggagtgggacctgaagcccatcgctgaccgggcccagatcttcctgaaggctgctgacatgctgagcggccccaggagagctgagatcctggccaagaccatggtgggccagggcaagacagtcatccaggccgagattgatgctgctgctgagctgattgacttcttccgcttcaatgccaagtatgctgtggagctggagggccagcagcccatctctgtgccccccagcaccaacagcacagtgtaccggggcctggagggctttgtggccgccatcagccccttcaacttcaccgccatcggcggcaacctggccggggccccagccctgatgggaaatgtggtgctgtggaagcccagcgacacagccatgctggccagctatgctgtgtaccgcatcctgcgggaggccggcctgccccccaacatcatccagtttgtgcctgcagatggccccctgtttggagacacagtgaccagcagcgagcacctgtgtggcatcaacttcaccggctctgtgcccaccttcaagcacctgtggaagcaggtggcccagaacctggaccgcttccacaccttcccccggctggccggggagtgtggcggcaagaacttccactttgtgcacaggtctgcagatgtggagagcgtggtgtctggcaccctgcggagcgcctttgaatatggaggccagaagtgcagcgcctgcagccggctgtatgtgccccacagcctgtggccccagatcaagggccgcctgctggaggagcacagccgcatcaaggtgggggaccctgctgaggactttggcaccttcttctctgctgtgattgatgccaaggagatcttcggccctgtgctgtctgtgtatgtgtacccagatgacaagtacaaggagaccctgcagctggtggacagcaccaccagctatggcctgaccggggctgtgttcagccaggacaaggatgtggtgcaggaggccaccaaggtgctgagaaatgctgctggcaacttctacatcaatgacaagagcacaggcagcatcgtgggccagcagccctttggaggagcccgggccagcggcaccaatgacaagccaggcggcccccactacatcctgcgctggaccagcccccaggtgatcaaggagacccacaagcccctgggggactggagctatgcctacatgcagtag

SEQ ID NO: 143235 - DNA, 1647 bp, Artificial Sequence
  Description of Artificial Sequence: Synthetic coding sequence
atggccacctgcatctggctgcggagctgtggggcccggcggctgggcagcaccttccctggctgccgcctgcggccccgggccggcggcctggtgcctgccagcggccctgcccctggccctgcccagctgcgctgctacgccggccgcctggccggcctgtctgctgccctgctgaggacagacagctttgtgggcggccgctggctgcctgctgctgccaccttccctgtgcaggaccctgccagcggggccgccctgggcatggtggccgactgtggggtgcgggaggcccgggctgctgtgcgggccgcctatgaggccttctgccgctggagggaggtgtctgccaaggagaggagcagcctgctgaggaagtggtacaacctgatgatccagaacaaggatgacctggcccgcatcatcacagctgagagcggcaagcccctgaaggaggcccacggggagatcctgtacagcgccttcttcctggagtggttcagcgaggaggcccggcgggtgtatggagacatcatccacaccccagccaaggaccggcgggccctggtgctgaagcagcccatcggcgtggccgctgtgatcaccccctggaacttccccagcgccatgatcaccaggaaggtgggcgccgccctggccgccggctgcaccgtggtggtgaagccagctgaggacacccccttcagcgccctggccctggccgaggtgaaccagggcttcctgctggacctggaccccctgctgctggccagccaggccggcatccccagcggcgtgtacaacgtcatcccctgcagcaggaagaatgccaaggaggtgggggaggccatctgcacagaccccctggtgtccaagatctccttcaccggcagcaccaccaccgggaagatcctgctgcaccacgccgccaacagcgtgaagagggtgtccatggagctgggcggcctggcccccttcatcgtgtttgattctgccaacgtggaccaggccgtggccggggccatggccagcaagttcaggaacacaggccagacctgtgtgtgcagcaaccagttcctggtgcagaggggcatccatgatgcctttgtgaaggcctttgctgaggccatgaagaagaacctgcgggtgggcaatggatttgaggagggcaccacccagggccccctcatcaatgagaaggctgtggagaaggtggagaagcaggtgaatgatgctgtgtccaaaggagccaccgtggtgactggaggcaagaggcaccagctgggcaagaacttctttgagcccaccctgctgtgcaatgtgacccaggacatgctgtgcacccatgaggagaccttcggccccctggcccctgtgatcaagtttgacacagaggaggaggccatcgccatcgccaatgctgctgatgtgggcctggccggctacttctacagccaggaccctgcccagatctggagggtggccgagcagctggaggtgggcatggtgggcgtgaatgaaggcctcatcagctctgtggagtgcccctttggaggagtgaagcagagcggcctgggccgggagggcagcaaatatggaattgatgagtacctggagctgaagtatgtgtgctatggaggcctgtag

SEQ ID NO: 143236 - DNA, 1608 bp, Artificial Sequence
  Description of Artificial Sequence: Synthetic coding sequence
atggccacctgcatctggctgcggagctgtggggcccggcggctgggcagcaccttccctggctgccgcctgcggccccgggccggcggcctggtgcctgccagcggccctgcccctggccctgcccagctgcgctgctacgccggccgcctggccggcctgtctgctgccctgctgaggacagacagctttgtgggcggccgctggctgcctgctgctgccaccttccctgtgcaggaccctgccagcggggccgccctgggcatggtggccgactgtggggtgcgggaggcccgggctgctgtgcgggccgcctatgaggccttctgccgctggagggaggtgtctgccaaggagaggagcagcctgctgaggaagtggtacaacctgatgatccagaacaaggatgacctggcccgcatcatcacagctgagagcggcaagcccctgaaggaggcccacggggagatcctgtacagcgccttcttcctggagtggttcagcgaggaggcccggcgggtgtatggagacatcatccacaccccagccaaggaccggcgggccctggtgctgaagcagcccatcggcgtggccgctgtgatcaccccctggaacttccccagcgccatgatcaccaggaaggtgggcgccgccctggccgccggctgcaccgtggtggtgaagccagctgaggacacccccttcagcgccctggccctggccgagctggccagccaggccggcatccccagcggcgtgtacaacgtcatcccctgcagcaggaagaatgccaaggaggtgggggaggccatctgcacagaccccctggtgtccaagatctccttcaccggcagcaccaccaccgggaagatcctgctgcaccacgccgccaacagcgtgaagagggtgtccatggagctgggcggcctggcccccttcatcgtgtttgacagcgccaacgtggaccaggccgtggccggggccatggccagcaagttcaggaacacaggccagacctgtgtgtgcagcaaccagttcctggtgcagaggggcatccatgatgcctttgtgaaggcctttgctgaggccatgaagaagaacctgcgggtgggcaatggatttgaggagggcaccacccagggccccctcatcaatgagaaggctgtggagaaggtggagaagcaggtgaatgatgctgtgtccaagggggccaccgtggtgactggaggcaagaggcaccagctgggcaagaacttctttgagcccaccctgctgtgcaatgtgacccaggacatgctgtgcacccatgaggagaccttcggccccctggcccctgtgatcaagtttgacacagaggaggaggccatcgccatcgccaatgctgctgatgtgggcctggccggctacttctacagccaggaccctgcccagatctggagggtggccgagcagctggaggtgggcatggtgggcgtgaatgaaggcctcatcagctctgtggagtgcccctttggaggagtgaagcagagcggcctgggccgggagggcagcaaatatggaattgatgagtacctggagctgaagtatgtgtgctacggcggcctgtag

SEQ ID NO: 143237 - DNA, 1344 bp, Artificial Sequence
  Description of Artificial Sequence: Synthetic coding sequence
atggtggccgactgtggggtgcgggaggcccgggctgctgtgcgggccgcctatgaggccttctgccgctggagggaggtgtctgccaaggagaggagcagcctgctgaggaagtggtacaacctgatgatccagaacaaggatgacctggcccgcatcatcacagctgagagcggcaagcccctgaaggaggcccacggggagatcctgtacagcgccttcttcctggagtggttcagcgaggaggcccggcgggtgtatggagacatcatccacaccccagccaaggaccggcgggccctggtgctgaagcagcccatcggcgtggccgctgtgatcaccccctggaacttccccagcgccatgatcaccaggaaggtgggcgccgccctggccgccggctgcaccgtggtggtgaagccagctgaggacacccccttcagcgccctggccctggccgagctggccagccaggccggcatccccagcggcgtgtacaacgtcatcccctgcagcaggaagaatgccaaggaggtgggggaggccatctgcacagaccccctggtgtccaagatctccttcaccggcagcaccaccaccgggaagatcctgctgcaccacgccgccaacagcgtgaagagggtgtccatggagctgggcggcctggcccccttcatcgtgtttgacagcgccaacgtggaccaggccgtggccggggccatggccagcaagttcaggaacacaggccagacctgtgtgtgcagcaaccagttcctggtgcagaggggcatccatgatgcctttgtgaaggcctttgctgaggccatgaagaagaacctgcgggtgggcaatggatttgaggagggcaccacccagggccccctcatcaatgagaaggctgtggagaaggtggagaagcaggtgaatgatgctgtgtccaagggggccaccgtggtgactggaggcaagaggcaccagctgggcaagaacttctttgagcccaccctgctgtgcaatgtgacccaggacatgctgtgcacccatgaggagaccttcggccccctggcccctgtgatcaagtttgacacagaggaggaggccatcgccatcgccaatgctgctgatgtgggcctggccggctacttctacagccaggaccctgcccagatctggagggtggccgagcagctggaggtgggcatggtgggcgtgaatgaaggcctcatcagctctgtggagtgcccctttggaggagtgaagcagagcggcctgggccgggagggcagcaaatatggaattgatgagtacctggagctgaagtatgtgtgctacggcggcctgtag

SEQ ID NO: 143238 - DNA, 1608 bp, Artificial Sequence
  Description of Artificial Sequence: Synthetic coding sequence
atggccgccctgctggccgctgctgctgtgcgggcccgcatcctgcaggtgagcagcaaggtgaagagcagccccacctggtacagcgccagcagcttcagcagctctgtgcccaccgtgaagctgttcatcggcggcaagtttgtggagagcaagagtgacaagtggattgacatccacaacccagccaccaatgaagtcatcggccgggtgccccaggccaccaaggccgagatggatgctgccatcgccagctgcaagagggccttccctgcctgggccgacacctctgtgctgagccggcagcaggtgctgctgcgctaccagcagctgatcaaggagaacctgaaggagatcgccaagctgatcaccctggagcagggcaagaccctggctgatgctgaaggagatgtgttccggggcctgcaggtggtggagcacgcctgcagcgtgaccagcctgatgatgggagagaccatgcccagcatcaccaaggacatggacctgtacagctaccgcctgcccctgggcgtgtgtgccggcatcgcccccttcaacttccctgccatgatccccctgtggatgttccccatggccatggtgtgtggcaacaccttcctgatgaagcccagcgagcgggtgcctggggccaccatgctgctggccaagctgctgcaggacagcggggccccagatggcaccctgaacatcatccacggccagcacgaggccgtgaacttcatctgtgaccacccagacatcaaggccatcagctttgtgggcagcaacaaggccggggagtacatctttgagcggggcagccgccacggcaagagggtgcaggccaacatgggcgccaagaaccacggcgtggtgatgccagatgccaacaaggagaacaccctgaaccagctggtgggcgccgccttcggggctgctggccagcgctgcatggccctgagcacagctgtgctggtgggggaggccaagaagtggctgcctgagctggtggagcacgccaagaacctgcgggtgaatgctggggaccagcctggagctgacctgggccccctcatcaccccccaggccaaggagcgggtgtgcaacctgattgattctggcaccaaggagggcgccagcatcctgctggatggcaggaagatcaaggtgaagggctatgaaaatggaaactttgtgggccccaccatcatcagcaatgtgaagcccaacatgacctgctacaaggaggagatctttggacctgtgctggtggtgctggagacagagaccctggatgaggccatccagatcgtgaacaacaacccctatggaaatggaacagccatcttcaccaccaatggagccacagccaggaaatatgcccacctggtggatgtgggccaggtgggcgtgaatgtgcccatccctgtgcccctgcccatgttctccttcaccggcagccgcagcagcttccggggggacaccaacttctacggcaagcagggcatccagttctacacccagctgaagaccatcaccagccagtggaaggaggaggatgccaccctgagcagccctgctgtggtgatgcccaccatgggccgctag

SEQ ID NO: 143239 - DNA, 1620 bp, Artificial Sequence
  Description of Artificial Sequence: Synthetic coding sequence
atgtggaggctgccccgggccctgtgtgtgcacgccgccaagaccagcaagctgagcggcccctggagcaggcctgctgccttcatgagcaccctgctgatcaaccagccccagtatgcctggctgaaggagctgggcctgcgggaggagaatgaaggagtgtacaacggctcctggggcggccgcggggaggtgatcaccacctactgcccagccaacaatgagcccatcgcccgggtgcggcaggcctctgtggccgactatgaggagaccgtgaagaaggcccgggaggcctggaagatctgggccgacatcccagcccccaagagaggagaaattgtgcggcagattggagatgccctgcgggagaagatccaggtgctgggcagcctggtgtccctggagatgggcaagatcctggtggagggcgtgggggaggtgcaggagtatgtggacatctgtgactatgctgtgggcctgagcaggatgattggaggccccatcctgcccagcgagaggagcggccacgccctgattgagcagtggaaccctgtgggcctggtgggcatcatcacagccttcaacttccctgtggccgtgtatggctggaacaatgccatcgccatgatctgtggaaatgtgtgcctgtggaagggggcccccaccaccagcctcatctctgtggccgtgaccaagatcatcgccaaggtgctggaggacaacaagctgcccggggccatctgcagcctgacctgtggcggcgctgacattggaacagccatggccaaggatgagcgggtgaacctgctgtccttcaccggcagcacccaggtgggcaagcaggtgggcctgatggtgcaggagcgcttcggccgcagcctgctggagctgggcggcaacaatgccatcatcgcctttgaagatgctgacctgagcctggtggtgcccagcgccctgtttgctgctgtgggcacagctggccagcgctgcaccacagcccggcggctcttcatccacgagagcatccatgatgaggtggtgaaccggctgaagaaggcctatgcccagatccgggtgggcaacccctgggaccccaacgtgctgtatggccccctgcacaccaagcaggccgtgtccatgttcctgggcgctgtggaggaggccaagaaggagggcggcaccgtggtgtatggaggcaaggtgatggacaggcctggcaactacgtggagcccaccatcgtgacaggcctgggccatgatgccagcatcgcccacacagagacctttgcccccatcctgtatgtgttcaagttcaagaatgaggaggaggtgtttgcctggaacaatgaggtgaagcagggcctgagcagcagcatcttcaccaaggacctgggccgcatcttccgctggctgggccccaagggcagtgactgtggcatcgtgaatgtgaacatccccaccagcggggctgagatcggcggggccttcggcggggagaagcacactggaggcggccgggagagcggcagtgatgcctggaagcagtacatgaggaggagcacctgcaccatcaactacagcaaggacctgcccctggcccagggcatcaagttccagtag

SEQ ID NO: 143240 - DNA, 1044 bp, Artificial Sequence
  Description of Artificial Sequence: Synthetic coding sequence
atgtggaggctgccccgggccctgtgtgtgcacgccgccaagaccagcaagctgagcggcccctggagcaggcctgctgccttcatgagcaccagcctcatctctgtggccgtgaccaagatcatcgccaaggtgctggaggacaacaagctgcccggggccatctgcagcctgacctgtggcggcgctgacattggaacagccatggccaaggatgagcgggtgaacctgctgtccttcaccggcagcacccaggtgggcaagcaggtgggcctgatggtgcaggagcgcttcggccgcagcctgctggagctgggcggcaacaatgccatcatcgcctttgaagatgctgacctgagcctggtggtgcccagcgccctgtttgctgctgtgggcacagctggccagcgctgcaccacagcccggcggctcttcatccacgagagcatccatgatgaggtggtgaaccggctgaagaaggcctatgcccagatccgggtgggcaacccctgggaccccaacgtgctgtatggccccctgcacaccaagcaggccgtgtccatgttcctgggcgctgtggaggaggccaagaaggagggcggcaccgtggtgtatggaggcaaggtgatggacaggcctggcaactacgtggagcccaccatcgtgacaggcctgggccatgatgccagcatcgcccacacagagacctttgcccccatcctgtatgtgttcaagttcaagaatgaggaggaggtgtttgcctggaacaatgaggtgaagcagggcctgagcagcagcatcttcaccaaggacctgggccgcatcttccgctggctgggccccaagggcagtgactgtggcatcgtgaatgtgaacatccccaccagcggggctgagatcggcggggccttcggcggggagaagcacactggaggcggccgggagagcggcagtgatgcctggaagcagtacatgaggaggagcacctgcaccatcaactacagcaaggacctgcccctggcccagggcatcaagttccagtag

SEQ ID NO: 143241 - DNA, 1509 bp, Artificial Sequence
  Description of Artificial Sequence: Synthetic coding sequence
atgggcagccctggccgcggggccggcctgtacttcagcagcagccagggcctgggcctcatccccagccctggcctgtccatgtggaggctgccccgggccctgtgtgtgcatgctgccaagaccagcaagctgagcggcccctggagcaggcctgctgccttcatgagcaccctgctgatcaaccagccccagtatgcctggctgaaggagctgggcctgcgggaggagaatgaaggagtgtacaacggctcctggggcggccgcggggaggtgatcaccacctactgcccagccaacaatgagcccatcgcccgggtgcggcaggcctctgtggccgactatgaggagaccgtgaagaaggcccgggaggcctggaagatctgggccgacatcccagcccccaagagaggagagatcgtgcggcagattggagatgccctgcgggagaagatccaggtgctgggcagcctggtgtccctggagatgggcaagatcctggtggagggcgtgggggaggtgcaggagtatgtggacatctgtgactatgctgtgggcctgagcaggatgattggaggccccatcctgcccagcgagaggagcggccacgccctgattgagcagtggaaccctgtgggcctggtgggcatcatcacagccttcaacttccctgtggccgtgtatggctggaacaatgccatcgccatgatctgtggaaatgtgtgcctgtggaagggggcccccaccaccagcctcatctctgtggccgtgaccaagatcatcgccaaggtgctggaggacaacaagctgcccggggccatctgcagcctgacctgtggcggcgctgacatcggcacagccatggccaaggatgagcgggtgaacctgctgtccttcaccggcagcacccaggtgggcaagcaggtgggcctgatggtgcaggagagatttggccgcagcctgctggagctgggcggcaacaatgccatcatcgcctttgaagatgctgacctgagcctggtggtgcccagcgccctgtttgctgctgtgggcacagctggccagcgctgcaccacagcccggcggctggtgatggaccggcccggcaactacgtggagcccaccatcgtgacaggcctgggccatgatgccagcatcgcccacacagagacctttgcccccatcctgtatgtgttcaagttcaagaatgaggaggaggtgtttgcctggaacaatgaggtgaagcagggcctgagcagcagcatcttcaccaaggacctgggccgcatcttccgctggctgggccccaagggcagtgactgtggcatcgtgaatgtgaacatccccaccagcggggctgagattggaggagcctttggaggagagaagcacactggaggcggccgggagagcggcagtgatgcctggaagcagtacatgagaagaagcacctgcaccatcaactacagcaaggacctgcccctggcccagggcatcaagttccagtag

SEQ ID NO: 143242 - DNA, 1314 bp, Artificial Sequence
  Description of Artificial Sequence: Synthetic coding sequence
atggccggcaccaatgccctgctgatgctggagaacttcattgatggcaagttcctgccctgcagcagctacatcgacagctatgaccccagcactggagaggtgtactgccgggtgcccaacagcggcaaggatgaaattgaagctgctgtgaaggccgcccgggaggccttccccagctggagcagccgcagcccccaggagaggagccgggtgctgaaccaggtggccgacctgctggagcagagcctggaggagtttgcccaggccgagagcaaggaccagggcaagaccctggccctggcccggaccatggacatccccaggtctgtgcagaacttccgcttctttgccagcagcagcctgcaccacaccagtgaatgtacccagatggaccacctgggctgcatgcactacacagtgcgggcccctgtgggcgtgggcgtgcccccaggagtggtgaacatcgtgtttggcaccggcccccgggtgggggaggccctggtgagccaccctgaggtgcccctcatctccttcaccggcagccagcccacagctgagcgcatcacccagctgagcgccccccactgcaagaagctgagcctggagctgggcggcaagaacccagccatcatctttgaagatgccaacctggatgagtgcatcccagccaccgtgcgcagcagctttgccaaccagggcgagatctgcctgtgcaccagccgcatctttgtgcagaagagcatctacagcgagttcctgaagagatttgtggaggccaccaggaagtggaaggtgggcatccccagcgaccccctggtgtccatcggggccctgatcagcaaggcccacctggagaaggtgcgctcctatgtgaagagggccctggccgagggcgcccagatctggtgtggggagggcgtggacaagctgagcctgcctgccaggaaccaggccggctacttcatgctgcccaccgtcatcacagacatcaaggatgagagctgctgcatgacagaggagatctttggacctgtgacctgtgtggtgccctttgacagcgaggaggaggtgattgagcgggccaacaacgtgaagtatggcctggccgccaccgtgtggagcagcaatgtgggccgggtgcaccgggtggccaagaagctgcagagcggcctggtgtggaccaactgctggctgatccgggagctgaacctgccctttggaggcatgaagagcagcggcatcggccgggagggcgccaaggacagctatgacttcttcacagagatcaagaccatcaccgtgaagcactag

SEQ ID NO: 143243 - DNA, 1464 bp, Artificial Sequence
  Description of Artificial Sequence: Synthetic coding sequence
atggccggcaccaatgccctgctgatgctggagaacttcattgatggcaagttcctgccctgcagcagctacatcgacagctatgaccccagcactggagaggtgtactgccgggtgcccaacagcggcaaggatgaaattgaagctgctgtgaaggccgcccgggaggccttccccagctggagcagccgcagcccccaggagaggagccgggtgctgaaccaggtggccgacctgctggagcagagcctggaggagtttgcccaggccgagagcaaggaccagggcaagaccctggccctggcccggaccatggacatccccaggtctgtgcagaacttccgcttctttgccagcagcagcctgcaccacaccagtgaatgtacccagatggaccacctgggctgcatgcactacacagtgcgggcccctgtgggcgtggccggcctcatcagcccctggaacctgcccctgtacctgctgacctggaagatcgccccagccatggctgctggcaacacagtcatcgccaagcccagcgagctgacctctgtgacagcctggatgctgtgcaagctgctggacaaggccggcgtgcccccaggagtggtgaacatcgtgtttggcaccggcccccgggtgggggaggccctggtgagccaccctgaggtgcccctcatctccttcaccggcagccagcccacagctgagcgcatcacccagctgagcgccccccactgcaagaagctgagcctggagctgggcggcaagaacccagccatcatctttgaagatgccaacctggatgagtgcatcccagccaccgtgcgcagcagctttgccaaccagggcgagatctgcctgtgcaccagccgcatctttgtgcagaagagcatctacagcgagttcctgaagagatttgtggaggccaccaggaagtggaaggtgggcatccccagcgaccccctggtgtccatcggggccctgatcagcaaggcccacctggagaaggtgcgctcctatgtgaagagggccctggccgagggcgcccagatctggtgtggggagggcgtggacaagctgagcctgcctgccaggaaccaggccggctacttcatgctgcccaccgtcatcacagacatcaaggatgagagctgctgcatgacagaggagatctttggacctgtgacctgtgtggtgccctttgacagcgaggaggaggtgattgagcgggccaacaacgtgaagtatggcctggccgccaccgtgtggagcagcaatgtgggccgggtgcaccgggtggccaagaagctgcagagcggcctggtgtggaccaactgctggctgatccgggagctgaacctgccctttggaggcatgaagagcagcggcatcggccgggagggcgccaaggacagctatgacttcttcacagagatcaagaccatcaccgtgaagcactag

SEQ ID NO: 143244 - DNA, 1302 bp, Artificial Sequence
  Description of Artificial Sequence: Synthetic coding sequence
atggccggcaccaatgccctgctgatgctggagaacttcattgatggcaagttcctgccctgcagcagctacatcgacagctatgaccccagcactggagaggtgtactgccgggtgcccaacagcggcaaggatgaaattgaagctgctgtgaaggccgcccgggaggccttccccagctggagcagccgcagcccccaggagaggagccgggtgctgaaccaggtggccgacctgctggagcagagcctggaggagtttgcccaggccgagagcaaggaccagggcaagaccctggccctggcccggaccatggacatccccaggtctgtgcagaacttccgcttctttgccagcagcagcctgcaccacaccagtgaatgtacccagatggaccacctgggctgcatgcactacacagtgcgggcccctgtgggcgtggccggcctcatcagcccctggaacctgcccctgtacctgctgacctggaagatcgccccagccatggctgctggcaacacagtcatcgccaagcccagcgagctgacctctgtgacagcctggatgctgtgcaagctgctggacaaggccggcgtgcccccaggagtggtgaacatcgtgtttggcaccggcccccgggtgggggaggccctggtgagccaccctgaggtgcccctcatctccttcaccggcagccagcccacagctgagcgcatcacccagctgagcgccccccactgcaagaagctgagcctggagctgggcggcaagaacccagccatcatctttgaagatgccaacctggatgagtgcatcccagccaccgtgcgcagcagctttgccaaccaggtgcgctcctatgtgaagagggccctggccgagggcgcccagatctggtgtggggagggcgtggacaagctgagcctgcctgccaggaaccaggccggctacttcatgctgcccaccgtcatcacagacatcaaggatgagagctgctgcatgacagaggagatctttggacctgtgacctgtgtggtgccctttgacagcgaggaggaggtgattgagcgggccaacaacgtgaagtatggcctggccgccaccgtgtggagcagcaatgtgggccgggtgcaccgggtggccaagaagctgcagagcggcctggtgtggaccaactgctggctgatccgggagctgaacctgccctttggaggcatgaagagcagcggcatcggccgggagggcgccaaggacagctatgacttcttcacagagatcaagaccatcaccgtgaagcactag

SEQ ID NO: 143245 - DNA, 1557 bp, Artificial Sequence
  Description of Artificial Sequence: Synthetic coding sequence
atgttcctgcgggccggcctggccgccctgagccccctgctgcggagcctgcggcccagccctgtggccgccatgagcacaggcacctttgtggtgtcccagcccctgaactaccggggcggggcccgggtggagccagcagatgccagcggcacagagaaggcctttgagcccgccaccggccgggtcatcgccaccttcacctgcagcggggagaaggaggtgaacctggccgtgcagaatgccaaggccgccttcaagatctggagccagaagagcggcatggagcgctgccgcatcctgctggaggccgcccgcatcatccgggagcgggaggatgaaattgccaccatggagtgcatcaacaacgggaagagcatctttgaggcccggctggacatcgacatctcctggcagtgcctggagtactatgccggcctggccgcctccatggccggggagcacatccagctgcccggcggcagctttggctacacccggcgggagcccctgggcgtgtgtgtgggcattggagcctggaactaccccttccagatcgcctcctggaagagcgccccagccctggcctgtggaaatgccatggtgttcaagcccagccccttcacccctgtgtctgccctgctgctggccgagatctacagcgaggccggcgtgcccccaggcctcttcaacgtggtgcagggcggggccgccaccggccagttcctgtgccagcacccagatgtggccaaggtgtccttcaccggctctgtgcccaccggcatgaagatcatggagatgtctgccaagggcatcaagcctgtgaccctggagctgggcggcaagagccccctcatcatcttcagtgactgtgacatgaacaatgctgtgaagggggccctgatggccaacttcctgacccagggccaggtgtgctgcaatggcaccagggtgtttgtgcagaaggagatcctggacaagttcacagaggaggtggtgaagcagacccagaggatcaagattggagaccccctgctggaggacaccaggatgggccccctcatcaaccggccccacctggagcgggtgctgggctttgtgaaggtggccaaggagcagggcgccaaggtgctgtgtggcggggacatctacgtgcctgaggaccccaagctgaaggatggctactacatgaggccctgtgtgctgaccaactgcagagatgacatgacctgtgtgaaggaggagatctttggacctgtgatgagcatcctgagctttgacacagaggccgaggtgctggagcgggccaatgacaccaccttcggcctggccgccggggtcttcacccgggacatccagagggcccaccgggtggtggccgagctgcaggccggcacctgcttcatcaacaactacaacgtgtcccctgtggagctgccctttggaggctacaagaagagcggcttcggccgggagaatggccgggtgaccatcgagtactacagccagctgaagacagtgtgtgtggagatgggagatgtggagagcgccttctag

SEQ ID NO: 143246 - DNA, 1275 bp, Artificial Sequence
  Description of Artificial Sequence: Synthetic coding sequence
atggagcgctgccgcatcctgctggaggccgcccgcatcatccgggagcgggaggatgaaattgccaccatggagtgcatcaacaacgggaagagcatctttgaggcccggctggacatcgacatctcctggcagtgcctggagtactatgccggcctggccgcctccatggccggggagcacatccagctgcccggcggcagctttggctacacccggcgggagcccctgggcgtgtgtgtgggcattggagcctggaactaccccttccagatcgcctcctggaagagcgccccagccctggcctgtggaaatgccatggtgttcaagcccagccccttcacccctgtgtctgccctgctgctggccgagatctacagcgaggccggcgtgcccccaggcctcttcaacgtggtgcagggcggggccgccaccggccagttcctgtgccagcacccagatgtggccaaggtgtccttcaccggctctgtgcccaccggcatgaagatcatggagatgtctgccaagggcatcaagcctgtgaccctggagctgggcggcaagagccccctcatcatcttcagtgactgtgacatgaacaatgctgtgaagggggccctgatggccaacttcctgacccagggccaggtgtgctgcaatggcaccagggtgtttgtgcagaaggagatcctggacaagttcacagaggaggtggtgaagcagacccagaggatcaagattggagaccccctgctggaggacaccaggatgggccccctcatcaaccggccccacctggagcgggtgctgggctttgtgaaggtggccaaggagcagggcgccaaggtgctgtgtggcggggacatctacgtgcctgaggaccccaagctgaaggatggctactacatgaggccctgtgtgctgaccaactgcagagatgacatgacctgtgtgaaggaggagatctttggacctgtgatgagcatcctgagctttgacacagaggccgaggtgctggagcgggccaatgacaccaccttcggcctggccgccggggtcttcacccgggacatccagagggcccaccgggtggtggccgagctgcaggccggcacctgcttcatcaacaactacaacgtgtcccctgtggagctgccctttggaggctacaagaagagcggcttcggccgggagaatggccgggtgaccatcgagtactacagccagctgaagacagtgtgtgtggagatgggagatgtggagagcgccttctag

SEQ ID NO: 143247 - DNA, 4017 bp, Artificial Sequence
  Description of Artificial Sequence: Synthetic coding sequence
atggaccgggccagcgagctgctcttctacgtgaatggaaggaaggtgattgagaagaatgtggaccctgagaccatgctgctgccctacctgaggaagaagctgcggctgaccggcaccaagtatggctgcggcggcggcggctgtggggcctgcaccgtgatgatcagccgctacaaccccatcaccaagaggatccgccaccacccagccaatgcctgcctgatccccatctgcagcctgtatggagctgctgtgaccaccgtggagggcatcggcagcacccacacccgcatccaccctgtgcaggagcgcatcgccaagtgccacggcacccagtgtggcttctgcaccccaggcatggtgatgagcatctacaccctgctgaggaaccaccctgagcccaccctggaccagctgacagatgccctgggcggcaacctgtgccgctgcaccggctaccggcccatcattgatgcctgcaagaccttctgcaagaccagcggctgctgccagagcaaagaaaatggagtgtgctgcctggaccagggcatcaatggcctgcctgagtttgaggagggcagcaagaccagccccaagctgtttgctgaggaggagttcctgcccctggaccccacccaggagctgatcttccccccagagctgatgatcatggccgagaagcagagccagaggaccagggtgtttggcagcgagaggatgatgtggttcagccctgtgaccctgaaggagctgctggagttcaagttcaagtacccccaggcccctgtgatcatgggcaacacctctgtgggccctgaggtgaagttcaagggcgtcttccaccctgtgatcatcagcccagacagaattgaggagctgtctgtggtgaaccacgcctacaacggcctgaccctgggcgccggcctgagcctggcccaggtgaaggacatcctggctgatgtggtgcagaagctgcctgaggagaagacccagatgtaccacgccctgctgaagcacctgggcaccctggccggcagccagatccggaacatggccagcctgggcggccacatcatcagccgccacccagacagcgacctgaaccccatcctggccgtgggcaactgcaccctgaacctgctgagcaaggagggcaagaggcagatccccctgaatgagcagttcctgagcaaatgtccaaatgctgacctgaagccccaggagatcctggtgtctgtgaacatcccctacagcaggaagtgggagtttgtgtctgccttccggcaggcccagaggcaggagaatgccctggccatcgtgaacagcggcatgagggtcttctttggagaaggagatggcatcatccgggagctgtgcatctcctatggaggagtgggccctgccaccatctgtgccaagaacagctgccagaagctgattggccgccactggaatgagcagatgctggacatcgcctgccgcctcatcctgaatgaggtgtccctgctgggcagcgcccctgggggcaaggtggagttcaagaggaccctcatcatctccttcctgttcaagttctacctggaggtgtcccagatcctgaagaagatggaccctgtgcactaccccagcctggccgacaagtatgaaagtgccctggaggacctgcacagcaagcaccactgcagcaccctgaagtaccagaacatcggccccaagcagcaccctgaggaccccatcggccaccccatcatgcacctgagcggcgtgaagcacgccaccggggaggccatctactgtgatgacatgcccctggtggaccaggagctgttcctgacctttgtgaccagcagccgggcccacgccaagatcgtgtccattgacctgtctgaggccctgtccatgcctggggtggtggacatcatgacagctgagcacctgagtgatgtgaacagcttctgcttcttcacagaagctgagaagttcctggccacagacaaggtgttctgtgtgggccagctggtgtgtgctgtgctggccgacagcgaggtgcaggccaagagagctgccaagagggtgaagatcgtgtaccaggacctggagcccctcatcctgaccatcgaggagagcatccagcacaacagcagcttcaagccagagaggaagctggagtatggaaatgtggatgaggccttcaaggtggtggaccagatcctggagggggagatccacatgggcggccaggagcacttctacatggagacccagagcatgctggtggtgcccaagggggaggaccaggagatggatgtgtatgtgtccacccagttccccaagtacatccaggacatcgtggccagcaccctgaagctgcctgccaacaaggtgatgtgccacgtgagaagagtgggcggggcctttggaggcaaggtgctgaagacaggcatcatcgctgctgtgacagcctttgctgccaacaagcacggccgggctgtgcgctgtgtgctggagcggggggaggacatgctgatcactggaggccgccacccctacctgggcaagtacaaggccggcttcatgaatgatggccgcatcctggccctggacatggagcactacagcaatgctggggccagcctggatgagagcctgtttgtgattgagatgggcctgctgaagatggacaatgcctacaagttccccaacctgcgctgccggggctgggcctgcaggaccaacctgcccagcaacacagccttccggggcttcggcttcccccaggccgccctgatcacagagagctgcatcacagaggtggccgccaagtgtggcctgagccctgagaaggtgcgcatcatcaacatgtacaaggagattgaccagaccccctacaagcaggagatcaatgccaagaacctgatccagtgctggagggagtgcatggccatgagcagctacagcctgaggaaggtggccgtggagaagttcaatgctgagaactactggaagaagaagggcctggccatggtgcccctgaagtttcctgtgggcctgggcagcagagctgctggccaggccgccgccctggtgcacatctacctggatggctctgtgctggtgacccacggcggcatcgagatgggccagggcgtgcacaccaagatgatccaggtggtgtcccgggagctgaggatgcccatgagcaatgtgcacctgcggggcaccagcacagaaacagtgcccaatgccaacatcagcggcggctctgtggtggccgacctgaatggcctggccgtgaaggatgcctgccagaccctgctgaagaggctggagcccatcatcagcaagaaccccaagggcacctggaaggactgggcccagacagcctttgatgagagcatcaacctgtctgctgtgggctacttccggggctatgaaagtgacatgaactgggagaagggggagggccagccctttgagtactttgtgtatggagctgcctgcagcgaggtggagattgactgcctgactggagaccacaagaacatcagaacagacatcgtgatggatgtgggctgcagcatcaacccagccattgatattggccagatcgagggcgccttcatccagggcatgggcctgtacaccatcgaggagctgaactacagcccccagggcatcctgcacacccggggccctgaccagtacaagatcccagccatctgtgacatgcccacagagctgcacatcgccctgctgccccccagccagaacagcaacaccctgtacagcagcaagggcctgggggagagcggggtcttcctgggctgcagcgtcttctttgccatccatgatgctgtgtctgctgcccggcaggagcggggcctgcacggccccctgaccctgaacagccccctgaccccagagaagatccgcatggcctgtgaggacaagttcaccaagatgatccccagagatgagcccggcagctatgtgccctggaatgtgcccatctag

SEQ ID NO: 143248 - DNA, 456 bp, Artificial Sequence
  Description of Artificial Sequence: Synthetic coding sequence
atgctgctgccctacctgaggaagaagctgcggctgaccggcaccaagtatggctgcggcggcggcggctgtggggcctgcaccgtgatgatcagccgctacaaccccatcaccaagaggatccgccaccacccagccaatgcctgcctgatccccatctgcagcctgtatggagctgctgtgaccaccgtggagggcatcggcagcacccacacccgcatccaccctgtgcaggagagaattgccaagtgccacggcacccagtgtggcttctgcaccccaggcatggtgatgagcatctacaccctgctgaggaaccaccctgagcccaccctggaccagctgacagatgccctgggcggcaacctgtgccgctgcaccggctaccggcccatcattgatgcctgcaagaccttctgcaagaccagcggctgctgccagagcaaggagaactag

SEQ ID NO: 143249 - DNA, 858 bp, Artificial Sequence
  Description of Artificial Sequence: Synthetic coding sequence
atggacctgtctgctgccagccaccgcatccccctgagtgatggcaacagcatccccatcatcggcctgggcacctacagcgagcccaagagcacccccaagggggcctgtgccacctctgtgaaggtggccatcgacaccggctaccgccacattgatggagcctacatctaccagaatgagcacgaggtgggggaggccatccgggagaagattgctgagggcaaggtgcggcgggaggacatcttctactgcggcaagctgtgggccaccaaccacgtgcctgagatggtgcggcccaccctggagaggaccctgcgggtgctgcagctggactatgtggacctgtacatcatcgaggtgcccatggccttcaagccaggagatgagatctaccccagagatgaaaatggcaagtggctgtaccacaagagcaacctgtgtgccacctgggaggtggagtgccacccctacttcacccagcccaagctgctgaagttctgccagcagcacgacatcgtcatcacagcctacagccccctgggcaccagcaggaaccccatctgggtgaatgtgagcagcccccccctgctgaaggatgccctgctgaacagcctgggcaagcgctacaacaagacagctgcccagatcgtgctgcgcttcaacatccagaggggcgtggtggtgatccccaagagcttcaacctggagcgcatcaaggagaacttccagatctttgacttcagcctgacagaggaggagatgaaggacatcgaggccctgaacaagaatgtgcgctttgtggagctgctgatgtggagggaccaccctgagtaccccttccatgatgagtactag

SEQ ID NO: 143250 - DNA, 873 bp, Artificial Sequence
  Description of Artificial Sequence: Synthetic coding sequence
atggacctgtctgctgccagccaccgcatccccctgagtgatggcaacagcatccccatcatcggcctgggcacctacagcgagcccaagagcacccccaagggggcctgtgccacctctgtgaaggtggccatcgacaccggctaccgccacattgatggagcctacatctaccagaatgagcacgaggtgggggaggccatccgggagaagattgctgagggcaaggtgcggcgggaggacatcttctactgcggcaagctgtgggccaccaaccacgtgcctgagatggtgcggcccaccctggagaggaccctgcgggtgctgcagctggactatgtggacctgtacatcatcgaggtgcccatggccttcaagccaggagatgagatctaccccagagatgaaaatggcaagtggctgtaccacaagagcaacctgtgtgccacctgggaggccatggaggcctgcaaggatgctggcctggtgaagagcctgggcgtgagcaacttcaacagacggcagctggagctgatcctgaacaagccaggcctgaagcacaagcctgtgagcaaccaggtggagtgccacccctacttcacccagcccaagctgctgaagttctgccagcagcacgacatcgtcatcacagcctacagccccctgggcaccagcaggaaccccatctgggtgaatgtgagcagcccccccctgctgaaggatgccctgctgaacagcctgggcaagcgctacaacaagacagctgcccagatcgtgctgcgcttcaacatccagaggggcgtggtggtgatccccaagagcttcaacctggagcgcatcaaggagaacttccaggtggcccggagcagctag

SEQ ID NO: 143251 - DNA, 978 bp, Artificial Sequence
  Description of Artificial Sequence: Synthetic coding sequence
atggccgccagctgtgtgctgctgcacacaggccagaagatgcccctgattggcctgggcacctggaagtctgagcccggccaggtgaaggctgctgtgaagtatgccctgtctgtgggctaccgccacatcgactgtgccgccatctatggaaatgaacctgagatcggggaggccctgaaggaggatgtgggccctgggaaggctgtgccccgggaggagctgtttgtgaccagcaagctgtggaacaccaagcaccacccagaagatgtggagcccgccctgaggaagaccctggccgacctgcagctggagtacctggacctgtacctgatgcactggccctatgcctttgagcggggggacaaccccttccccaagaatgctgatggcaccatctgctatgacagcacccactacaaggagacctggaaggccctggaggccctggtggccaagggcctggtgcaggccctgggcctgagcaacttcaacagccggcagattgatgacatcctgtctgtggcctctgtgcggcctgctgtgctgcaggtggagtgccacccctacctggcccagaatgagctgattgcccactgccaggcccggggcctggaggtgacagcctacagccccctgggcagcagtgaccgggcctggagggaccctgatgagcctgtgctgctggaggagcctgtggtgctggccctggccgagaagtatggccgcagccctgcccagatcctgctgcgctggcaggtgcagaggaaggtgatctgcatccccaagagcatcacccccagccgcatcctgcagaacatcaaggtgtttgacttcaccttcagccctgaggagatgaagcagctgaatgccctgaacaagaactggagatacatcgtgcccatgctgactgtggatggcaagagggtgcccagagatgctggccaccccctgtaccccttcaatgacccctactag

SEQ ID NO: 143252 - DNA, 978 bp, Artificial Sequence; identical to SEQ ID NO: 143251
  Description of Artificial Sequence: Synthetic coding sequence

SEQ ID NO: 143253 - DNA, 444 bp, Artificial Sequence
  Description of Artificial Sequence: Synthetic coding sequence
atggccgccagctgtgtgctgctgcacacaggccagaagatgcccctgattggcctgggcacctggaagtctgagcccggccaggtgaaggctgctgtgaagtatgccctgtctgtgggctaccgccacatcgactgtgccgccatctatggaaatgaacctgagatcggggaggccctgaaggaggatgtgggccctgggaaggctgtgccccgggaggagctgtttgtgaccagcaagctgtggaacaccaagcaccacccagaagatgtggagcccgccctgaggaagaccctggccgacctgcagctggagtacctggacctgtacctgatgcactggccctatgcctttgagcggggggacaaccccttccccaagaatgctgatggcaccatctgctatgacagcacccactacaaggagacctggaaggccctgtag

SEQ ID NO: 143254 - DNA, 951 bp, Artificial Sequence
  Description of Artificial Sequence: Synthetic coding sequence
atggccagccggctgctgctgaacaatggagccaagatgcccatcctgggcctgggcacctggaagagccccccaggccaggtgacagaagctgtgaaggtggccattgatgtgggctaccgccacatcgactgtgcccacgtgtaccagaatgaaaatgaggtgggcgtggccatccaggagaagctgcgggagcaggtggtgaagcgggaggagctgttcatcgtgtccaagctgtggtgcacctaccacgagaagggcctggtgaagggggcctgccagaagaccctgagtgacctgaagctggactacctggacctgtacctgatccactggcccaccggcttcaagccaggcaaggagttcttccccctggatgagagcggaaatgtggtgcccagcgacaccaacatcctggacacctgggccgccatggaggagctggtggatgagggcctggtgaaggccatcggcatcagcaacttcaaccacctgcaggtggagatgatcctgaacaagccaggcctgaagtacaagccagctgtgaaccagatcgagtgccacccctacctgacccaggagaagctgatccagtactgccagagcaaaggaattgtggtgacagcctacagccccctgggcagcccagaccggccctgggccaagccagaggaccccagcctgctggaggacccccgcatcaaggccatcgccgccaagcacaacaagaccacagcccaggtgctgatccgcttccccatgcagaggaacctggtggtgatccccaagtctgtgaccccagagagaattgctgagaacttcaaggtgtttgattttgagctgagcagccaggacatgaccaccctgctgagctacaacagaaactggagggtgtgtgccctgctgagctgcaccagccacaaggactaccccttccacgaggagttctag

SEQ ID NO: 143255 - DNA, 618 bp, Artificial Sequence
  Description of Artificial Sequence: Synthetic coding sequence
atgggcgtggtgtccctcttcctgtgcatcgtggagcagatcttcaccagcagcaagaagatccagttccggggcatcttcatggccaaggtgcccaagagcaaggccctggaggccaccaagctggccatcgaggccggcttccgccacattgattctgcccacctgtacaacaatgaggagcaggtgggcctggccatccgcagcaagattgctgatggctctgtgaagcgggaggacatcttctacaccagcaagctgtggtgcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccgtggagaagtgcaaggatgctggcctggccaagagcattggagtgagcaacttcaacagacggcagctggagatgatcctgaacaagccaggcctgaagtacaagcctgtgtgcaaccagccccgggacaacagcatcttcagcctgagcccagactggtag

SEQ ID NO: 143256 - DNA, 972 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccaccaagctggccatcgaggccggcttccgccacattgattctgcccacctgtacaacaatgaggagcaggtgggcctggccatccgcagcaagattgctgatggctctgtgaagcgggaggacatcttctacaccagcaagctgtggtgcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccgtggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgaccagcgaggagatgaaggccattgatggcctgaacagaaatgtgcgctacctgaccctggacatctttgctggcccccccaactaccccttcagtgatgagtactag

SEQ ID NO: 143257 - DNA, 972 bp, Artificial Sequence; identical to SEQ ID NO: 143256
  Description of Artificial Sequence: Synthetic coding sequence

SEQ ID NO: 143258 - DNA, 747 bp, Artificial Sequence
  Description of Artificial Sequence: Synthetic coding sequence
tgaagcaagtaccagtgtgtgaagctgaatgatggccacttcatgcctgtgctgggcttcggcacctacgccccagctgaggtgggcctggccatccgcagcaagattgctgatggctctgtgaagcgggaggacatcttctacaccagcaagctgtggtgcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccgtggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgtag

SEQ ID NO: 143259 - DNA, 972 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccgtgaagctggccatcgaggccggcttccaccacattgattctgcccacgtgtacaacaatgaggagcaggtgggcctggccatccgcagcaagattgctgatggctctgtgaagcgggaggacatcttctacaccagcaagctgtggagcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccatggagaagtgcaaggatgctggcctggccaagagcattggagtgagcaacttcaaccaccggctgctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgaccagcgaggagatgaaggccattgatggcctgaacagaaatgtgcgctacctgaccctggacatctttgctggcccccccaactaccccttcagtgatgagtactag

SEQ ID NO: 143260 - DNA, 972 bp, Artificial Sequence; identical to SEQ ID NO: 143259
  Description of Artificial Sequence: Synthetic coding sequence

SEQ ID NO: 143261 - DNA, 894 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccgtgaagctggccatcgaggccggcttccaccacattgattctgcccacgtgtacaacaatgaggagcaggtgggcctggccatccgcagcaagattgctgatggctctgtgaagcgggaggacatcttctacaccagcaagctgtggagcaacagccacaggcctgagctggtgcggcctgccctggagaggagcctgaagaacctgcagctggactatgtggacctgtacctgatccacttccctgtgtctgtgaaggccatggagaagtgcaaggatgctggcctggccaagagcattggagtgagcaacttcaaccaccggctgctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgaccagcgaggagatgaaggccattgatggcctgaacagaaatgtgcgctacctgaccctggacatctttgctggcccccccaactaccccttcagtgatgagtactag

SEQ ID NO: 143262 - DNA, 420 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccgtgaagctggccatcgaggccggcttccaccacattgattctgcccacgtgtacaacaatgaggagcaggtgggcctggccatccgcagcaagattgctgatggctctgtgaagcgggaggacatcttctacaccagcaagctgtggagcaacagccacaggcctgagctggtgcggcctgccctggagaggagcctgaagaacctgcagctggactatgtggacctgtacctgatccacttccctgtgtctgtgaaggaggacatcggcatcctgacctggaagaagagccccaagcacaacagctag

SEQ ID NO: 143263 - DNA, 972 bp, Artificial Sequence
  Description of Artificial Sequence: Synthetic coding sequence
atggacagcaagcaccagtgtgtgaagctgaatgatggccacttcatgcctgtgctgggcttcggcacctacgcccctcctgaggtgcccaggagcaaggccctggaggtgaccaagctggccatcgaggccggcttccgccacattgattctgcccacctgtacaacaatgaggagcaggtgggcctggccatccgcagcaagattgctgatggctctgtgaagcgggaggacatcttctacaccagcaagctgtggagcaccttccacaggcctgagctggtgcggcctgccctggagaacagcctgaagaaggcccagctggactatgtggacctgtacctgatccacagccccatgagcctgaagccaggagaggagctgagccccacagatgaaaatggcaaggtgatctttgatattgtggacctgtgcaccacctgggaggccatggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaacagaagcaagctgctggacttctgcaagagcaaggacatcgtgctggtggcctacagcgccctgggcagccagagggacaagcgctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgacagctgaggacatgaaggccattgatggcctggacaggaacctgcactacttcaacagcgacagctttgccagccaccccaactacccctacagtgatgagtactag

SEQ ID NO: 143264 - DNA, 615 bp, Artificial Sequence
  Description of Artificial Sequence: Synthetic coding sequence
atgagcctgaagccaggagaggagctgagccccacagatgaaaatggcaaggtgatctttgacatcgtggacctgtgcaccacctgggaggccatggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaacagaagcaagctgctggacttctgcaagagcaaggacatcgtgctggtggcctacagcgccctgggcagccagagggacaagcgctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgacagctgaggacatgaaggccattgatggcctggacaggaacctgcactacttcaacagcgacagctttgccagccaccccaactacccctacagtgatgagtactag

SEQ ID NO: 143265 - DNA, 972 bp, Artificial Sequence
  Description of Artificial Sequence: Synthetic coding sequence
atggaccccaagtaccagagggtggagctgaatgatggccacttcatgcctgtgctgggcttcggcacctacgcccctcctgaggtgcccaggaacagagctgtggaggtgaccaagctggccatcgaggccggcttccgccacattgattctgcctacctgtacaacaatgaggagcaggtgggcctggccatccgcagcaagattgctgatggctctgtgaagcgggaggacatcttctacaccagcaagctgtggtgcaccttcttccagccccagatggtgcagcctgccctggagagcagcctgaagaagctgcagctggactatgtggacctgtacctgctgcacttccccatggccctgaagccaggagagacccccctgcccaaggatgaaaatggcaaggtgatctttgacacagtggacctgagcgccacctgggaggtgatggagaagtgcaaggatgctggcctggccaagagcattggagtgagcaacttcaactgccggcagctggagatgatcctgaacaagccaggcctgaagtacaagcctgtgtgcaaccaggtggagtgccacccctacctgaaccagagcaagctgctggacttctgcaagagcaaggacatcgtgctggtggcccacagcgccctgggcacccagaggcacaagctgtgggtggaccccaacagccctgtgctgctggaggaccctgtgctgtgtgccctggccaagaagcacaagcagaccccagccctgattgccctgcgctaccagctgcagaggggcgtggtggtgctggccaagagctacaatgagcagaggatccgggagaacatccaggtgtttgagttccagctgaccagcgaggacatgaaggtgctggatggcctgaacagaaactaccgctacgtggtgatggacttcctgatggaccacccagactaccccttcagtgatgagtactag

SEQ ID NO: 143266 - DNA, 972 bp, Artificial Sequence; identical to SEQ ID NO: 143265
  Description of Artificial Sequence: Synthetic coding sequence

SEQ ID NO: 143267 - DNA, 381 bp, Artificial Sequence
  Description of Artificial Sequence: Synthetic coding sequence
atggaccccaagtaccagagggtggagctgaatgatggccacttcatgcctgtgctgggcttcggcacctacgcccctcctgaggtgcccaggaacagagctgtggaggtgaccaagctggccatcgaggccggcttccgccacattgattctgcctacctgtacaacaatgaggagcaggtgggcctggccatccgcagcaagattgctgatggctctgtgaagcgggaggacatcttctacaccagcaagctgtggtgcaccttcttccagccccagatggtgcagcctgccctggagagcagcctgaagaagctgcagctggactatgtggacctgtacctgctgcacttccccatggccctgaagagcaccacctag

SEQ ID NO: 143268 - DNA, 981 bp, Artificial Sequence
  Description of Artificial Sequence: Synthetic coding sequence
atggacctgtctgctgccagccaccgcatccccctgagtgatggcaacagcatccccatcatcggcctgggcacctacagcgagcccaagagcacccccaagggggcctgtgccacctctgtgaaggtggccatcgacaccggctaccgccacattgatggagcctacatctaccagaatgagcacgaggtgggggaggccatccgggagaagattgctgagggcaaggtgcggcgggaggacatcttctactgcggcaagctgtgggccaccaaccacgtgcctgagatggtgcggcccaccctggagaggaccctgcgggtgctgcagctggactatgtggacctgtacatcatcgaggtgcccatggccttcaagccaggagatgagatctaccccagagatgaaaatggcaagtggctgtaccacaagagcaacctgtgtgccacctgggaggccatggaggcctgcaaggatgctggcctggtgaagagcctgggcgtgagcaacttcaacagacggcagctggagctgatcctgaacaagccaggcctgaagcacaagcctgtgagcaaccaggtggagtgccacccctacttcacccagcccaagctgctgaagttctgccagcagcacgacatcgtcatcacagcctacagccccctgggcaccagcaggaaccccatctgggtgaatgtgagcagcccccccctgctgaaggatgccctgctgaacagcctgggcaagcgctacaacaagacagctgcccagatcgtgctgcgcttcaacatccagaggggcgtggtggtgatccccaagagcttcaacctggagcgcatcaaggagaacttccagatctttgacttcagcctgacagaggaggagatgaaggacatcgaggccctgaacaagaatgtgcgctttgtggagctgctgatgtggagggaccaccctgagtaccccttccatgatgagtactag

SEQ ID NO: 143269 - DNA, 441 bp, Artificial Sequence
  Description of Artificial Sequence: Synthetic coding sequence
atggccttcaagccaggagatgagatctaccccagagatgaaaatggcaagtggctgtaccacaagagcaacctgtgtgccacctgggaggccatggaggcctgcaaggatgctggcctggtgaagagcctgggcgtgagcaacttcaacagacggcagctggagctgatcctgaacaagccaggcctgaagcacaagcctgtgagcaaccaggtggagtgccacccctacttcacccagcccaagctgctgaagttctgccagcagcacgacatcgtcatcacagcctacagccccctgggcaccagcaggaaccccatctggaggcagctgcacaagctggccctgctggacctgcccatcctgcgggtgaccctgcacagcgtgcacaccctgcacagcgagaagctggtgactggagacctgcagtgccctggatag

SEQ ID NO: 143270 - DNA, 672 bp, Artificial Sequence
  Description of Artificial Sequence: Synthetic coding sequence
atggcccaccgcttccctgccctgacccaggagcagaagaaggacagccagggcaagctgttcaggaacatcctgaaggagaagggcatcgtggtgggcatcaagctggaccagggcggggcccccctggccggcaccaacaaggagaccaccatccagggcctggatggcctgtctgagcgctgtgcccagtacaagaaggatggagtggactttgggaagtggagggctgtgctgagaattgctgaccagtgccccagcagcctggccatccaggagaatgccaatgccctggcccgctatgccagcatctgccagcagaatggcctggtgcccatcgtggagcctgaggtgatcccagatggagaccatgacctggagcactgccagtatgtgacagagaaggtgctggccgctgtgtacaaggccctgaatgaccaccacgtgtacctggagggcaccctgctgaagcccaacatggtgacagctggccacgcctgcaccaagaagtacaccccagagcaggtggccatggccaccgtgacagccctgcacaggacagtgcctgctgctgtgcccggcatctgcttcctgagcggcggcatgtctgaagaagatgccaccctgaacctgaatgccatccccaccagggtgcagtgccccccagcctag

SEQ ID NO: 143271 - DNA, 1095 bp, Artificial Sequence
  Description of Artificial Sequence: Synthetic coding sequence
atggcccaccgcttccctgccctgacccaggagcagaagaaggagctgtctgaaattgcccagagcatcgtggccaacgggaagggcatcctggccgcagatgagagcgtgggcaccatgggcaaccggctgcagaggatcaaggtggagaacacagaggagaacagacggcagttccgggagatcctcttctctgtggacagcagcatcaaccagagcatcggcggcgtcatcctcttccacgagaccctgtaccagaaggacagccagggcaagctgttcaggaacatcctgaaggagaagggcatcgtggtgggcatcaagctggaccagggcggggcccccctggccggcaccaacaaggagaccaccatccagggcctggatggcctgtctgagcgctgtgcccagtacaagaaggatggagtggactttgggaagtggagggctgtgctgagaattgctgaccagtgccccagcagcctggccatccaggagaatgccaatgccctggcccgctatgccagcatctgccagcagaatggcctggtgcccatcgtggagcctgaggtgatcccagatggagaccatgacctggagcactgccagtatgtgacagagaaggtgctggccgctgtgtacaaggccctgaatgaccaccacgtgtacctggagggcaccctgctgaagcccaacatggtgacagctggccacgcctgcaccaagaagtacaccccagagcaggtggccatggccaccgtgacagccctgcacaggacagtgcctgctgctgtgcccggcatctgcttcctgagcggcggcatgtctgaggaggatgccaccctgaacctgaatgccatcaacctgtgccccctgcccaagccctggaagctgtccttctcctatggccgggccctgcaggccagcgccctggccgcctggggcggcaaggccgccaacaaggaggccacccaggaggccttcatgaagagggccatggccaactgccaggccgccaagggccagtatgtgcacacaggcagcagtggagctgccagcacccagagcctcttcaccgcctgctacacctactag

SEQ ID NO: 143272 - DNA, 951 bp, Artificial Sequence
  Description of Artificial Sequence: Synthetic coding sequence
atggcccaccgcttccctgccctgacccaggagcagaagaaggagctgtctgaaattgcccagagcatcgtggccaacgggaagggcatcctggccgcagatgagagcgtgggcaccatgggcaaccggctgcagaggatcaaggtggagaacacagaggagaacagacggcagttccgggagatcctcttctctgtggacagcagcatcaaccagagcatcggcggcgtcatcctcttccacgagaccctgtaccagaaggacagccagggcaagctgttcaggaacatcctgaaggagaagggcatcgtggtgggcatcaagctggaccagggcggggcccccctggccggcaccaacaaggagaccaccatccagggcctggatggcctgtctgagcgctgtgcccagtacaagaaggatggagtggactttgggaagtggagggctgtgctgagaattgctgaccagtgccccagcagcctggccatccaggagaatgccaatgccctggcccgctatgccagcatctgccagcagaatggcctggtgcccatcgtggagcctgaggtgatcccagatggagaccatgacctggagcactgccagtatgtgacagagaaggtgctggccgctgtgtacaaggccctgaatgaccaccacgtgtacctggagggcaccctgctgaagcccaacatggtgacagctggccacgcctgcaccaagaagtacaccccagagcaggtggccatggccaccgtgacagccctgcacaggacagtgcctgctgctgtgcccggcatctgcttcctgagcggcggcatgtctgaggaggatgccaccctgaacctgaatgccatcaacctgtgccccctgcccaagccctggaagctgtccttctctggagtggcccggctgcagacccggcggcagccccggcggctgctgtag

SEQ ID NO: 143273 - DNA, 1947 bp, Artificial Sequence
  Description of Artificial Sequence: Synthetic coding sequence
atggtgtccctgcccccaccccagagtgatgtgaccctgcccggccccacccggctggagggggagcggcagggcgacctgatgcaggcccctggcctgcccggcagccctgccccccagagcaagcacgccggcttcagctgcagcagctttgtgtctgatggccccccagagaggacccccagcctgcccccccacagcccccgcatcgccagccctggccctgagcaggtgcagggccactgcccagctggccctggccctggccccttccggctgagccccagcgacaagtacccaggcttcggctttgaggaggccgccgccagcagccctggccgcttcctgaagggcagccacgcccccttccacccctacaagaggcccttccatgaagatgtgtttcctgaggccgagaccaccctggccctgaagggccacagcttcaagaccccaggccccctggaggcctttgaggagatccctgtggatgtggccgaggccgaggccttcctgcccggcttctctgctgaggcctggtgcaatggcctgccctaccccagccaggagcacggcccccaggtgctgggcagcgaggtgaaggtgaagccccctgtgctggagagcggggccggcatgttctgctaccagccccccctgcagcacatgtactgcagcagccagccccccttccaccagtacagccctgggggcggcagctaccccatcccctacctgggcagcagccactaccagtaccagaggatggccccccaggccagcacagatggccaccagcccctcttccccaagcccatctacagctacagcatcctgatcttcatggccctgaagaacagcaagacaggcagcctgcctgtgtctgagatctacaacttcatgacagagcacttcccctacttcaagacagccccagatggctggaagaacagcgtgcgccacaacctgagcctgaacaagtgctttgagaaggtggagaacaagagcggcagcagcagcaggaagggctgcctgtgggccctgaacccagccaagattgacaagatgcaggaggagctgcagaagtggaagaggaaggaccccatcgctgtgaggaagtccatggccaagccagaggagctggacagcctgattggagacaagcgggagaagctgggcagccccctgctgggctgccccccacctggcctgagcggcagcggccccatccggcccctggcccctcctgctggcctgagcccccccctgcacagcctgcacccagcccctggccccatccctgggaagaaccccctgcaggacctgctgatgggccacacccccagctgctacggccagacctacctgcacctgagccctggcctggcccctcctggccccccccagcccctcttcccccagccagatggccacctggagctgcgggcccagcccggcaccccccaggacagccccctgcctgcccacaccccacccagccacagcgccaagctgctggccgagcccagccctgcccggaccatgcatgacaccctgctgcctgatggagacctgggcacagacctggatgccatcaaccccagcctgacagactttgacttccagggcaacctgtgggagcagctgaaggatgacagcctggccctggaccccctggtgctggtgaccagcagccccaccagcagctccatgcccccaccccagcccccaccccactgcttccccccaggcccctgcctgacagagaccggcagcggggccggggacctggccgcccctggcagcggcggcagcggggccctgggggacctgcacctgaccaccctgtacagcgccttcatggagctggagcccaccccacccacagccccagctggccccagcgtgtacctgagccccagcagcaagcctgtggccctggcctag

SEQ ID NO: 143274 - DNA, 1095 bp, Artificial Sequence
  Description of Artificial Sequence: Synthetic coding sequence
atgccccacagctacccagccctgtctgctgagcagaagaaggagctgagtgacatcgccctgagaattgtggcccctgggaagggcatcctggccgcagatgagagcgtgggctccatggccaagaggctgagccagattggagtggagaacacagaggagaacagaaggctgtaccggcaggtgctcttcagcgcagatgacagagtgaagaagtgcatcggcggcgtcatcttcttccacgagaccctgtaccagaaggatgacaacggggtgccctttgtgaggaccatccaggacaagggcatcgtggtgggcatcaaggtggacaagggcgtggtgcccctggccggcacagatggagagaccaccacccagggcctggatggcctgtctgagcgctgtgcccagtacaagaaggatggagctgactttgccaagtggaggtgtgtgctgaagatcagcgagaggacccccagcgccctggccatcctggagaatgccaacgtgctggcccgctatgccagcatctgccagcagaatggaattgtgcccatcgtggagcctgagatcctgcctgatggagaccatgacctgaagcgctgccagtatgtgacagagaaggtgctggccgctgtgtacaaggccctgagtgaccaccacgtgtacctggagggcaccctgctgaagcccaacatggtgaccccaggccacgcctgccccatcaagtacaccccagaggagatcgccatggccaccgtgacagccctgcggaggacagtgcccccagctgtgcctggggtgaccttcctgagcggcggccagagcgaggaggaggccagcttcaacctgaatgccatcaaccgctgccccctgccccggccctgggccctgaccttctcctatggccgggccctgcaggccagcgccctgaatgcctggaggggccagagggacaatgctggggccgccacagaggagttcatcaagagagctgaggtgaatggcctggccgcccagggcaagtatgagggcagcggggaggatggaggagctgctgcccagagcctgtacatcgccaaccacgcctactag

SEQ ID NO: 143275 - DNA, 450 bp, Artificial Sequence
  Description of Artificial Sequence: Synthetic coding sequence
atgccccacagctacccagccctgtctgctgagcagaagaaggagctgagtgacatcgccctgagaattgtggcccctgggaagggcatcctggccgcagatgagagcgtgggctccatggccaagaggctgagccagattggagtggagaacacagaggagaacagaaggctgtaccggcaggtgctcttcagcgcagatgacagagtgaagaagtgcatcggcggcgtcatcttcttccacgagaccctgtaccagaaggatgacaacggggtgccctttgtgaggaccatccaggacaagggcatcgtggtgggcatcaaggtggacaagggcgtggtgcccctggccggcacagatggagagaccaccacccagggcctggatggcctgtctgagcgctgtgcccagtacaagaaggatggagctgactttgccaagtggaggtag

SEQ ID NO: 143276 - DNA, 795 bp, Artificial Sequence
  Description of Artificial Sequence: Synthetic coding sequence
atgcccagcatctttgcctaccagagcagcgaggtggactggtgtgagagcaacttccagtacagcgagctggtggccgagttctacaacaccttcagcaacatccccttcttcatcttcggccccctgatgatgctgctgatgcacccctatgcccagaagaggagccgctacatctacgtggtgtgggtgctcttcatgatcatcggcctcttctccatgtacttccacatgaccctgtccttcctgggccagctgctggatgagatcgccatcctgtggctgctgggcagcggctacagcatctggatgccccgctgctacttccccagcttcctgggcggcaacagaagccagttcatccggctggtgttcatcaccaccgtggtgtccaccctgctgtccttcctgcggcccaccgtgaatgcctatgccctgaacagcatcgccctgcacatcctgtacatcgtgtgccaggagtacaggaagaccagcaacaaggagctgcggcacctgattgaggtgtctgtggtgctgtgggccgtggccctgacctcctggatcagtgaccggctgctgtgcagcttctggcagaggatccacttcttctacctgcacagcatctggcacgtgctgatcagcatcaccttcccctacggcatggtgaccatggccctggtggatgccaactatgagatgcctggagagaccctgaaggtgcgctactggccccgggacagctggcctgtgggcctgccctacgtggagatcagaggagatgacaaggactgctag

SEQ ID NO: 143277 - DNA, 828 bp, Artificial Sequence
  Description of Artificial Sequence: Synthetic coding sequence
atgggcgccccccactggtgggaccagctgcaggccggcagcagcgaggtggactggtgtgaggacaactacaccatcgtgcctgccatcgccgagttctacaacaccatcagcaatgtgctcttcttcatcctgccccccatctgcatgtgcctcttccggcagtatgccacctgcttcaacagcggcatctacctgatctggaccctgctggtggtggtgggcatcggctctgtgtacttccacgccaccctgtccttcctgggccagatgctggatgagctggccgtgctgtgggtgctgatgtgtgccctggccatgtggttcccccggcgctacctgcccaagatcttcagaaatgaccggggccgcttcaaggtggtggtgtctgtgctgtctgctgtgaccacctgcctggcctttgtgaagccagccatcaacaacatcagcctgatgaccctgggcgtgccctgcacagccctgctgattgctgagctgaagagatgtgacaacatgagggtcttcaagctgggcctcttcagcggcctgtggtggaccctggccctcttctgctggatcagtgaccgggccttctgtgagctgctgagcagcttcaacttcccctacctgcactgcatgtggcacatcctgatctgcctggccgcctacctgggctgtgtgtgctttgcctactttgatgctgccagcgagatccctgagcagggccctgtgatcaagttctggcccaatgagaagtgggccttcatcggcgtgccctacgtgtccctgctgtgtgccaacaagaagagctctgtgaagatcacctag

SEQ ID NO: 143278 - DNA, 423 bp, Artificial Sequence
  Description of Artificial Sequence: Synthetic coding sequence
atgtgcctcttccggcagtatgccacctgcttcaacagcggcatctacctgatctggaccctgctggtggtggtgggcatcggctctgtgtacttccacgccaccctgtccttcctgggccagatgctggatgagctggccgtgctgtgggtgctgatgtgtgccctggccatgtggttcccccggcgctacctgcccaagatcttcagaaatgaccggggccgcttcaaggtggtggtgtctgtgctgtctgctgtgaccacctgcctggcctttgtgaagccagccatcaacaacatcagcctgatgaccctgggcgtgccctgcacagccctgctgattgctgagctgaagagacatgagaggaaccagaggcggcggcacaggaagggcggccagcagggcggcggggacaaggtgtag

SEQ ID NO: 143279 - DNA, 1587 bp, Artificial Sequence
  Description of Artificial Sequence: Synthetic coding sequence
atgcagggcccctgggtgctgctgctgctgggcctgcggctgcagctgagcctgggcgtcatcccagctgaggaggagaacccagccttctggaaccggcaggccgctgaggccctggatgctgccaagaagctgcagcccatccagaaggtggccaagaacctgatcctcttcctgggagatggcctgggcgtgcccaccgtgacagccacccgcatcctgaagggccagaagaatggcaagctgggccctgagacccccctggccatggaccgcttcccctacctggccctgagcaagacctacaacgtggaccggcaggtgcctgattctgctgccacagccacagcctacctgtgtggggtgaaggccaacttccagaccatcggcctgtctgctgctgcccgcttcaaccagtgcaacaccaccagaggaaatgaggtgatctctgtgatgaacagagccaagcaggccggcaagtctgtgggcgtggtgaccaccaccagggtgcagcacgccagccctgctggcacctacgcccacacagtgaacagaaactggtacagtgatgctgacatgcctgccagcgcccggcaggagggctgccaggacatcgccacccagctgatcagcaacatggacattgatgtgatcctgggcggcggcaggaagtacatgttccccatgggcaccccagaccctgagtacccagcagatgccagccagaatggcatccggctggatggcaagaacctggtgcaggagtggctggccaagcaccagggcgcctggtacgtgtggaacagaacagagctgatgcaggccagcctggaccagagcgtgacccacctgatgggcctgtttgagcccggggacaccaagtatgagatccaccgggaccccaccctggaccccagcctgatggagatgacagaagctgccctgcggctgctgagcaggaacccccggggcttctacctgtttgtggagggcggcagaattgaccacggccaccatgaaggagtggcctaccaggccctgacagaggccgtgatgtttgatgatgccatcgagcgggccggccagctgaccagcgaggaggacaccctgaccctggtgacagctgaccacagccacgtgttctcctttggaggctacaccctgcggggcagcagcatcttcggcctggcccccagcaaggcccaggacagcaaggcctacaccagcatcctgtatggaaatggacctggctacgtgttcaacagcggcgtgcggccagatgtgaatgaaagtgaaagtggcagcccagactaccagcagcaggccgctgtgcccctgagcagcgagacccatggaggagaagatgtggccgtgtttgcccggggcccccaggcccacctggtgcatggagtgcaggagcagagctttgtggcccacgtgatggcctttgctgcctgcctggagccctacacagcctgtgacctggcccccccagcctgcaccacagatgctgcccaccctgtggccgccagcctgcccctgctggccggcaccctgctgctgctgggcgccagcgctgccccctag

SEQ ID NO: 143280 - DNA, 513 bp, Artificial Sequence
  Description of Artificial Sequence: Synthetic coding sequence
atggaccgggccatcggccaggccggcagcctgaccagcagcgaggacaccctgactgtggtgacagctgaccacagccacgtgttcacctttggaggctacaccccccggggcaacagcatcttcggcctggcccccatgctgagtgacacagacaagaagcccttcaccgccatcctgtatggaaatggacctggctacaaggtggtgggcggggagagagaaaatgtgtccatggtggactatgcccacaacaactaccaggcccagagcgctgtgcccctgcggcatgagacccacggcggagaagatgtggccgtgttcagcaagggccccatggcccacctgctgcacggcgtgcatgagcagaactacgtgccccacgtgatggcctatgctgcctgcatcggggccaacctgggccactgtgccccagccagcagcgctggcagcctggccgccggccccctgctgctggccctggccctgtaccccctgtctgtgctcttctag

SEQ ID NO: 143281 - DNA, 513 bp, Artificial Sequence; identical to SEQ ID NO: 143280
  Description of Artificial Sequence: Synthetic coding sequence

SEQ ID NO: 143282 - DNA, 1575 bp, Artificial Sequence
  Description of Artificial Sequence: Synthetic coding sequence
atgatcagccccttcctggtgctggccatcggcacctgcctgaccaacagcctggtgcctgagaaggagaaggaccccaagtactggagggaccaggcccaggagaccctgaagtatgccctggagctgcagaagctgaacaccaacgtggccaagaatgtcatcatgttcctgggagatggcatgggcgtgtccacagtgacagctgcccgcatcctgaagggccagctgcaccacaaccctggagaggagacccggctggagatggacaagttcccctttgtggccctgagcaagacctacaacaccaatgcccaggtgcctgacagcgctggaacagccacagcctacctgtgtggggtgaaggccaatgaaggaacagtgggcgtgtctgctgccacagagaggagccgctgcaacaccacccagggcaatgaggtgaccagcatcctgcgctgggccaaggatgctgggaagtctgtgggcatcgtgaccaccaccagggtgaaccacgccaccccatctgctgcctatgcccacagcgctgaccgggactggtacagcgacaatgagatgcctcctgaggccctgagccagggctgcaaggacatcgcctaccagctgatgcacaacatccgggacattgatgtgatcatgggcggcggcaggaagtacatgtaccccaagaacaagacagatgtggagtatgaaagtgatgagaaggcccggggcacccggctggatggcctggacctggtggacacctggaagagcttcaagccccgctacaagcacagccacttcatctggaacagaacagagctgctgaccctggacccccacaacgtggactacctgctgggcctgtttgagcccggggacatgcagtatgagctgaacagaaataatgtgacagaccccagcctgtctgagatggtggtggtggccatccagatcctgaggaagaaccccaagggcttcttcctgctggtggagggcggcagaattgaccacggccaccacgagggcaaggccaagcaggccctgcacgaggccgtggagatggaccgggccatcggccaggccggcagcctgaccagcagcgaggacaccctgactgtggtgacagctgaccacagccacgtgttcacctttggaggctacaccccccggggcaacagcatcttcggcctggcccccatgctgagtgacacagacaagaagcccttcaccgccatcctgtatggaaatggacctggctacaaggtggtgggcggggagagagaaaatgtgtccatggtggactatgcccacaacaactaccaggcccagagcgctgtgcccctgcggcatgagacccacggcggagaagatgtggccgtgttcagcaagggccccatggcccacctgctgcacggcgtgcatgagcagaactacgtgccccacgtgatggcctatgctgcctgcatcggggccaacctgggccactgtgccccagccagcagcgctggcagcctggccgccggccccctgctgctggccctggccctgtaccccctgtctgtgctcttctag

SEQ ID NO: 143283 - DNA, 1575 bp, Artificial Sequence; identical to SEQ ID NO: 143282
  Description of Artificial Sequence: Synthetic coding sequence

SEQ ID NO: 143284 - DNA, 1575 bp, Artificial Sequence; identical to SEQ ID NO: 143282
  Description of Artificial Sequence: Synthetic coding sequence

SEQ ID NO: 143285 - DNA, 1344 bp, Artificial Sequence
  Description of Artificial Sequence: Synthetic coding sequence
atgccctggagcttccgcagcagcacccccacctggctgaggatgagcagctgctcctgggagatgacctacaacaccaatgcccaggtgcctgattctgctggaacagccacagcctacctgtgtggggtgaaggccaatgaaggcaccgtgggcgtgtctgctgccacagagaggagccgctgcaacaccacccagggcaatgaggtgaccagcatcctgcgctgggccaaggatgctgggaagtctgtgggcatcgtgaccaccaccagggtgaaccacgccacccccagcgctgcctatgcccacagcgctgaccgggactggtacagcgacaatgagatgcctcctgaggccctgagccagggctgcaaggacatcgcctaccagctgatgcacaacatccgggacattgatgtgatcatgggcggcggcaggaagtacatgtaccccaagaacaagacagatgtggagtatgaaagtgatgagaaggcccggggcacccggctggatggcctggacctggtggacacctggaagagcttcaagccccgctacaagcacagccacttcatctggaacagaacagagctgctgaccctggacccccacaacgtggactacctgctgggcctgtttgagcccggggacatgcagtatgagctgaacagaaacaacgtgacagaccccagcctgtctgagatggtggtggtggccatccagatcctgaggaagaaccccaagggcttcttcctgctggtggagggcggcagaattgaccacggccaccacgagggcaaggccaagcaggccctgcatgaagctgtggagatggaccgggccatcggccaggccggcagcctgaccagcagcgaggacaccctgactgtggtgacagctgaccacagccacgtgttcaccttcggcggctacaccccccggggcaacagcatcttcggcctggcccccatgctgagtgacacagacaagaagcccttcaccgccatcctgtatggaaatggacctggctacaaggtggtgggcggggagcgggagaatgtgtccatggtggactatgcccacaacaactaccaggcccagagcgctgtgcccctgcggcatgagacccatggaggagaagatgtggccgtgttcagcaagggccccatggcccacctgctgcatggagtgcatgagcagaactacgtgccccacgtgatggcctatgctgcctgcattggagccaacctgggccactgtgccccagccagcagcgctggcagcctggccgccggccccctgctgctggccctggccctgtaccccctgtctgtgctcttctag

SEQ ID NO: 143286 - DNA, 1410 bp, Artificial Sequence
  Description of Artificial Sequence: Synthetic coding sequence
atgttcctgggagatggcatgggcgtgtccacagtgacagctgcccgcatcctgaagggccagctgcaccacaaccctggagaggagacccggctggagatggacaagttcccctttgtggccctgagcaagacctacaacaccaatgcccaggtgcctgattctgctggaacagccacagcctacctgtgtggggtgaaggccaatgaaggcaccgtgggcgtgtctgctgccacagagaggagccgctgcaacaccacccagggcaatgaggtgaccagcatcctgcgctgggccaaggatgctgggaagtctgtgggcatcgtgaccaccaccagggtgaaccacgccacccccagcgctgcctatgcccacagcgctgaccgggactggtacagcgacaatgagatgcctcctgaggccctgagccagggctgcaaggacatcgcctaccagctgatgcacaacatccgggacattgatgtgatcatgggcggcggcaggaagtacatgtaccccaagaacaagacagatgtggagtatgaaagtgatgagaaggcccggggcacccggctggatggcctggacctggtggacacctggaagagcttcaagccccgctacaagcacagccacttcatctggaacagaacagagctgctgaccctggacccccacaacgtggactacctgctgggcctgtttgagcccggggacatgcagtatgagctgaacagaaacaacgtgacagaccccagcctgtctgagatggtggtggtggccatccagatcctgaggaagaaccccaagggcttcttcctgctggtggagggcggcagaattgaccacggccaccacgagggcaaggccaagcaggccctgcatgaagctgtggagatggaccgggccatcggccaggccggcagcctgaccagcagcgaggacaccctgactgtggtgacagctgaccacagccacgtgttcaccttcggcggctacaccccccggggcaacagcatcttcggcctggcccccatgctgagtgacacagacaagaagcccttcaccgccatcctgtatggaaatggacctggctacaaggtggtgggcggggagcgggagaatgtgtccatggtggactatgcccacaacaactaccaggcccagagcgctgtgcccctgcggcatgagacccatggaggagaagatgtggccgtgttcagcaagggccccatggcccacctgctgcatggagtgcatgagcagaactacgtgccccacgtgatggcctatgctgcctgcattggagccaacctgggccactgtgccccagccagcagcgctggcagcctggccgccggccccctgctgctggccctggccctgtaccccctgtctgtgctcttctag

SEQ ID NO: 143287 - DNA, 1608 bp, Artificial Sequence
  Description of Artificial Sequence: Synthetic coding sequence
atgctgggcccctgcatgctgctgctgctgctgctgctgggcctgcggctgcagctgagcctgggcatcatccctgtggaggaggagaacccagacttctggaaccgggaggccgctgaggccctgggcgccgccaagaagctgcagcctgcccagacagctgccaagaacctgatcatcttcctgggagatggcatgggcgtgtccacagtgacagctgcccgcatcctgaagggccagaagaaggacaagctgggccctgagatccccctggccatggaccgcttcccctacgtggccctgagcaagacctacaacgtggacaagcacgtgcctgacagcggggccacagccacagcctacctgtgtggggtgaagggcaacttccagaccatcggcctgtctgctgctgcccgcttcaaccagtgcaacaccaccagaggaaatgaagtcatctctgtgatgaacagagccaagaaggccggcaagtctgtgggcgtggtgaccaccaccagggtgcagcacgccagccctgctggcacctacgcccacacagtgaacagaaactggtacagtgatgctgatgtgcctgccagcgcccggcaggagggctgccaggacatcgccacccagctgatcagcaacatggacattgatgtgatcctgggcggcggcaggaagtacatgttcaggatgggcaccccagaccctgagtacccagatgactacagccagggcggcacccggctggatggcaagaacctggtgcaggagtggctggccaagaggcagggcgcccgctacgtgtggaacagaacagagctgatgcaggccagcctggaccccagcgtgacccacctgatgggcctgtttgagcccggggacatgaagtatgagatccaccgggacagcaccctggaccccagcctgatggagatgacagaggccgccctgcggctgctgagcaggaacccccggggcttcttcctgtttgtggagggcggcagaattgaccacggccaccacgagagccgggcctaccgggccctgacagagaccatcatgtttgatgatgccatcgagagagctggccagctgaccagcgaggaggacaccctgagcctggtgacagctgaccacagccacgtgttctcctttggaggctaccccctgcggggcagcagcatcttcggcctggcccctgggaaggcccgggacaggaaggcctacacagtgctgctgtatggaaatggacctggctacgtgctgaaggatggagcccggccagatgtgacagagagcgagagcggcagccctgagtaccggcagcagagcgctgtgcccctggatgaggagacccatgctggagaagatgtggccgtgtttgcccggggcccccaggcccacctggtgcacggcgtgcaggagcagaccttcatcgcccacgtgatggcctttgctgcctgcctggagccctacacagcctgtgacctggcccccccagctggcaccacagatgctgcccaccctggccgctctgtggtgcctgccctgctgcccctgctggccggcaccctgctgctgctggagacagccacagccccctag

SEQ ID NO: 143288 - DNA, 1599 bp, Artificial Sequence
  Description of Artificial Sequence: Synthetic coding sequence
atgcagggcccctgggtgctgctgctgctgggcctgcggctgcagctgagcctgggcatcatccctgtggaggaggagaacccagacttctggaaccggcaggccgctgaggccctgggcgccgccaagaagctgcagcctgcccagacagctgccaagaacctgatcatcttcctgggagatggcatgggcgtgtccacagtgacagctgcccgcatcctgaagggccagaagaaggacaagctgggccctgagaccttcctggccatggaccgcttcccctacgtggccctgagcaagacctacagcgtggacaagcacgtgcctgattctggggccacagccacagcctacctgtgtggggtgaagggcaacttccagaccatcggcctgtctgctgctgcccgcttcaaccagtgcaacaccaccagaggaaatgaggtgatctctgtgatgaacagagccaagaaggccggcaagtctgtgggcgtggtgaccaccaccagggtgcagcacgccagccctgctggggcctatgcccacacagtgaacagaaactggtacagtgatgctgatgtgcctgccagcgcccggcaggagggctgccaggacatcgccacccagctgatcagcaacatggacattgatgtgatcctgggcggcggcaggaagtacatgttccccatgggcaccccagaccctgagtacccagatgactacagccagggcggcacccggctggatggcaagaacctggtgcaggagtggctggccaagcaccagggcgcccgctacgtgtggaacagaacagagctgctgcaggccagcctggaccccagcgtgacccacctgatgggcctgtttgagcccggggacatgaagtatgagatccaccgggacagcaccctggaccccagcctgatggagatgacagaagctgccctgctgctgctgagcaggaacccccggggcttcttcctgtttgtggagggcggcagaattgaccacggccaccacgagagccgggcctaccgggccctgacagagaccatcatgtttgatgatgccatcgagcgggccggccagctgaccagcgaggaggacaccctgagcctggtgacagctgaccacagccacgtgttctcctttggaggctaccccctgcggggcagcagcatcttcggcctggcccctgggaaggcccgggacaggaaggcctacacagtgctgctgtatggaaatggacctggctacgtgctgaaggatggagcccggccagatgtgacagaaagtgaaagtggcagccctgagtaccggcagcagagcgctgtgcccctggatggagagacccacgccggggaggatgtggccgtgtttgcccggggcccccaggcccacctggtgcatggagtgcaggagcagaccttcatcgcccacgtgatggcctttgctgcctgcctggagccctacacagcctgtgacctggcccccagggctggcaccacagatgctgcccaccctggccccagcgtggtgcctgccctgctgcccctgctggccggcaccctgctgctgctgggcacagccacagccccctag

SEQ ID NO: 143289 - DNA, 474 bp, Artificial Sequence
  Description of Artificial Sequence: Synthetic coding sequence
atggaccgcttcctggtgaagggggcccagggcggcctgctgaggaagcaggaggagcaggagcccactggagaggagcctgctgtgctgggcggggacaaggagagcaccaggaagaggccccggcgggaggcccctggaaatggaggccacagcgctggccccagctggaggcacatccgggcagagggcctggactgcagctacacagtgctgtttgggaaggccgaggctgatgagatcttccaggagctggagaaggaggtggagtacttcaccggcatcaagatggctgtgaccaccagcggcagcacagagatgatgaaggagaactggcccctgggcgcccccctgcccctgagccccagcgtgcctgctgagaccctgagcagcggcatccgcatccctgtgggcaaggcccctcctgggggctggcgctggagcggctgccgctggcccaccggggcctactag

SEQ ID NO: 143290 - DNA, 2958 bp, Artificial Sequence
  Description of Artificial Sequence: Synthetic coding sequence
atgatcagacatgctggggccccagcccggggggaccccaccggccctgtgcctgtggtgggcaagggggaggaggaggaggaggaggatggcatgaggctgtgcctgcctgccaaccccaagaactgcctgccccacagaagaggcatcagcatcctggagaagctgatcaagacctgccctgtgtggctgcagctgagcctgggccaggccgaggtggcccgcatcctgcaccgggtggtggccggcatgttcctggtgcggcgggacagcagcagcaagcagctggtgctgtgtgtgcacttccccagcctgaatgaatcttctgctgaggtgctggagtacaccatcaaggaggagaagagcatcctgtacctggagggcagcgccctggtgtttgaggacatcttccgcctcatcgccttctactgtgtgtcccgggacctgctgcccttcaccctgcggctgccccaggccatcctggaggccagcagcttcacagacctggagaccatcgccaacctgggcctgggcttctgggacagcagcctgaaccccccccaggagcggggcaagccagctgagcccccccgggaccgggcccctggcttccccctggtgagcagcctgcggcccacagcccatgatgccaactgtgcctgtgaaattgagctgtctgtgggcaatgaccggctgtggtttgtgaaccccatcttcatcgaggactgcagcagcgccctgcccacagaccagccccccctgggcaactgcccagcccggcccctgccccccaccagtgatgccaccagccccaccagccgctgggccccccggcggcccccacctcctcctcctgtgctgcccctgcagccctgcagccctgcccagccccctgtgctgcctgccctggccccagccccagcctgccccctgcccaccagcccccctgtgcctgcccctcatgtgacccctcatgcccctggccccccagaccaccccaaccagccccccatgatgacctgtgagcggctgccctgccccacagctggcctgggccccctgcgggaggaggccatgaagccaggagctgccagcagccccctgcagcaggtgcctgccccacccctgcctgccaagaagaacctgcccacagccccacccaggagaagagtgtctgagcgggtgtccctggaggaccagagccctggcatggctgctgagggggaccagctgagcctgcccccccagggcaccagtgatggccctgaggacaccccccgggagagcacagagcagggccaggacacagaggtgaaggccagtgacccccacagcatgcctgagctgcccaggacagccaagcagccccctgtgcccccacccaggaagaagaggatcagccggcagctggccagcaccctgcctgcccccctggagaatgctgagctgtgcacccaggccatggccctggagacccccaccccaggccccccccgggagggccagagccctgccagccaggccggcacccagcaccccccagcccaggccacagcccacagccagagcagccctgagttcaagggcagcctggccagcctgagtgacagcctgggcgtgtctgtgatggccacagaccaggacagctacagcaccagcagcacagaggaggagctggagcagttcagcagccccagcgtgaagaagaagcccagcatgatcctgggcaaggcccggcaccggctgagctttgccagcttcagctccatgttccacgccttcctgagcaacaacaggaagctgtacaagaaggtggtggagctggcccaggacaagggcagctacttcggcagcctggtgcaggactacaaggtgtacagcctggagatgatggcccggcagaccagcagcacagagatgctgcaggagatccgcaccatgatgacccagctgaagagctacctgctgcagagcacagagctgaaggccctggtggaccctgccctgcacagcgaggaggagctggaggccatcgtggagagcgccctgtacaagtgtgtgctgaagcccctgaaggaggccatcaacagctgcctgcaccagatccacagcaaggatggcagcctgcagcagctgaaggagaaccagctggtgatcctggccaccaccaccacagacctgggcgtgaccacctctgtgcctgaggtgcccatgatggagaagatcctgcagaagttcacctccatgcacaaggcctacagccctgagaagaagatcagcatcctgctgaagacctgcaagctgatctatgacagcatggccctgggcaaccctgggaagccctacggggctgatgacttcctgcctgtgctgatgtatgtgctggcccggagcaacctgacagagatgctgctgaatgtggagtacatgatggagctgatggaccctgccctgcagctgggggagggcagctactacctgaccaccacctatggagccctggagcacatcaagagctatgacaagatcaccgtgacccggcagctgtctgtggaggtgcaggacagcatccaccgctgggagaggaggaggaccctgaacaaggcccgggccagccgcagctctgtgcaggacttcatctgtgtgtcctacctggagcctgagcagcaggcccggaccctggccagcagagctgacacccaggcccaggccctgtgtgcccagtgtgccgagaagtttgctgtggagcggccccaggcccaccggctgtttgtgctggtggatggccgctgcttccagctggctgatgatgccctgccccactgcatcaagggctacctgctgcggtctgagcccaagagggacttccactttgtgtaccggcccctggatggcggcggcggcggcggcggcggcagccccccctgcctggtggtgcgggagcccaacttcctgtag

SEQ ID NO: 143291 - DNA, 786 bp, Artificial Sequence
  Description of Artificial Sequence: Synthetic coding sequence
atggaccgcttcctggtgaagggggcccagggcggcctgctgaggaagcaggaggagcaggagcccactggagaggagcctgctgtgctgggcggggacaaggagagcaccaggaagaggccccggcgggaggcccctggaaatggaggccacagcgctggccccagctggaggcacatccgggcagagggcctggactgcagctacacagtgctgtttgggaaggccgaggctgatgagatcttccaggagctggagaaggaggtggagtacttcaccggggccctggcccgggtgcaggtgtttgggaagtggcacagcgtgcccaggaagcaggccacctatggagatgctggcctgacctacaccttcagcggcctgaccctgagccccaagccctggatccctgtgctggagcgcatccgggaccacgtgtctggagtgacaggccagaccttcaactttgtgctgatcaaccgctacaaggatggctgtgaccacatcggggagcacagagatgatgagcgggagctggcccctggcagccccatcgcctctgtgtcctttggagcctgccgggactttgtgttccgccacaaggacagccggggcaagagccccagcagaagagtggccgtggtgcggctgcccctggcccacggcagcctgctgatgatgaaccaccccaccaacacccactggtaccacagcctgcctgtgaggaagaaggtgctggccccccgggtgaacctgaccttcaggaagatcctgctgaccaagaagtag

SEQ ID NO: 143292 - DNA, 786 bp, Artificial Sequence; identical to SEQ ID NO: 143291
  Description of Artificial Sequence: Synthetic coding sequence

SEQ ID NO: 143293 - DNA, 786 bp, Artificial Sequence; identical to SEQ ID NO: 143291
  Description of Artificial Sequence: Synthetic coding sequence

SEQ ID NO: 143294 - DNA, 453 bp, Artificial Sequence
  Description of Artificial Sequence: Synthetic coding sequence
atggaccgcttcctggtgaagggggcccagggcggcctgctgaggaagcaggaggagcaggagcccactggagaggagcctgctgtgctgggcggggacaaggagagcaccaggaagaggccccggcgggaggcccctggaaatggaggccacagcgctggccccagctggaggcacatccgggcagagggcctggactgcagctacacagtgctgtttgggaaggccgaggctgatgagatcttccaggagctggagaaggaggtggagtacttcaccggggccctggcccgggtgcaggtgtttgggaagtggcacagcgtgcccaggaagcaggccacctatggagatgctggcctgacctacaccttcagcggcctgaccctgagccccaagccctggatccctgtgctggagcgcatccgggaccacgtgtctggagtgactggatag

SEQ ID NO: 143295 - DNA, 366 bp, Artificial Sequence
  Description of Artificial Sequence: Synthetic coding sequence
atggaccgcttcctggtgaagggggcccagggcggcctgctgaggaagcaggaggagcaggagcccactggagaggagcctgctgtgctgggcggggacaaggagagcaccaggaagaggccccggcgggaggcccctggaaatggaggccacagcgctggccccagctggaggcacatccgggcagagggcctggactgcagctacacagtgctgtttgggaaggccgaggctgatgagatcttccaggagctggagaaggaggtggagtacttcaccggggccctggcccgggtgcaggtgtttgggaagtggcacagcgtgcccaggaagcaggccacctatggagatgctggcctgacctag

SEQ ID NO: 143296 - DNA, 483 bp, Artificial Sequence
  Description of Artificial Sequence: Synthetic coding sequence
atggaccgcttcctggtgaagggggcccagggcggcctgctgaggaagcaggaggagcaggagcccactggagaggagcctgctgtgctgggcggggacaaggagagcaccaggaagaggccccggcgggaggcccctggaaatggaggccacagcgctggccccagctggaggcacatccgggcagagggcctggactgcagctacacagtgctgtttgggaaggccgaggctgatgagatcttccaggagctggagaaggaggtggagtacttcaccggggccctggcccgggtgcaggtgtttgggaagtggcacagcgtgcccaggaagcaggccacctatggagatgctggcctgacctacaccttcagcggcctgaccctgagccccaagccctggatccctgtgctggagcgcatccgggaccacgtgtctggagtgacaggccagaccttcaactttgtgctgatcaacagatag

SEQ ID NO: 143297 - DNA, 861 bp, Artificial Sequence
  Description of Artificial Sequence: Synthetic coding sequence
atggaggagaagagaagaagagcccgggtgcagggcgcctgggccgcccctgtgaagagccaggccatcgcccagcctgccaccacagccaagagccacctgcaccagaagccaggccagacctggaagaacaaggagcaccacctgagtgaccgggagtttgtgttcaaggagccccagcaggtggtgcggcgggcccctgagcccagggtcatcgaccgggagggcgtgtatgagatcagcctgagccccactggagtgtcccgggtgtgcctgtacccaggctttgtggatgtgaaggaggccgactggatcctggagcagctgtgccaggatgtgccctggaagcagaggacaggcatccgggaggacatcacctaccagcagccccggctgacagcctggtacggggagctgccctacacctacagccgcatcaccatggagcccaacccccactggcaccctgtgctgcggaccctgaagaacagaattgaagaaaatacaggccacaccttcaacagcctgctgtgcaacctgtacagaaatgagaaggacagcgtggactggcacagtgatgatgagcccagcctgggccgctgccccatcatcgccagcctgagctttggagccaccaggacctttgagatgaggaagaagcccccaccagaagaaaatggagactacacctacgtggagcgggtgaagatccccctggaccacggcaccctgctgatcatggagggcgccacccaggccgactggcagcaccgggtgcccaaggagtaccacagccgggagccccgggtgaacctgaccttcagaacagtgtacccagaccccaggggggccccctggtag

SEQ ID NO: 143298 - DNA, 513 bp, Artificial Sequence
  Description of Artificial Sequence: Synthetic coding sequence
atggaggagaagagaagaagagcccgggtgcagggcgcctgggccgcccctgtgaagagccaggccatcgcccagcctgccaccacagccaagagccacctgcaccagaagccaggccagacctggaagaacaaggagcaccacctgagtgaccgggagtttgtgttcaaggagccccagcaggtggtgcggcgggcccctgagcccagggtcatcgaggagggcgtgtatgagatcagcctgagccccaccggggtgtcccgggtgtgcctgtacccaggctttgtggatgtgaaggaggccgactggatcctggagcagctgtgccaggatgtgccctggaagcagaggacaggcatccgggaggacagcatcctgcagctgaccttcaagaagagcgcccctgtgtctggaacagccacagccccccagagctgctggtatgaaagacccagccccccccacatccctggccctgccatcctgaccaggacccggctgtgggccccctag

SEQ ID NO: 143299 - DNA, 183 bp, Artificial Sequence
  Description of Artificial Sequence: Synthetic coding sequence
atggaggagaagagaagaagagcccgggtgcagggcgcctgggccgcccctgtgaagagccaggccatcgcccagcctgccaccacagccaagagccacctgcaccagaagccaggccagacctggaagaacaaggagcaccacctgagtgaccgggagtttgtgttcaaggagccccagtag

SEQ ID NO: 143300 - DNA, 909 bp, Artificial Sequence
  Description of Artificial Sequence: Synthetic coding sequence
atggctgctgctgctgctgagaccccagaggtgctgcgggagtgtggctgcaagggcatccgcacctgcctgatctgtgagcggcagaggggcagtgaccccccctgggagctgcccccagccaagacctaccgcttcatctactgcagcgacaccggctgggccgtgggcacagaggagagtgactttgagggctgggccttccccttccctggggtgatgctgattgaagattttgtgacccgggaggaggaggccgagctggtgcggctgatggaccgggacccctggaagctgagccagagcggccgcaggaagcaggactatggccccaaggtgaacttcaggaagcagaagctgaagacagagggcttctgtggcctgcccagcttcagccgggaggtggtgcggaggatgggcctgtacccaggcctggagggcttccggcctgtggagcagtgcaacctggactactgcccagagcggggcagcgccatcgacccccacctggatgatgcctggctgtggggcgagcggctggtgtccctgaacctgctgagccccaccgtgctgtccatgtgccgggaggcccctggcagcctgctgctgtgcagcgcccccagcgctgcccctgaggccctggtggacagcgtgattgcccccagccgctctgtgctgtgccaggaggtggaggtggccatccccctgcctgcccggagcctgctggtgctgactggagctgcccggcaccagtggaagcacgccatccaccggcggcacatcgaggcccggcgggtgtgtgtgaccttccgggagctgtctgctgagtttggacctgggggccggcagcaggagctgggccaggagctgctgagaattgccctgtccttccagggccggcctgtgtag

SEQ ID NO: 143301 - DNA, 1377 bp, Artificial Sequence
  Description of Artificial Sequence: Synthetic coding sequence
atggctgctgccagcggctacacagacctgcgggagaagctgaagtccatgaccagccgggacaactacaaggccggcagccgggaggccgctgctgctgctgctgctgctgtggccgctgctgctgctgctgctgctgctgctgagccctaccctgtgtctggggccaagaggaagtaccaggaggacagcgaccctgagaggagtgactatgaggagcagcagctgcagaaggaggaggaggccaggaaggtgaagagcggcatccggcagatgaggctcttcagccaggatgaatgtgccaagattgaggccagaattgatgaggtggtgtccagagctgagaagggcctgtacaatgagcacacagtggaccgggcccccctgaggaacaagtacttctttggagagggctacacctatggagcccagctgcagaagaggggccctggccaggagcggctgtacccacctggagatgtggatgagatccctgagtgggtgcaccagctggtgatccagaagctggtggagcacagggtcatccctgagggctttgtgaacagcgctgtgatcaatgactaccagcccggcggctgcatcgtgagccacgtggaccccatccacatctttgagcggcccatcgtgtctgtgtccttcttcagtgacagcgccctgtgcttcggctgcaagttccagttcaagcccatccgggtgtctgagcctgtgctgagcctgcctgtgagaagaggctctgtgacagtgctgagcggctacgccgcagatgagatcacccactgcatccggccccaggacatcaaggagcggcgggccgtcatcatcctgaggaagacccggctggatgccccccggctggagaccaagagcctgagcagctctgtgctgcccccatcctatgccagtgaccggctgagcggcaacaacagagatcctgccctgaagcccaagaggagccacaggaaggctgaccctgatgctgcccaccggccccgcatcctggagatggacaaggaggagaacagaagatctgtgctgctgcccacccacagaagaagaggcagcttcagcagcgagaactactggaggaagagctatgagagcagcgaggactgcagcgaggccgccggcagccctggcaacagcggcagcagcctgcggagctgccccagcttctgctttgagggctttgtgtttgtgcactggggcgtgtttgtgttctgcttcctgttcttcctgatcctgtacatcttcccctggttctgctgcctgctgggcctgaagaacagaattggccaggacctgggcagccacatcctgggcatccccccaggctggaagggctgctggcaccagtag

SEQ ID NO: 143302 - DNA, 1185 bp, Artificial Sequence
  Description of Artificial Sequence: Synthetic coding sequence
atggctgctgccagcggctacacagacctgcgggagaagctgaagtccatgaccagccgggacaactacaaggccggcagccgggaggccgctgctgctgctgctgctgctgtggccgctgctgctgctgctgctgctgctgctgagccctaccctgtgtctggggccaagaggaagtaccaggaggacagcgaccctgagaggagtgactatgaggagcagcagctgcagaaggaggaggaggccaggaaggtgaagagcggcatccggcagatgaggctcttcagccaggatgaatgtgccaagattgaggccagaattgatgaggtggtgtccagagctgagaagggcctgtacaatgagcacacagtggaccgggcccccctgaggaacaagtacttctttggagagggctacacctatggagcccagctgcagaagaggggccctggccaggagcggctgtacccacctggagatgtggatgagatccctgagtgggtgcaccagctggtgatccagaagctggtggagcacagggtcatccctgagggctttgtgaacagcgctgtgatcaatgactaccagcccggcggctgcatcgtgagccacgtggaccccatccacatctttgagcggcccatcgtgtctgtgtccttcttcagtgacagcgccctgtgcttcggctgcaagttccagttcaagcccatccgggtgtctgagcctgtgctgagcctgcctgtgagaagaggctctgtgacagtgctgagcggctacgccgcagatgagatcacccactgcatccggccccaggacatcaaggagcggcgggccgtcatcatcctgaggaagacccggctggatgccccccggctggagaccaagagcctgagcagctctgtgctgcccccatcctatgccagtgaccggctgagcggcaacaacagagatcctgccctgaagcccaagaggagccacaggaaggctgaccctgatgctgcccaccggccccgcatcctggagatggacaaggaggagaacagaagatctgtgctgctgcccacccacagaagaagaggcagcttcagcagcgagaactactggaggaagagctatgagagcagcgaggactgcagcgaggccgccggcagccctgccaggaaggtgaagatgaggaggcactag

SEQ ID NO: 143303 - DNA, 1152 bp, Artificial Sequence
  Description of Artificial Sequence: Synthetic coding sequence
atgaggcgctgcagaagaccctgcccagctggccgcggggagggcggcggcggccgcagccctgctgctgctgctgctgtggccgctgctgctgctgctgctgctgctgctgagccctaccctgtgtctggggccaagaggaagtaccaggaggacagcgaccctgagaggagtgactatgaggagcagcagctgcagaaggaggaggaggccaggaaggtgaagagcggcatccggcagatgaggctcttcagccaggatgaatgtgccaagattgaggccagaattgatgaggtggtgtccagagctgagaagggcctgtacaatgagcacacagtggaccgggcccccctgaggaacaagtacttcttcggggagggctacacctacggggcccagctgcagaagaggggccctggccaggagcggctgtacccacctggagatgtggatgagatccctgagtgggtgcaccagctggtgatccagaagctggtggagcacagggtcatccctgagggctttgtgaacagcgctgtgatcaatgactaccagcccggcggctgcatcgtgagccacgtggaccccatccacatctttgagcggcccatcgtgtctgtgtccttcttcagtgacagcgccctgtgcttcggctgcaagttccagttcaagcccatccgggtgtctgagcctgtgctgagcctgcctgtgcggcggggctctgtgacagtgctgagcggctatgctgctgatgagatcacccactgcatccggccccaggacatcaaggagaggagagctgtgatcatcctgaggaagacccggctggatgccccccggctggagaccaagagcctgagcagctctgtgctgccccccagctatgccagtgaccggctgagcggcaacaacagagatcctgccctgaagcccaagaggagccacaggaaggctgaccctgatgctgcccaccggccccgcatcctggagatggacaaggaggagaacagaagatctgtgctgctgcccacccacagaagaagaggcagcttcagcagcgagaactactggaggaagagctatgagagcagcgaggactgcagcgaggccgccggcagccctgccaggaaggtgaagatgagaagacactag

SEQ ID NO: 143304 - DNA, 717 bp, Artificial Sequence
  Description of Artificial Sequence: Synthetic coding sequence
atggaggagcaggatgcccgggtgcctgccctggagcccttccgggtggagcaggcccctcctgtgatctactacgtgcctgacttcatcagcaaggaggaggaggagtacctgctgcggcaggtgttcaatgcccccaagcccaagtggacccagctgagcggcaggaagctgcagaactggggcggcctgccccacccccggggcatggtgcctgagcggctgcccccctggctgcagcgctacgtggacaaggtgagcaacctgagcctgtttggaggcctgcctgccaaccacgtgctggtgaaccagtacctgcctggagagggcatcatgcctcatgaagatggccccctgtactaccccaccgtgtccaccatcagcctgggcagccacacagtgctggacttctatgagcccaggaggccagaagatgatgaccccacagagcagccccggcccccaccccggcccaccaccagcctgctgctggagcccaggagcctgctggtgctgcggggccctgcctacacccggctgctgcacggcattgctgctgcccgggtggatgccctggatgctgccagcagccccccaaatgctgctgcctgccccagcgcccggcctggggcctgcctggtgcggggcaccagggtgtccctgaccatccggcgggtgccccgggtgctgcgggccggcctgctgctgggcaagtag

SEQ ID NO: 143305 - DNA, 801 bp, Artificial Sequence
  Description of Artificial Sequence: Synthetic coding sequence
atggccggccggggcatgggcatgctgaacctggagattggaggagatgctgggggcagaattggctgcaaggagctggtgctgatggaggagcaggatgcccgggtgcctgccctggagcccttccgggtggagcaggcccctcctgtgatctactacgtgcctgacttcatcagcaaggaggaggaggagtacctgctgcggcaggtgttcaatgcccccaagcccaagtggacccagctgagcggcaggaagctgcagaactggggcggcctgccccacccccggggcatggtgcctgagcggctgcccccctggctgcagcgctacgtggacaaggtgagcaacctgagcctgtttggaggcctgcctgccaaccacgtgctggtgaaccagtacctgcctggagagggcatcatgcctcatgaagatggccccctgtactaccccaccgtgtccaccatcagcctgggcagccacacagtgctggacttctatgagcccaggaggccagaagatgatgaccccacagagcagccccggcccccaccccggcccaccaccagcctgctgctggagcccaggagcctgctggtgctgcggggccctgcctacacccggctgctgcacggcattgctgctgcccgggtggatgccctggatgctgccagcagccccccaaatgctgctgcctgccccagcgcccggcctggggcctgcctggtgcggggcaccagggtgtccctgaccatccggcgggtgccccgggtgctgcgggccggcctgctgctgggcaagtag

SEQ ID NO: 143306 - DNA, 717 bp, Artificial Sequence; identical to SEQ ID NO: 143304
  Description of Artificial Sequence: Synthetic coding sequence

SEQ ID NO: 143307 - DNA, 666 bp, Artificial Sequence
  Description of Artificial Sequence: Synthetic coding sequence
atggccggcaccggcctgctggccctgcggaccctgcccggccccagctgggtgcggggcagcggccccagcgtgctgagccggctgcaggatgctgctgtggtgcggcccggcttcctgagcacagctgaggaggagaccctgagccgggagctggagcctgagctgcggaggagaagatatgaatatgaccactgggatgctgccatccacggcttccgggagacagagaagagccgctggagcgaggccagccgggccatcctgcagagggtgcaggccgccgcctttggacctggccagaccctgctgagctctgtgcacgtgctggacctggaggcccggggctacatcaagccccacgtggacagcatcaagttctgtggggccaccatcgccggcctgagcctgctgagccccagcgtgatgaggctggtgcacacccaggagcctggagagtggctggagctgctgctggagcccggcagcctgtacatcctgcggggcagcgcccgctatgacttcagccatgagatcctgagagatgaggagagcttctttggagagcggcgcatcccccggggccgccgcatcagcgtcatctgccgcagcctgcctgagggcatgggccctggagagagcggccagcccccaccagcctgctag

SEQ ID NO: 143308 - DNA, 1995 bp, Artificial Sequence
  Description of Artificial Sequence: Synthetic coding sequence
atggacagcaaccaccagagcaactacaagctgagcaagacagagaagaagttcctgaggaagcagatcaaggccaagcacaccctgctgcggcatgagggcattgaaacagtgtcctatgccacccagagcctggtggtggccaatggaggcctgggcaatggagtgtccaggaaccagctgctgcctgtgctggagaagtgtggcctggtggatgccctgctgatgccacccaacaagccctacagctttgcccgctaccgcaccacagaggagagcaagagggcctacgtgaccctgaatggcaaggaggtggtggatgacctgggccagaagatcaccctgtacctgaactttgtggagaaggtgcagtggaaggagctgcggccccaggccctgcccccaggcctgatggtggtggaggagatcatcagcagcgaggaggagaagatgctgctggagagcgtggactggacagaggacacagacaaccagaacagccagaagagcctgaagcaccggcgggtgaagcacttcggctatgagttccactatgagaacaacaacgtggacaaggacaagcccctgagcggcggcctgcctgacatctgtgagagcttcctggagaagtggctgaggaagggctacatcaagcacaagccagaccagatgaccatcaaccagtatgagcccggccagggcatcccagcccacatcgacacccacagcgcctttgaagatgaaattgtgtccctgagcctgggcagcgagatcgtgatggacttcaagcacccagatggcattgctgtgcctgtgatgctgccccggcgcagcctgctggtgatgactggagagagccgctacctgtggacccacggcatcacctgcaggaagtttgacacagtgcaggccagcgagagcctgaagagcggcatcatcaccagtgatgtgggggacctgaccctgagcaagaggggcctgcggaccagcttcaccttcaggaaggtgcggcagaccccctgcaactgcagctaccccctggtgtgtgacagccagaggaaggagaccccacccagcttccctgagagtgacaaggaggccagccggctggagcaggagtatgtgcaccaggtgtatgaggagattgctggccacttcagcagcaccaggcacaccccctggccccacatcgtggagttcctgaaggccctgcccagcggcagcatcgtggccgacatcggctgtggaaatggcaagtacctgggcatcaacaaggagctgtacatgattggctgtgacaggagccagaacctggtggacatctgccgggagcggcagttccaggcctttgtgtgtgatgccctggccgtgcctgtgcgcagcggcagctgtgatgcctgcatcagcattgctgtgatccaccactttgccacagctgagaggagagtggccgccctgcaggagatcgtgcggctgctgcggcctgggggcaaggccctgatctacgtgtgggccatggagcaggagtacaacaagcagaagagcaagtacctgcggggcaacagaaacagccagggcaagaaggaggagatgaacagcgacacctctgtgcagaggagcctggtggagcagatgagggacatgggcagccgggacagcgccagctctgtgccccgcatcaatgacagccaggagggcggctgcaacagccggcaggtgagcaacagcaagctgcctgtgcacgtgaacagaaccagcttctacagccaggatgtgctggtgccctggcacctgaagggcaacccagacaagggcaagcctgtggagcccttcggccccatcggcagccaggaccccagccctgtgttccaccgctactaccacgtgttccgggagggggagctggagggcgcctgcaggacagtgtctgatgtgcgcatcctgcagagctactatgaccagggcaactggtgtgtgatcctgcagaaggcctag

SEQ ID NO: 143309 - DNA, 2004 bp, Artificial Sequence
  Description of Artificial Sequence: Synthetic coding sequence
atgtttgccatggacagcaaccaccagagcaactacaagctgagcaagacagagaagaagttcctgaggaagcagatcaaggccaagcacaccctgctgcggcatgagggcatcgagaccgtgtcctatgccacccagagcctggtggtggccaacggcggcctgggcaatggagtgtccaggaaccagctgctgcctgtgctggagaagtgtggcctggtggatgccctgctgatgccacccaacaagccctacagctttgcccgctaccgcaccacagaggagagcaagagggcctacgtgaccctgaatggcaaggaggtggtggatgacctgggccagaagatcaccctgtacctgaactttgtggagaaggtgcagtggaaggagctgcggccccaggccctgcccccaggcctgatggtggtggaggagatcatcagcagcgaggaggagaagatgctgctggagagcgtggactggacagaggacacagacaaccagaacagccagaagagcctgaagcacagaagagtgaagcacttcggctatgagttccactatgagaacaacaacgtggacaaggacaagcccctgagcggcggcctgcctgacatctgtgagagcttcctggagaagtggctgaggaagggctacatcaagcacaagccagaccagatgaccatcaaccagtatgagcccggccagggcatcccagcccacatcgacacccacagcgcctttgaagatgagatcgtgtccctgagcctgggcagcgagatcgtgatggacttcaagcacccagatggcattgctgtgcctgtgatgctgcccaggaggagcctgctggtgatgaccggggagagccgctacctgtggacccacggcatcacctgcaggaagtttgacacagtgcaggccagcgagagcctgaagagcggcatcatcaccagtgatgtgggggacctgaccctgagcaagaggggcctgcggaccagcttcaccttcaggaaggtgcggcagaccccctgcaactgcagctaccccctggtgtgtgacagccagaggaaggagaccccacccagcttccctgagagtgacaaggaggccagccggctggagcaggagtatgtgcaccaggtgtatgaggagattgctggccacttcagcagcaccaggcacaccccctggccccacatcgtggagttcctgaaggccctgcccagcggcagcatcgtggccgacatcggctgtggaaatggcaagtacctgggcatcaacaaggagctgtacatgattggctgtgacaggagccagaacctggtggacatctgccgggagcggcagttccaggcctttgtgtgtgatgccctggccgtgcctgtgcgcagcggcagctgtgatgcctgcatcagcattgctgtgatccaccactttgccacagctgagcggcgggtggccgccctgcaggagatcgtgcggctgctgcggcctgggggcaaggccctgatctacgtgtgggccatggagcaggagtacaacaagcagaagagcaagtacctgcggggcaacagaaacagccagggcaagaaggaggagatgaacagcgacacctctgtgcagaggagcctggtggagcagatgagggacatgggcagccgggacagcgccagctctgtgccccgcatcaatgacagccaggagggcggctgcaacagccggcaggtgagcaacagcaagctgcctgtgcacgtgaacagaaccagcttctacagccaggatgtgctggtgccctggcacctgaagggcaacccagacaagggcaagcctgtggagcccttcggccccatcggcagccaggaccccagccctgtgttccaccgctactaccacgtgttccgggagggggagctggagggcgcctgcaggacagtgtctgatgtgcgcatcctgcagagctactatgaccagggcaactggtgtgtgatcctgcagaaggcctag

SEQ ID NO: 143310 - DNA, 1995 bp, Artificial Sequence; identical to SEQ ID NO: 143308
  Description of Artificial Sequence: Synthetic coding sequence

SEQ ID NO: 143311 - DNA, 675 bp, Artificial Sequence
  Description of Artificial Sequence: Synthetic coding sequence
atggacagcaaccaccagagcaactacaagctgagcaagacagagaagaagttcctgaggaagcagatcaaggccaagcacaccctgctgcggcatgagggcattgaaacagtgtcctatgccacccagagcctggtggtggccaatggaggcctgggcaatggagtgtccaggaaccagctgctgcctgtgctggagaagtgtggcctggtggatgccctgctgatgccacccaacaagccctacagctttgcccgctaccgcaccacagaggagagcaagagggcctacgtgaccctgaatggcaaggaggtggtggatgacctgggccagaagatcaccctgtacctgaactttgtggagaaggtgcagtggaaggagctgcggccccaggccctgcccccaggcctgatggtggtggaggagatcatcagcagcgaggaggagaagatgctgctggagagcgtggactggacagaggacacagacaaccagaacagccagaagagcctgaagcaccggcgggtgaagcacttcggctatgagttccactatgagaacaacaacgtggacaaggacaagcccctgagcggcggcctgcctgacatctgtgagagcttcctggagaagtggctgaggaaggccgagaagaacctggaggtgggcatccactag

SEQ ID NO: 143312 - DNA, 1338 bp, Artificial Sequence
  Description of Artificial Sequence: Synthetic coding sequence
atgaagaaccctgaggcccagcaggatgtgtctgtgtcccagggcttcaggatgctgttctacaccatgaagcccagcgagaccagcttccagaccctggaggaggtgcctgactatgtgaagaaggccacccccttcttcatcagcctgatgctgctggagctggtggtgtcctggatcctgaagggcaagcccccaggccgcctggatgatgccctgaccagcatctctgctggggtgctgagccggctgcccagcctcttcttccgcagcattgagctgaccagctacatctacatctgggagaactaccgcctcttcaacctgccctgggacagcccctggacctggtacagcgccttcctgggcgtggactttggctactactggttccacaggatggcccacgaggtgaacatcatgtgggccggccaccagacccaccacagcagcgaggactacaacctgagcacagccctgcggcagagcgtgctgcagatctacacctcctggatcttctacagccccctggccctcttcatcccccccagcgtgtatgctgtgcacctgcagttcaacctgctgtaccagttctggatccacacagaggtgatcaacaacctgggccccctggagctgatcctgaacacccccagccaccaccgggtgcaccacggcaggaaccgctactgcatcgacaagaactatgccggcgtgctgatcatctgggacaagatcttcggcacctttgaagcagaaaatgagaaggtggtgtatggcctgacccaccccatcaacacctttgagcccatcaaggtgcagttccaccacctgttcagcatctggaccaccttctgggccaccccaggcttcttcaacaagttcagcgtcatcttcaagggccctggctggggccctgggaagccccggctgggcctgtctgaggagatccctgaggtgacaggcaaggaggtgcccttcagcagcagcagcagccagctgctgaagatctacacagtggtgcagtttgccctgatgctggccttctatgaggagacctttgctgacacagctgccctgagccaggtgaccctgctgctgcgggtgtgcttcatcatcctgaccctgaccagcatcggcttcctgctggaccagaggcccaaggccgccatcatggagaccctgcgctgcctgatgttcctgatgctgtaccgcttcggccacctgaagcccctggtgcccagcctgagcagcgcctttgagatcgtgttcagcatctgcatcgccttctggggcgtgcgctccatgaagcagctgaccagccacccctggaagtag

SEQ ID NO: 143313 - DNA, 1977 bp, Artificial Sequence
  Description of Artificial Sequence: Synthetic coding sequence
atggccgaggccgctgctgctgctgggggcaccggcctgggcgctggggccagctatggcagcgctgctgaccgggaccgggaccctgaccctgaccgggccggccggcggctgcgggtgctgagcggccacctgctgggccggccccgggaggccctgagcaccaatgaatgcaaggccaggagagctgccagcgctgccacagctgcccccacagccaccccagctgcccaggagagcggcaccatccccaagaagaggcaggaggtgatgaagtggaatggctggggctacaatgacagcaagttcatcttcaacaagaagggccagatcgagctgaccgggaagcgctaccccctgagcggcatgggcctgcccaccttcaaggagtggatccagaacaccctgggcgtgaatgtggagcacaagaccaccagcaaggccagcctgaaccccagcgacaccccacccagcgtggtgaatgaagacttcctgcatgacctgaaggagaccaacatctcctacagccaggaggctgatgacagagtcttccgggcccacggccactgcctgcacgagatcttcctgctgcgggagggcatgtttgagcgcatcccagacatcgtgctgtggcccacctgccatgatgatgtggtgaagatcgtgaacctggcctgcaagtacaacctgtgcatcatccccatcggcggcggcacctctgtgtcctatggcctgatgtgcccagcagatgagaccaggaccatcatcagcctggacaccagccagatgaaccgcatcctgtgggtggatgagaacaacctgacagcccacgtggaggccggcatcaccggccaggagctggagcggcagctgaaggagagcggctactgcaccggccacgagccagacagcctggagttcagcacagtgggcggctgggtgtccacccgggccagcggcatgaagaagaacatctacggcaacatcgaggacctggtggtgcacatcaagatggtgaccccccggggcatcatcgagaagagctgccagggccccaggatgagcacaggccctgacatccaccacttcatcatgggcagcgagggcaccctgggcgtcatcacagaggccaccatcaagatccggcctgtgcctgagtaccagaagtatggctctgtggccttccccaactttgagcagggcgtggcctgcctgcgggagatcgccaagcagagatgtgccccagccagcatccggctgatggacaacaagcagttccagtttggccacgccctgaagccccaggtgagcagcatcttcaccagcttcctggatggcctgaagaagttctacatcaccaagttcaagggctttgaccccaaccagctgtctgtggccaccctgctgtttgaaggagaccgggagaaggtgctgcagcacgagaagcaggtgtatgacattgctgccaagtttggaggcctggccgccggggaggacaatggccagaggggctacctgctgacctacgtgattgcctacatccgggacctggccctggagtactacgtgctgggggagagctttgagaccagcgccccctgggacagagtggtggacctgtgcagaaatgtgaaggagcgcatcacccgggagtgcaaggagaagggcgtgcagtttgcccccttcagcacctgccgggtgacccagacctatgatgctggggcctgcatctacttctactttgccttcaactaccggggcatcagtgaccccctgactgtgtttgagcagacagaggccgccgcccgggaggagatcctggccaatggaggcagcctgagccaccaccacggcgtgggcaagctgaggaagcagtggctgaaggagagcatcagtgatgtgggcttcggcatgctgaagtctgtgaaggagtatgtggaccccaacaacatcttcggcaacagaaacctgctgtag

SEQ ID NO: 143314 - DNA, 966 bp, Artificial Sequence
  Description of Artificial Sequence: Synthetic coding sequence
atggaccccaagtacccctggagcaaatgtggccacaagaccaccagcaaggccagcctgaaccccagcgacaccccacccagcgtggtgaatgaagacttcctgcatgacctgaaggagaccaacatctcctacagccaggaggctgatgacagagtcttccgggcccacggccactgcctgcacgagatcttcctgctgcgggagggcatgtttgagcgcatcccagacatcgtgctgtggcccacctgccatgatgatgtggtgaagatcgtgaacctggcctgcaagtacaacctgtgcatcatccccatcggcggcggcacctctgtgtcctatggcctgatgtgcccagcagatgagaccaggaccatcatcagcctggacaccagccagatgaaccgcatcctgtgggtggatgagaacaacctgacagcccacgtggaggccggcatcaccggccaggagctggagcggcagctgaaggagagcggctactgcaccggccacgagccagacagcctggagttcagcacagtgggcggctgggtgtccacccgggccagcggcatgaagaagaacatctacggcaacatcgaggacctggtggtgcacatcaagatggtgaccccccggggcatcatcgagaagagctgccagggccccaggatgagcacaggccctgacatccaccacttcatcatgggcagcgagggcaccctgggcgtcatcacagaggccaccatcaagatccggcctgtgcctgagtaccagaagtatggctctgtggccttccccaactttgagcagggcgtggcctgcctgcgggagatcgccaagcagagatgtgccccagccagcatccggctgatggacaacaagcagttccagtttggccacgccctgaagccccaggtgagcagcatcttcaccagcttcctggatggcctgaagaagttctactag

SEQ ID NO: 143315 - DNA, 1176 bp, Artificial Sequence
  Description of Artificial Sequence: Synthetic coding sequence
atggacatggccagcgagagcgtgggcggcaagatcctgtttgccacagatgacttctttgccccagctgagaacctgatcaagagtgacagcccctgcttcaaggagcacgagtacacagaatttgggaagtggatggatggctgggagaccaggaggaagagaattcctggccatgactggtgtgtgctgcggctgggcatccagggcgtcatccggggctttgatgtggatgtgtcctacttcaccggggactatgccccccgggtgtccatccaggccgccaacctggaggaggacaagctgcctgagatccctgagcggggcaccaggactggagctgctgccaccccagaggagtttgaggccatcgccgagctgaagagtgatgactggagctacctggtgcccatgacagagctgaagccaggcaacccagccagcggccacaactacttcctggtgaacagccagcagcgctggacccacatccggctgaacatcttcccagatggcggcatcgcccggctgcgggtgtttggcaccggccagaaggactggacagccacagaccccaaggagcctgctgacctggtggccatcgcctttggaggagtgtgtgtgggcttcagcaatgccaagtttggccaccccaacaacatcatcggcgtgggcggggccaagtccatggctgatggctgggagacagcccggcggctggacaggcctcccatcctggagaatgatgaaaatggcatcctgctggtgcccggctgtgagtgggccgtgttccggctggcccaccctggggtcatcaccagaattgaaattgacaccaagtactttgagggcaatgccccagacagctgcaaggtggatggctgcatcctgaccacccaggaggaggaggccgtcatccggcagaagtggatcctgcctgcccacaagtggaagcccctgctgcctgtgaccaagctgagccccaaccagagccacctgtttgacagcctgaccctggagctgcaggatgtgatcacccacgcccggctgaccatcgtgcctgatggaggagtgtcccggctgcggctgcggggcttccccagcagcatctgcctgctgcggccccgggagaagcccatgctgaagttctctgtgtccttcaaggccaacccctag

SEQ ID NO: 143316 - DNA, 486 bp, Artificial Sequence
  Description of Artificial Sequence: Synthetic coding sequence
ggcaggaaggccagcgagaagacaggaggccgggagggggagcctgctgaccggggcctgcagctgggcggcaaggccttcggcctgctgaaggcccagcaggaggagcggctggatgagatcaacaagcagttcctggatgaccccaagtacagcagtgatgaggacctgcccagcaagctggagggcttcaaggagaagtacatggagtttgacctgaatggaaatggagacatcgacatcatgagcctgaagaggatgctggagaagctgggcgtgcccaagacccacctggagctgaagaagctgattggagaggtgagcagcggcagcggggagaccttctcctacccagacttcctgaggatgatgctgggcaagaggtctgccatcctgaagatgatcctgatgtatgaggagaaggcccgggagaaggagaagcccactggacctccagccaagaaggccatcagcgagctgccctag

SEQ ID NO: 143317 - DNA, 282 bp, Artificial Sequence
  Description of Artificial Sequence: Synthetic coding sequence
atggagtttgacctgaatggaaatggagacatcgacatcatgagcctgaagaggatgctggagaagctgggcgtgcccaagacccacctggagctgaagaagctgattggagaggtgagcagcggcagcggggagaccttctcctacccagacttcctgaggatgatgctgggcaagaggtctgccatcctgaagatgatcctgatgtatgaggagaaggcccgggagaaggagaagcccactggacctccagccaagaaggccatcagcgagctgccctag

SEQ ID NO: 143318 - DNA, 444 bp, Artificial Sequence
  Description of Artificial Sequence: Synthetic coding sequence
atgagccagacccgggacctgcagggcggcaaggccttcggcctgctgaaggcccagcaggaggagcggctggatgagatcaacaagcagttcctggatgaccccaagtacagcagtgatgaggacctgcccagcaagctggagggcttcaaggagaagtacatggagtttgacctgaatggaaatggagacatcgacatcatgagcctgaagaggatgctggagaagctgggcgtgcccaagacccacctggagctgaagaagctgattggagaggtgagcagcggcagcggggagaccttctcctacccagacttcctgaggatgatgctgggcaagaggtctgccatcctgaagatgatcctgatgtatgaggagaaggcccgggagaaggagaagcccactggacctccagccaagaaggccatcagcgagctgccctag

SEQ ID NO: 143319 - DNA, 282 bp, Artificial Sequence; identical to SEQ ID NO: 143317
  Description of Artificial Sequence: Synthetic coding sequence

SEQ ID NO: 143320 - DNA, 444 bp, Artificial Sequence; identical to SEQ ID NO: 143318
  Description of Artificial Sequence: Synthetic coding sequence

SEQ ID NO: 143321 - DNA, 486 bp, Artificial Sequence; identical to SEQ ID NO: 143316
  Description of Artificial Sequence: Synthetic coding sequence

SEQ ID NO: 143322 - DNA, 444 bp, Artificial Sequence; identical to SEQ ID NO: 143318
  Description of Artificial Sequence: Synthetic coding sequence

SEQ ID NO: 143323 - DNA, 444 bp, Artificial Sequence; identical to SEQ ID NO: 143318
  Description of Artificial Sequence: Synthetic coding sequence

SEQ ID NO: 143324 - DNA, 282 bp, Artificial Sequence; identical to SEQ ID NO: 143317
  Description of Artificial Sequence: Synthetic coding sequence

SEQ ID NO: 143325 - DNA, 282 bp, Artificial Sequence; identical to SEQ ID NO: 143317
  Description of Artificial Sequence: Synthetic coding sequence

SEQ ID NO: 143326 - DNA, 486 bp, Artificial Sequence; identical to SEQ ID NO: 143316
  Description of Artificial Sequence: Synthetic coding sequence

SEQ ID NO: 143327 - DNA, 282 bp, Artificial Sequence; identical to SEQ ID NO: 143317
  Description of Artificial Sequence: Synthetic coding sequence

SEQ ID NO: 143328 - DNA, 282 bp, Artificial Sequence; identical to SEQ ID NO: 143317
  Description of Artificial Sequence: Synthetic coding sequence

SEQ ID NO: 143329 - DNA, 444 bp, Artificial Sequence; identical to SEQ ID NO: 143318
  Description of Artificial Sequence: Synthetic coding sequence

SEQ ID NO: 143330 - DNA, 486 bp, Artificial Sequence; identical to SEQ ID NO: 143316
  Description of Artificial Sequence: Synthetic coding sequence

SEQ ID NO: 143331 - DNA, 444 bp, Artificial Sequence; identical to SEQ ID NO: 143318
  Description of Artificial Sequence: Synthetic coding sequence

SEQ ID NO: 143332 - DNA, 486 bp, Artificial Sequence; identical to SEQ ID NO: 143316
  Description of Artificial Sequence: Synthetic coding sequence

SEQ ID NO: 143333 - DNA, 486 bp, Artificial Sequence; identical to SEQ ID NO: 143316
  Description of Artificial Sequence: Synthetic coding sequence

SEQ ID NO: 143334 - DNA, 282 bp, Artificial Sequence; identical to SEQ ID NO: 143317
  Description of Artificial Sequence: Synthetic coding sequence

SEQ ID NO: 143335 - DNA, 1062 bp, Artificial Sequence
  Description of Artificial Sequence: Synthetic coding sequence
atgagcaagcccccagacctgctgctgcggctgctgcggggggccccccggcagagggtgtgcaccctcttcatcatcggcttcaagttcaccttctttgtgtccatcatgatctactggcacgtggtgggggagcccaaggagaagggccagctgtacaacctgcctgctgagatcccctgccccaccctgaccccacccaccccacccagccacggccccaccccaggcaacatcttcttcctggagaccagtgacaggaccaaccccaacttcctgttcatgtgcagcgtggagagcgctgcccggacccaccctgagagccacgtgctggtgctgatgaagggcctgcccggcggcaatgccagcctgcccaggcacctgggcatcagcctgctgagctgcttccccaacgtgcagatgctgcccctggacctgcgggagctgttccgggacacccccctggccgactggtacgccgctgtgcagggccgctgggagccctacctgctgcctgtgctgagtgatgccagccgcatcgccctgatgtggaagtttggaggcatctacctggacacagacttcatcgtgctgaagaacctgaggaacctgaccaacgtgctgggcacccagagccgctacgtgctgaatggagccttcctggcctttgaaagaagacatgagttcatggccctgtgcatgagggactttgtggaccactacaacggctggatctggggccaccagggcccccagctgctgaccagggtcttcaagaagtggtgcagcatccgcagcctggccgagagccgggcctgccggggcgtgaccaccctgcccccagaggccttctaccccatcccctggcaggactggaagaagtactttgaggacatcaaccctgaggagctgccccggctgctgagcgccacctatgctgtgcacgtgtggaacaagaagagccagggcaccaggtttgaggccaccagccgggccctgctggcccagctgcacgcccgctactgccccaccacccatgaggccatgaagatgtacctgtag

SEQ ID NO: 143336 - DNA, 1062 bp, Artificial Sequence; identical to SEQ ID NO: 143335
  Description of Artificial Sequence: Synthetic coding sequence

SEQ ID NO: 143337 - DNA, 1062 bp, Artificial Sequence; identical to SEQ ID NO: 143335
  Description of Artificial Sequence: Synthetic coding sequence

SEQ ID NO: 143338 - DNA, 1311 bp, Artificial Sequence
  Description of Artificial Sequence: Synthetic coding sequence
atgagcaagcccccagacctgctgctgcggctgctgcggggggccccccggcagagggtgtgcaccctcttcatcatcggcttcaagttcaccttctttgtgtccatcatgatctactggcacgtggtgggggagcccaaggagaagggccagctgtacaacctgcctgctgagatcccctgccccaccctgaccccacccaccccacccagccacggccccaccccaggcaacatcttcttcctggagaccagtgacaggaccaaccccaacttcctgttcatgtgcagcgtggagagcgctgcccggacccaccctgagagccacgtgctggtgctgatgaagggcctgcccggcggcaatgccagcctgcccaggcacctgggcatcagcctgctgagctgcttccccaacgtgcagatgctgcccctggacctgcgggagctgttccgggacacccccctggccgactggtacgccgctgtgcagggccgctgggagccctacctgctgcctgtgctgagtgatgccagccgcatcgccctgatgtggaagtttggaggcatctacctggacacagacttcatcgtgctgaagaacctgaggaacctgaccaacgtgctgggcacccagagccgctacgtgctgaatggagccttcctggcctttgaaagaagacatgagttcatggccctgtgcatgagggactttgtggaccactacaacggctggatctggggccaccagggcccccagctgctgaccagggtcttcaagaagtggtgcagcatccgcagcctggccgagagccgggcctgccggggcgtgaccaccctgcccccagaggccttctaccccatcccctggcaggactggaagaagtactttgaggacatcaaccctgaggagctgccccggctgctgagcgccacctatgctgtgcacgtgtggaacaagaagagccagggcacagctggccctgctgcctgccccctgctgccccatgatgcccggggccatgaaaatgtgctggtgcggggccccccaggccacctgcccaacctgctgctgatgggccactgggccgccctgcctggagaggcccggctgcgggcccgggagcgggaggcccgggccgccaccggcctgcggcaggccgtggaggagctgtgggagcaggcccagtgggaggccgtggacacccccaggacagtgtcctgcctggaggccggcctgacccacggggccatcgccagcggcggccgctctgtgtctgcccctggcctgctggacaaccggcaggagggctag

SEQ ID NO: 143339 - DNA, 309 bp, Artificial Sequence
  Description of Artificial Sequence: Synthetic coding sequence
atggccctgctgaaggccaacaaggacctgatctctgctggcctgaaggagttctctgtgctgctgaaccagcaggtgttcaatgaccccctggtgtctgaggaggacatggtgacagtggtggaggactggatgaacttctacatcaactactaccggcagcaggtgactggagagccccaggagcgggacaaggccctgcaggagctgcggcaggagctgaacaccctggccaaccccttcctggccaagtacagagacttcctgaagagccatgagctgcccagccaccccccacccagcagctag

SEQ ID NO: 143340 - DNA, 1488 bp, Artificial Sequence
  Description of Artificial Sequence: Synthetic coding sequence
atgtccatgctggtggtgttcctgctgctgtggggcgtgacctggggccctgtgacagaagctgccatcttctatgagacccagcccagcctgtgggccgagagcgagagcctgctgaagcccctggccaacgtgaccctgacctgccaggcccacctggagaccccagacttccagctgttcaagaatggagtggcccaggagcctgtgcacctggacagccctgccatcaagcaccagttcctgctgaccggggacacccagggccgctaccgctgccgcagcggcctgagcacaggctggacccagctgagcaagctgctggagctgaccggccccaagagcctgcctgccccctggctgtccatggcccctgtgtcctggatcaccccaggcctgaagaccacagctgtgtgccggggcgtgctgcggggcgtgaccttcctgctgcggcgggagggggaccacgagttcctggaggtgcctgaggcccaggaggatgtggaggccaccttccctgtgcaccagcccggcaactacagctgcagctacagaacagatggagagggcgccctgtctgagcccagcgccaccgtgaccatcgaggagctggccgcccctcctcctcctgtgctgatgcaccacggggagagcagccaggtgctgcaccctggcaacaaggtgaccctgacctgtgtggcccccctgtctggagtggacttccagctgcggcggggggagaaggagctgctggtgcccaggagcagcaccagcccagaccgcatcttcttccacctgaatgctgtggccctgggagatggcggccactacacctgccgctaccgcctgcatgacaaccagaatggctggagcggggacagcgcccctgtggagctgatcctgagtgatgagaccctgcctgcccctgagttcagccctgagcctgagagcggccgggccctgcggctgcgctgcctggcccccctggagggcgccaggtttgccctggtgagagaagatcggggcggccggcgggtgcaccgcttccagagccctgctggaacagaggccctgtttgagctgcacaacatctctgtggccgacagcgccaactacagctgtgtgtatgtggacctgaagcccccatttggaggcagcgcccccagcgagcggctggagctgcacgtggatggccccccaccccggccccagctgcgggccacctggagcggggctgtgctggccggcagagatgctgtgctgcgctgtgagggccccatcccagatgtgacctttgagctgctgcgggagggggagaccaaggctgtgaagacagtgaggaccccaggagctgctgccaacctggagctgatctttgtgggcccccagcacgccggcaactaccgctgccgctaccgctcctgggtgccccacacctttgagagcgagctgagtgaccctgtggagctgctggtggccgagagctag

SEQ ID NO: 143341 - DNA, 1059 bp, Artificial Sequence
  Description of Artificial Sequence: Synthetic coding sequence
atgaggagcctgggcgccctgctgctgctgctgagcgcctgcctggccgtgtctgctggccctgtgcccaccccaccagacaacatccaggtgcaggagaacttcaacatcagccgcatctacggcaagtggtacaacctggccatcggcagcacctgcccctggctgaagaagatcatggacaggatgacagtgtccaccctggtgctgggggagggcgccacagaagctgagatctccatgaccagcacccgctggaggaagggcgtgtgtgaggagaccagcggggcctatgagaagacagacacagatggcaagttcctgtaccacaagagcaagtggaacatcaccatggagagctatgtggtgcacaccaactatgatgaatatgccatcttcctgaccaagaagttcagccgccaccacggccccaccatcacagccaagctgtatggccgggccccccagctgcgggagaccctgctgcaggacttccgggtggtggcccagggcgtgggcatccctgaggacagcatcttcaccatggctgacagaggagaatgtgtgcctggagagcaggagcctgagcccatcctgatcccccgggtgcggcgggctgtgctgccccaggaggaggagggcagcggcggcggccagctggtgacagaggtgaccaagaaggaggacagctgccagctgggctacagcgctggcccctgcatgggcatgaccagccgctacttctacaacggcacctccatggcctgtgagaccttccagtatggaggctgcatgggaaatggaaacaactttgtgacagagaaggagtgcctgcagacctgcaggacagtggccgcctgcaacctgcccatcgtgcggggcccctgccgggccttcatccagctgtgggcctttgatgctgtgaagggcaaatgtgtgctcttcccctatggaggctgccagggcaatggaaacaagttctacagcgagaaggagtgccgggagtactgcggcgtgcctggagatggagatgaggagctgctgcgcttcagcaactag

SEQ ID NO: 143342 - DNA, 813 bp, Artificial Sequence
  Description of Artificial Sequence: Synthetic coding sequence
atggacaggatgacagtgtccaccctggtgctgggggagggcgccacagaggccgagatctccatgaccagcacccgctggaggaaaggagtgtgtgaggagaccagcggggcctatgagaagacagacacagatggcaagttcctgtaccacaagagcaagtggaacatcaccatggagagctatgtggtgcacaccaactatgatgaatatgccatcttcctgaccaagaagttcagccgccaccacggccccaccatcacagccaagctgtatggccgggccccccagctgcgggagaccctgctgcaggacttccgggtggtggcccagggcgtgggcatcccagaagattccatcttcaccatggctgacagaggagaatgtgtgcctggagagcaggagcctgagcccatcctgatcccccgggtgagaagagctgtgctgccccaggaggaggagggcagcggcggcggccagctggtgacagaggtgaccaagaaggaggacagctgccagctgggctacagcgctggcccctgcatgggcatgaccagccgctacttctacaacggcacctccatggcctgtgagaccttccagtatggaggctgcatgggaaatggaaacaactttgtgacagagaaggaatgtctgcagacctgcaggacagtgggagaatgtggcagcccccccctgtgtgccctgcacccccaggaccctgtgccccctgtgaaccacctgcgcatcgagaaggtggccaacagaggccacagcagcggccgcacccctgggggcttcctgaagagctag

SEQ ID NO: 143343 - DNA, 897 bp, Artificial Sequence
  Description of Artificial Sequence: Synthetic coding sequence
atggtgaggatggtgcctgtgctgctgagcctgctgctgctgctgggccctgctgtgccccaggagaaccaggacggccgctacagcctgacctacatctacacaggcctgagcaagcacgtggaggatgtgcctgccttccaggccctgggcagcctgaatgacctgcagttcttccgctacaacagcaaggacaggaagagccagcccatgggcctgtggaggcaggtggagggcatggaggactggaagcaggacagccagctgcagaaggcccgggaggacatcttcatggagaccctgaaggacatcgtggagtactacaatgacagcaatggcagccacgtgctgcagggccgcttcggctgtgaaattgagaacaacagaagcagcggggccttctggaagtactactatgatggcaaggactacatcgagttcaacaaggagatcccagcctgggtgccctttgatcctgctgcccagatcaccaagcagaagtgggaggccgagcctgtgtatgtgcagagggccaaggcctacctggaggaggagtgcccagccaccctgaggaagtacctgaagtacagcaagaacatcctggaccggcaggacccccccagcgtggtggtgaccagccaccaggcccctggagagaagaagaagctgaagtgcctggcctatgacttctacccaggcaagattgatgtgcactggacccgggccggggaggtgcaggagcctgagctgcggggagatgtgctgcacaatggaaatggcacctaccagagctgggtggtggtggccgtgcccccccaggacacagccccctacagctgccacgtgcagcacagcagcctggcccagcccctggtggtgccctgggaggccagctag

SEQ ID NO: 143344 - DNA, 1104 bp, Artificial Sequence
  Description of Artificial Sequence: Synthetic coding sequence
atgaagagcctggtgctgctgctgtgcctggcccagctgtggggctgccacagcgcccctcatggccctggcctcatctaccggcagcccaactgtgatgatcctgagacagaggaggccgccctggtggccatcgactacatcaaccagaacctgccctggggctacaagcacaccctgaaccagattgatgaggtgaaggtgtggccccagcagcccagcggggagctgtttgaaattgaaattgacaccctggagaccacctgccacgtgctggaccccacccctgtggcccgctgcagcgtgcggcagctgaaggagcacgctgtggagggggactgtgacttccagctgctgaagctggatggcaagttctctgtggtgtatgccaagtgtgacagcagcccagacagcgcagaagatgtgaggaaggtgtgccaggactgccccctgctggcccccctgaatgacaccagggtggtgcatgctgccaaggccgccctggccgccttcaatgcccagaacaacggcagcaacttccagctggaggagatcagccgggcccagctggtgcccctgccccccagcacctacgtggagttcaccgtgtctggaacagactgtgtggccaaggaggccacagaggccgccaagtgcaacctgctggccgagaagcagtatggcttctgcaaggccaccctgtctgagaagctgggcggcgctgaggtggccgtgacctgcatggtgttccagacccagcctgtgagcagccagccccagcctgagggcgccaatgaagctgtgcccacccctgtggtggaccctgatgccccacccagcccccccctgggcgcccctggcctgcccccagctggcagccccccagacagccacgtgctgctggccgcccctcctggccaccagctgcaccgggcccactatgacctgcggcacaccttcatgggcgtggtgtccctgggcagccccagcggggaggtgagccaccccaggaagaccaggacagtggtgcagcccagcgtgggcgctgctgctggccctgtggtgcccccctgccccggccgcatccgccacttcaaggtgtag

SEQ ID NO: 143345 - DNA, 1302 bp, Artificial Sequence
  Description of Artificial Sequence: Synthetic coding sequence
atgtttgctggctgcttcttcttcctgctgaaccagagcaggaaccaccctgtgtccctgtgcaacagcagcggccgcctgcagcagatcaacaaggcccaccaccccccctgggtgtacctgagccagcagagcacctgggtgggccctgaggccagcaaccacctgcacgcctgccagggcctgtctggagctgccatgaagagcctggtgctgctgctgtgcctggcccagctgtggggctgccacagcgcccctcatggccctggcctcatctaccggcagcccaactgtgatgatcctgagacagaggaggccgccctggtggccatcgactacatcaaccagaacctgccctggggctacaagcacaccctgaaccagattgatgaggtgaaggtgtggccccagcagcccagcggggagctgtttgaaattgaaattgacaccctggagaccacctgccacgtgctggaccccacccctgtggcccgctgcagcgtgcggcagctgaaggagcacgctgtggagggggactgtgacttccagctgctgaagctggatggcaagttctctgtggtgtatgccaagtgtgacagcagcccagacagcgcagaagatgtgaggaaggtgtgccaggactgccccctgctggcccccctgaatgacaccagggtggtgcatgctgccaaggccgccctggccgccttcaatgcccagaacaacggcagcaacttccagctggaggagatcagccgggcccagctggtgcccctgccccccagcacctacgtggagttcaccgtgtctggaacagactgtgtggccaaggaggccacagaggccgccaagtgcaacctgctggccgagaagcagtatggcttctgcaaggccaccctgtctgagaagctgggcggcgctgaggtggccgtgacctgcatggtgttccagacccagcctgtgagcagccagccccagcctgagggcgccaatgaagctgtgcccacccctgtggtggaccctgatgccccacccagcccccccctgggcgcccctggcctgcccccagctggcagccccccagacagccacgtgctgctggccgcccctcctggccaccagctgcaccgggcccactatgacctgcggcacaccttcatgggcgtggtgtccctgggcagccccagcggggaggtgagccaccccaggaagaccaggacagtggtgcagcccagcgtgggcgctgctgctggccctgtggtgcccccctgccccggccgcatccgccacttcaaggtgtag

SEQ ID NO: 143346 - DNA, 4425 bp, Artificial Sequence
  Description of Artificial Sequence: Synthetic coding sequence
atgggcaagaacaagctgctgcaccccagcctggtgctgctgctgctggtgctgctgcccacagatgcctctgtgtctgggaagccccagtacatggtgctggtgcccagcctgctgcacacagagaccacagagaagggctgtgtgctgctgagctacctgaatgaaacagtgacagtgtctgccagcctggagagcgtgcggggcaacagaagcctcttcacagacctggaggccgagaatgatgtgctgcactgtgtggcctttgctgtgcccaagagcagcagcaatgaggaggtgatgttcctgactgtgcaggtgaagggccccacccaggagttcaagaagaggaccaccgtgatggtgaagaatgaagacagcctggtgtttgtgcagacagacaagagcatctacaagccaggccagacagtgaagttccgggtggtgtccatggatgagaacttccaccccctgaatgaactcatccccctggtgtacatccaggaccccaagggcaacagaattgcccagtggcagagcttccagctggagggcggcctgaagcagttctccttccccctgagcagcgagcccttccagggcagctacaaggtggtggtgcagaagaagagcggcggccgcacagagcaccccttcaccgtggaggagtttgtgctgcccaagtttgaggtgcaggtgacagtgcccaagatcatcaccatcctggaggaggagatgaatgtgtctgtgtgtggcctgtacacctacggcaagcctgtgcccggccacgtgacagtgtccatctgcaggaagtacagtgatgccagtgactgccacggggaggacagccaggccttctgtgagaagttcagcggccagctgaacagccacggctgcttctaccagcaggtgaagaccaaggtgttccagctgaagaggaaggagtatgagatgaagctgcacacagaggcccagatccaggaggagggcaccgtggtggagctgaccggccggcagagcagcgagatcaccaggaccatcaccaagctgagctttgtgaaggtggacagccacttccggcagggcatccccttcttcggccaggtgcggctggtggatggaaaaggagtgcccatccccaacaaggtgatcttcatcagaggaaatgaggccaactactacagcaatgccaccacagatgagcacggcctggtgcagttcagcatcaacaccaccaacgtgatgggcaccagcctgactgtgcgggtgaactacaaggacaggagcccctgctacggctaccagtgggtgtctgaggagcacgaggaggcccaccacacagcctacctggtgttcagccccagcaagagctttgtgcacctggagcccatgagccatgagctgccctgtggccacacccagacagtgcaggcccactacatcctgaatggaggcaccctgctgggcctgaagaagctgtccttctactacctgatcatggccaagggcggcatcgtgaggacaggcacccacggcctgctggtgaagcaggaggacatgaagggccacttcagcatcagcatccctgtgaagagtgacatcgcccctgtggcccggctgctgatctatgctgtgctgcccactggagatgtgattggagacagcgccaagtatgatgtggagaactgcctggccaacaaggtggacctgtccttcagccccagccagagcctgcctgccagccacgcccacctgcgggtgacagctgccccccagagcgtgtgtgccctgcgggctgtggaccagagcgtgctgctgatgaagccagatgctgagctgagcgccagctctgtgtacaacctgctgcctgagaaggacctgaccggcttccctggccccctgaatgaccaggacaatgaagactgcatcaacagacacaacgtgtacatcaatggcatcacctacacccctgtgagcagcaccaatgagaaggacatgtacagcttcctggaggacatgggcctgaaggccttcaccaacagcaagatcaggaagcccaagatgtgcccccagctgcagcagtatgagatgcacggccctgagggcctgcgggtgggcttctatgaaagtgatgtgatgggccggggccacgcccggctggtgcacgtggaggagccccacacagagaccgtgaggaagtacttccctgagacctggatctgggacctggtggtggtgaacagcgctggggtggccgaggtgggcgtgacagtgcctgacaccatcacagagtggaaggccggggccttctgcctgtctgaagatgctggcctgggcatcagcagcacagccagcctgcgggccttccagcccttctttgtggagctgaccatgccctacagcgtcatccggggggaggccttcaccctgaaggccaccgtgctgaactacctgcccaagtgcatccgggtgtctgtgcagctggaggccagccctgccttcctggccgtgcctgtggagaaggagcaggccccccactgcatctgtgccaacggccggcagacagtgtcctgggccgtgacccccaagagcctgggcaatgtgaacttcaccgtgtctgctgaggccctggagagccaggagctgtgtggcacagaggtgcccagcgtgcctgagcacggcaggaaggacaccgtcatcaagcccctgctggtggagcctgagggcctggagaaggagaccaccttcaacagcctgctgtgccccagcggcggggaggtgtctgaggagctgagcctgaagctgccccccaacgtggtggaggagagcgcccgggcctctgtgtctgtgctgggggacatcctgggcagcgccatgcagaacacccagaacctgctgcagatgccctacggctgtggggagcagaacatggtgctgtttgcccccaacatctacgtgctggactacctgaatgagacccagcagctgaccccagagatcaagagcaaggccatcggctacctgaacacaggctaccagaggcagctgaactacaagcactatgatggcagctacagcaccttcggggagagatatggcaggaaccagggcaacacctggctgacagcctttgtgctgaagacctttgcccaggcccgggcctacatcttcattgatgaggcccacatcacccaggccctgatctggctgagccagaggcagaaggacaatggctgcttccgcagcagcggcagcctgctgaacaatgccatcaagggcggcgtggaggatgaggtgaccctgagcgcctacatcaccatcgccctgctggagatccccctgactgtgacccaccctgtggtgagaaatgccctcttctgcctggagagcgcctggaagacagcccaggagggggaccacggcagccacgtgtacaccaaggccctgctggcctatgcctttgccctggccggcaaccaggacaagaggaaggaggtgctgaagagcctgaatgaggaggccgtgaagaaggacaacagcgtgcactgggagcggccccagaagcccaaggcccctgtgggccacttctatgagccccaggcccccagcgctgaggtggagatgaccagctatgtgctgctggcctacctgacagcccagcctgcccccaccagcgaggacctgaccagcgccaccaacatcgtgaagtggatcaccaagcagcagaatgcccagggcggcttcagcagcacccaggacacagtggtggccctgcacgccctgagcaagtacggggccgccaccttcaccaggacaggcaaggccgcccaggtgaccatccagagcagcggcaccttcagcagcaagttccaggtggacaacaacaaccggctgctgctgcagcaggtgtccctgcctgagctgcctggagagtacagcatgaaggtgactggagagggctgtgtgtacctgcagaccagcctgaagtacaacatcctgcctgagaaggaggagttcccctttgccctgggcgtgcagaccctgccccagacctgtgatgagcccaaggcccacaccagcttccagatcagcctgtctgtgtcctacacaggcagccgcagcgccagcaacatggccatcgtggatgtgaagatggtgtctggcttcatccccctgaagcccaccgtgaagatgctggagaggagcaaccacgtgtccaggacagaggtgagcagcaaccacgtgctgatctacctggacaaggtgagcaaccagaccctgagcctcttcttcaccgtgctgcaggatgtgcctgtgcgggacctgaagccagccatcgtgaaggtgtatgactactatgaaacagatgaatttgccatcgccgagtacaatgccccctgcagcaaggacctgggcaatgcctag

SEQ ID NO: 143347 - DNA, 507 bp, Artificial Sequence
  Description of Artificial Sequence: Synthetic coding sequence
atgggcaagaacaagctgctgcaccccagcctggtgctgctgctgctggtgctgctgcccacagatgcctctgtgtctgggaagccccagtacatggtgctggtgcccagcctgctgcacacagagaccacagagaagggctgtgtgctgctgagctacctgaatgaaacagtgacagtgtctgccagcctggagagcgtgcggggcaacagaagcctcttcacagacctggaggccgagaatgatgtgctgcactgtgtggcctttgctgtgcccaagagcagcagcaatgaggaggtgatgttcctgactgtgcaggtgaagggccccacccaggagttcaagaagaggaccaccgtgatggtgaagaatgaagacagcctggtgtttgtgcagacagacaagagcatctacaagccaggccagacagtgaagttccgggtggtgtccatggatgagaacttccaccccctgaatgaactcatccccctggtgtacatccagtag

SEQ ID NO: 143348 - DNA, 4470 bp, Artificial Sequence
  Description of Artificial Sequence: Synthetic coding sequence
cgggtgcagtatgtgtgcagccccccagcccccagcttctgcaacatgggcaagaacaagctgctgcaccccagcctggtgctgctgctgctggtgctgctgcccacagatgcctctgtgtctgggaagccccagtacatggtgctggtgcccagcctgctgcacacagagaccacagagaagggctgtgtgctgctgagctacctgaatgagaccgtgacagtgtctgccagcctggagagcgtgcggggcaacagaagcctcttcacagacctggaggctgaaaatgatgtgctgcactgtgtggcctttgctgtgcccaagagcagcagcaatgaggaggtgatgttcctgactgtgcaggtgaagggccccacccaggagttcaagaagaggaccaccgtgatggtgaagaatgaagacagcctggtgtttgtgcagacagacaagagcatctacaagccaggccagacagtgaagttccgggtggtgtccatggatgagaacttccaccccctgaatgagctgatccccctggtgtacatccaggaccccaagggcaaccgcatcgcccagtggcagagcttccagctggagggcggcctgaagcagttctccttccccctgagcagcgagcccttccagggcagctacaaggtggtggtgcagaagaagagcggcggccgcacagagcaccccttcaccgtggaggagtttgtgctgcccaagtttgaggtgcaggtgacagtgcccaagatcatcaccatcctggaggaggagatgaatgtgtctgtgtgtggcctgtacacctacggcaagcctgtgcccggccacgtgacagtgtccatctgcaggaagtacagtgatgccagtgactgccacggggaggacagccaggccttctgtgagaagttcagcggccagctgaacagccacggctgcttctaccagcaggtgaagaccaaggtgttccagctgaagaggaaggagtatgagatgaagctgcacacagaggcccagatccaggaggagggcaccgtggtggagctgaccggccggcagagcagcgagatcaccaggaccatcaccaagctgagctttgtgaaggtggacagccacttccggcagggcatccccttcttcggccaggtgcggctggtggatggcaagggcgtgcccatccccaacaaggtgatcttcatcagaggaaatgaggccaactactacagcaatgccaccacagatgaacatggcctggtgcagttcagcatcaacaccaccaacgtgatgggcaccagcctgactgtgcgggtgaactacaaggacaggagcccctgctacggctaccagtgggtgtctgaggagcacgaggaggcccaccacacagcctacctggtgttcagccccagcaagagctttgtgcacctggagcccatgagccatgagctgccctgtggccacacccagacagtgcaggcccactacatcctgaatggaggcaccctgctgggcctgaagaagctgtccttctactacctgatcatggccaagggcggcatcgtgaggacaggcacccacggcctgctggtgaagcaggaggacatgaagggccacttcagcatcagcatccctgtgaagagtgacatcgcccctgtggcccggctgctgatctatgctgtgctgcccactggagatgtgattggagacagcgccaagtatgatgtggagaactgcctggccaacaaggtggacctgtccttcagccccagccagagcctgcctgccagccacgcccacctgcgggtgacagctgccccccagagcgtgtgtgccctgcgggctgtggaccagagcgtgctgctgatgaagccagatgctgagctgagcgccagctctgtgtacaacctgctgcctgagaaggacctgaccggcttccctggccccctgaatgaccaggacaatgaagactgcatcaacagacacaacgtgtacatcaatggcatcacctacacccctgtgagcagcaccaatgagaaggacatgtacagcttcctggaggacatgggcctgaaggccttcaccaacagcaagatcaggaagcccaagatgtgcccccagctgcagcagtatgagatgcacggccctgagggcctgcgggtgggcttctatgaaagtgatgtgatgggccggggccacgcccggctggtgcacgtggaggagccccacacagaaacagtgaggaagtacttccctgagacctggatctgggacctggtggtggtgaacagcgctggggtggccgaggtgggcgtgacagtgcctgacaccatcacagagtggaaggccggggccttctgcctgtctgaagatgctggcctgggcatcagcagcacagccagcctgcgggccttccagcccttctttgtggagctgaccatgccctacagcgtcatccggggggaggccttcaccctgaaggccaccgtgctgaactacctgcccaagtgcatccgggtgtctgtgcagctggaggccagccctgccttcctggccgtgcctgtggagaaggagcaggccccccactgcatctgtgccaacggccggcagacagtgtcctgggccgtgacccccaagagcctgggcaatgtgaacttcaccgtgtctgctgaggccctggagagccaggagctgtgtggcacagaggtgcccagcgtgcctgagcacggcaggaaggacaccgtcatcaagcccctgctggtggagcctgagggcctggagaaggagaccaccttcaacagcctgctgtgccccagcggcggggaggtgtctgaggagctgagcctgaagctgcccccaaatgtggtggaggagagcgcccgggcctctgtgtctgtgctgggggacatcctgggcagcgccatgcagaacacccagaacctgctgcagatgccctacggctgtggggagcagaacatggtgctgtttgcccccaacatctacgtgctggactacctgaatgagacccagcagctgaccccagagatcaagagcaaggccatcggctacctgaacacaggctaccagaggcagctgaactacaagcactatgatggcagctacagcacctttggagagagatatggaagaaaccagggcaacacctggctgacagcctttgtgctgaagacctttgcccaggcccgggcctacatcttcattgatgaggcccacatcacccaggccctgatctggctgagccagaggcagaaggacaatggctgcttccgcagcagcggcagcctgctgaacaatgccatcaagggcggcgtggaggatgaggtgaccctgagcgcctacatcaccatcgccctgctggagatccccctgactgtgacccaccctgtggtgagaaatgccctcttctgcctggagagcgcctggaagacagcccaggagggggaccacggcagccacgtgtacaccaaggccctgctggcctatgcctttgccctggccggcaaccaggacaagaggaaggaggtgctgaagagcctgaatgaggaggccgtgaagaaggacaacagcgtgcactgggagcggccccagaagcccaaggcccctgtgggccacttctatgagccccaggcccccagcgctgaggtggagatgaccagctatgtgctgctggcctacctgacagcccagcctgcccccaccagcgaggacctgaccagcgccaccaacatcgtgaagtggatcaccaagcagcagaatgcccagggcggcttcagcagcacccaggacacagtggtggccctgcacgccctgagcaaatatggagctgccaccttcaccaggacaggcaaggccgcccaggtgaccatccagagcagcggcaccttcagcagcaagttccaggtggacaacaacaaccggctgctgctgcagcaggtgtccctgcctgagctgcccggggagtacagcatgaaggtgactggagagggctgtgtgtacctgcagaccagcctgaagtacaacatcctgcctgagaaggaggagttcccctttgccctgggcgtgcagaccctgccccagacctgtgatgagcccaaggcccacaccagcttccagatcagcctgtctgtgtcctacacaggcagccgcagcgccagcaacatggccatcgtggatgtgaagatggtgtctggcttcatccccctgaagcccaccgtgaagatgctggagaggagcaaccacgtgtccaggacagaggtgagcagcaaccacgtgctgatctacctggacaaggtgagcaaccagaccctgagcctcttcttcaccgtgctgcaggatgtgcctgtgcgggacctgaagccagccatcgtgaaggtgtatgactactatgaaacagatgaatttgccatcgccgagtacaatgccccctgcagcaaggacctgggcaatgcctag

SEQ ID NO: 143349 - DNA, 4365 bp, Artificial Sequence
  Description of Artificial Sequence: Synthetic coding sequence
atgtgggcccagctgctgctgggcatgctggccctgagccctgccatcgccgaggagctgcccaactacctggtgaccctgcctgcccggctgaacttccccagcgtgcagaaggtgtgcctggacctgagccctggctacagtgatgtgaagttcaccgtgaccctggagaccaaggacaagacccagaagctgctggagtacagcggcctgaagaagaggcacctgcactgcatctccttcctggtgcccccacctgctgggggcacagaggaggtggccaccatccgggtgtctggagtgggcaacaacatcagctttgaggagaagaagaaggtgctgatccagaggcagggcaatggcacctttgtgcagacagacaagcccctgtacaccccaggccagcaggtgtacttcagaattgtgaccatggacagcaactttgtgcctgtgaatgacaagtacagcatggtggagctgcaggaccccaacagcaaccgcatcgcccagtggctggaggtggtgcctgagcagggcatcgtggacctgtccttccagctggcccctgaggccatgctgggcacctacacagtggccgtggccgagggcaagaccttcggcaccttctctgtggaggagtatgtgctgcccaagttcaaggtggaggtggtggagcccaaggagctgagcacagtgcaggagagcttcctggtgaagatctgctgccgctacacctacggcaagcccatgctgggcgctgtgcaggtgtctgtgtgccagaaggccaacacctactggtaccgggaggtggagcgggagcagctgcctgacaagtgcaggaacctgagcggccagacagacaagacaggctgcttcagcgcccctgtggacatggccacctttgacctgattggctacgcctacagccaccagatcaacatcgtggccaccgtggtggaggagggcactggagtggaggccaatgccacccagaacatctacatcagcccccagatgggctccatgacctttgaggacaccagcaacttctaccaccccaacttccccttcagcggcaagatccgggtgcggggccatgatgacagcttcctgaagaaccacctggtgttcctggtgatctacggcaccaacggcaccttcaaccagaccctggtgacagacaacaacggcctggcccccttcaccctggagaccagcggctggaatggaacagatgtgtccctggagggcaagttccagatggaggacctggtgtacaaccctgagcaggtgccccgctactaccagaatgcctacctgcacctgcggcccttctacagcaccaccaggagcttcctgggcatccaccggctgaatggccccctgaagtgtggccagccccaggaggtgctggtggactactacatcgaccctgcagatgccagcccagaccaggagatctccttctcctactacctgattggcaagggcagcctggtgatggagggccagaagcacctgaacagcaagaagaagggcctgaaggccagcttcagcctgagcctgaccttcaccagccggctggccccagaccccagcctggtgatctatgccatcttccccagcggcggcgtggtggccgacaagatccagttctctgtggagatgtgctttgacaaccaggtgtccctgggcttcagccccagccagcagctgcctggagctgaggtggagctgcagctgcaggccgcccctggcagcctgtgtgccctgcgggctgtggatgaatctgtgctgctgctgcggccagaccgggagctgagcaacagatctgtgtatggcatgttccccttctggtacggccactacccctaccaggtggccgagtatgaccagtgccctgtgtctggcccctgggacttcccccagcccctgattgaccccatgccccagggccacagcagccagaggagcatcatctggaggcccagcttcagcgagggcacagacctcttctccttcttcagagatgtgggcctgaagatcctgagcaatgccaagatcaagaagcctgtggactgcagccacaggagccctgagtacagcacagccatgggcgccggcggcggccaccctgaggcctttgagagcagcacccccctgcaccaggccgaggacagccaggtgcggcagtacttccctgagacctggctgtgggacctcttccccatcggcaacagcggcaaggaggccgtgcacgtgacagtgcctgatgccatcacagagtggaaggccatgtccttctgcaccagccagagccggggcttcggcctgagccccaccgtgggcctgacagccttcaagcccttctttgtggacctgaccctgccctacagcgtggtgcggggggagagcttccggctgacagccaccatcttcaactacctgaaggactgcatccgggtgcagacagacctggccaagagccatgagtaccagctggagagctgggccgacagccagaccagcagctgcctgtgtgctgatgatgccaagacccaccactggaacatcacagctgtgaagctgggccacatcaacttcaccatcagcaccaagatcctggacagcaatgagccctgtggcggccagaagggctttgtgccccagaagggccgcagtgacaccctcatcaagcctgtgctggtgaagccagagggcgtgctggtggagaagacccacagcagcctgctgtgccccaagggcaaggtggccagcgagagcgtgtccctggagctgcctgtggacatcgtgcctgacagcaccaaggcctacgtgacagtgctgggggacatcatgggcacagccctgcagaacctggatggcctggtgcagatgcccagcggctgtggggagcagaacatggtgctgtttgcccccatcatctacgtgctgcagtacctggagaaggccggcctgctgacagaggagatccgcagcagagctgtgggcttcctggagatcggctaccagaaggagctgatgtacaagcacagcaatggcagctacagcgccttcggggagagagatggaaatggaaacacctggctgacagcctttgtgaccaagtgcttcggccaggcccagaagttcatcttcatcgaccccaagaacatccaggatgccctgaagtggatggccggcaaccagctgcccagcggctgctacgccaacgtgggcaacctgctgcacacagccatgaagggcggcgtggatgatgaggtgtccctgacagcctacgtgacagctgccctgctggagatgggcaaggatgtggatgaccccatggtgtcccagggcctgcgctgcctgaagaacagcgccaccagcaccaccaacctgtacacccaggccctgctggcctacatcttcagcctggccggggagatggacatccggaacatcctgctgaagcagctggaccagcaggccatcatctctggagagagcatctactggagccagaagcccacccccagcagcaatgccagcccctggagcgagcctgctgctgtggatgtggagctgacagcctatgccctgctggcccagctgaccaagcccagcctgacccagaaggagatcgccaaggccaccagcatcgtggcctggctggccaagcagcacaatgcctacggcggcttcagcagcacccaggacacagtggtggccctgcaggccctggccaagtatgccaccacagcctacatgcccagcgaggagatcaacctggtggtgaagagcacagagaacttccagaggaccttcaacatccagagcgtgaaccggctggtgttccagcaggacaccctgcccaacgtgcccggcatgtacaccctggaggccagcggccagggctgtgtgtatgtgcagacagtgctgcgctacaacatcctgccccccaccaacatgaagaccttcagcctgtctgtggagatcggcaaggcccgctgtgagcagcccaccagccccaggagcctgaccctgaccatccacaccagctatgtgggcagccgcagcagcagcaacatggccatcgtggaggtgaagatgctgagcggcttcagccccatggagggcaccaaccagctgctgctgcagcagcccctggtgaagaaggtggagtttggaacagacaccctgaacatctacctggatgagctgatcaagaacacccagacctacaccttcaccatcagccagagcgtgctggtgaccaacctgaagccagccaccatcaaggtgtatgactactacctgcctgatgagcaggccaccatccagtacagcgacccctgtgagtag

SEQ ID NO: 143350 - DNA, 4365 bp, Artificial Sequence
  Description of Artificial Sequence: Synthetic coding sequence
atgtgggcccagctgctgctgggcatgctggccctgagccctgccatcgccgaggagctgcccaactacctggtgaccctgcctgcccggctgaacttccccagcgtgcagaaggtgtgcctggacctgagccctggctacagtgatgtgaagttcaccgtgaccctggagaccaaggacaagacccagaagctgctggagtacagcggcctgaagaagaggcacctgcactgcatctccttcctggtgcccccacctgctgggggcacagaggaggtggccaccatccgggtgtctggagtgggcaacaacatcagctttgaggagaagaagaaggtgctgatccagaggcagggcaatggcacctttgtgcagacagacaagcccctgtacaccccaggccagcaggtgtacttcagaattgtgaccatggacagcaactttgtgcctgtgaatgacaaggtgtcctgggaggagggccaggaccccaacagcaaccgcatcgcccagtggctggaggtggtgcctgagcagggcatcgtggacctgtccttccagctggcccctgaggccatgctgggcacctacacagtggccgtggccgagggcaagaccttcggcaccttctctgtggaggagtatgtgctgcccaagttcaaggtggaggtggtggagcccaaggagctgagcacagtgcaggagagcttcctggtgaagatctgctgccgctacacctacggcaagcccatgctgggcgctgtgcaggtgtctgtgtgccagaaggccaacacctactggtaccgggaggtggagcgggagcagctgcctgacaagtgcaggaacctgagcggccagacagacaagacaggctgcttcagcgcccctgtggacatggccacctttgacctgattggctacgcctacagccaccagatcaacatcgtggccaccgtggtggaggagggcactggagtggaggccaatgccacccagaacatctacatcagcccccagatgggctccatgacctttgaggacaccagcaacttctaccaccccaacttccccttcagcggcaagatccgggtgcggggccatgatgacagcttcctgaagaaccacctggtgttcctggtgatctacggcaccaacggcaccttcaaccagaccctggtgacagacaacaacggcctggcccccttcaccctggagaccagcggctggaatggaacagatgtgtccctggagggcaagttccagatggaggacctggtgtacaaccctgagcaggtgccccgctactaccagaatgcctacctgcacctgcggcccttctacagcaccaccaggagcttcctgggcatccaccggctgaatggccccctgaagtgtggccagccccaggaggtgctggtggactactacatcgaccctgcagatgccagcccagaccaggagatctccttctcctactacctgattggcaagggcagcctggtgatggagggccagaagcacctgaacagcaagaagaagggcctgaaggccagcttcagcctgagcctgaccttcaccagccggctggccccagaccccagcctggtgatctatgccatcttccccagcggcggcgtggtggccgacaagatccagttctctgtggagatgtgctttgacaaccaggtgtccctgggcttcagccccagccagcagctgcctggagctgaggtggagctgcagctgcaggccgcccctggcagcctgtgtgccctgcgggctgtggatgaatctgtgctgctgctgcggccagaccgggagctgagcaacagatctgtgtatggcatgttccccttctggtacggccactacccctaccaggtggccgagtatgaccagtgccctgtgtctggcccctgggacttcccccagcccctgattgaccccatgccccagggccacagcagccagaggagcatcatctggaggcccagcttcagcgagggcacagacctcttctccttcttcagagatgtgggcctgaagatcctgagcaatgccaagatcaagaagcctgtggactgcagccacaggagccctgagtacagcacagccatgggcgccggcggcggccaccctgaggcctttgagagcagcacccccctgcaccaggccgaggacagccaggtgcggcagtacttccctgagacctggctgtgggacctcttccccatcggcaacagcggcaaggaggccgtgcacgtgacagtgcctgatgccatcacagagtggaaggccatgtccttctgcaccagccagagccggggcttcggcctgagccccaccgtgggcctgacagccttcaagcccttctttgtggacctgaccctgccctacagcgtggtgcggggggagagcttccggctgacagccaccatcttcaactacctgaaggactgcatccgggtgcagacagacctggccaagagccatgagtaccagctggagagctgggccgacagccagaccagcagctgcctgtgtgctgatgatgccaagacccaccactggaacatcacagctgtgaagctgggccacatcaacttcaccatcagcaccaagatcctggacagcaatgagccctgtggcggccagaagggctttgtgccccagaagggccgcagtgacaccctcatcaagcctgtgctggtgaagccagagggcgtgctggtggagaagacccacagcagcctgctgtgccccaagggcaaggtggccagcgagagcgtgtccctggagctgcctgtggacatcgtgcctgacagcaccaaggcctacgtgacagtgctgggggacatcatgggcacagccctgcagaacctggatggcctggtgcagatgcccagcggctgtggggagcagaacatggtgctgtttgcccccatcatctacgtgctgcagtacctggagaaggccggcctgctgacagaggagatccgcagcagagctgtgggcttcctggagatcggctaccagaaggagctgatgtacaagcacagcaatggcagctacagcgccttcggggagagagatggaaatggaaacacctggctgacagcctttgtgaccaagtgcttcggccaggcccagaagttcatcttcatcgaccccaagaacatccaggatgccctgaagtggatggccggcaaccagctgcccagcggctgctacgccaacgtgggcaacctgctgcacacagccatgaagggcggcgtggatgatgaggtgtccctgacagcctacgtgacagctgccctgctggagatgggcaaggatgtggatgaccccatggtgtcccagggcctgcgctgcctgaagaacagcgccaccagcaccaccaacctgtacacccaggccctgctggcctacatcttcagcctggccggggagatggacatccggaacatcctgctgaagcagctggaccagcaggccatcatctctggagagagcatctactggagccagaagcccacccccagcagcaatgccagcccctggagcgagcctgctgctgtggatgtggagctgacagcctatgccctgctggcccagctgaccaagcccagcctgacccagaaggagatcgccaaggccaccagcatcgtggcctggctggccaagcagcacaatgcctacggcggcttcagcagcacccaggacacagtggtggccctgcaggccctggccaagtatgccaccacagcctacatgcccagcgaggagatcaacctggtggtgaagagcacagagaacttccagaggaccttcaacatccagagcgtgaaccggctggtgttccagcaggacaccctgcccaacgtgcccggcatgtacaccctggaggccagcggccagggctgtgtgtatgtgcagacagtgctgcgctacaacatcctgccccccaccaacatgaagaccttcagcctgtctgtggagatcggcaaggcccgctgtgagcagcccaccagccccaggagcctgaccctgaccatccacaccagctatgtgggcagccgcagcagcagcaacatggccatcgtggaggtgaagatgctgagcggcttcagccccatggagggcaccaaccagctgctgctgcagcagcccctggtgaagaaggtggagtttggaacagacaccctgaacatctacctggatgagctgatcaagaacacccagacctacaccttcaccatcagccagagcgtgctggtgaccaacctgaagccagccaccatcaaggtgtatgactactacctgcctgatgagcaggccaccatccagtacagcgacccctgtgagtag

SEQ ID NO: 143351 - DNA, 3015 bp, Artificial Sequence
  Description of Artificial Sequence: Synthetic coding sequence
tccttcctgggcatccaccggctgaatggccccctgaagtgtggccagccccaggaggtgctggtggactactacatcgaccctgcagatgccagcccagaccaggagatctccttctcctactacctgattggcaagggcagcctggtgatggagggccagaagcacctgaacagcaagaagaagggcctgaaggccagcttcagcctgagcctgaccttcaccagccggctggccccagaccccagcctggtgatctatgccatcttccccagcggcggcgtggtggccgacaagatccagttctctgtggagatgtgctttgacaaccaggtgtccctgggcttcagccccagccagcagctgcctggagctgaggtggagctgcagctgcaggccgcccctggcagcctgtgtgccctgcgggctgtggatgaatctgtgctgctgctgcggccagaccgggagctgagcaacagatctgtgtatggcatgttccccttctggtacggccactacccctaccaggtggccgagtatgaccagtgccctgtgtctggcccctgggacttcccccagcccctgattgaccccatgccccagggccacagcagccagaggagcatcatctggaggcccagcttcagcgagggcacagacctcttctccttcttcagagatgtgggcctgaagatcctgagcaatgccaagatcaagaagcctgtggactgcagccacaggagccctgagtacagcacagccatgggcgccggcggcggccaccctgaggcctttgagagcagcacccccctgcaccaggccgaggacagccaggtgcggcagtacttccctgagacctggctgtgggacctcttccccatcggcaacagcggcaaggaggccgtgcacgtgacagtgcctgatgccatcacagagtggaaggccatgtccttctgcaccagccagagccggggcttcggcctgagccccaccgtgggcctgacagccttcaagcccttctttgtggacctgaccctgccctacagcgtggtgcggggggagagcttccggctgacagccaccatcttcaactacctgaaggactgcatccgggtgcagacagacctggccaagagccatgagtaccagctggagagctgggccgacagccagaccagcagctgcctgtgtgctgatgatgccaagacccaccactggaacatcacagctgtgaagctgggccacatcaacttcaccatcagcaccaagatcctggacagcaatgagccctgtggcggccagaagggctttgtgccccagaagggccgcagtgacaccctcatcaagcctgtgctggtgaagccagagggcgtgctggtggagaagacccacagcagcctgctgtgccccaagggcaaggtggccagcgagagcgtgtccctggagctgcctgtggacatcgtgcctgacagcaccaaggcctacgtgacagtgctgggggacatcatgggcacagccctgcagaacctggatggcctggtgcagatgcccagcggctgtggggagcagaacatggtgctgtttgcccccatcatctacgtgctgcagtacctggagaaggccggcctgctgacagaggagatccgcagcagagctgtgggcttcctggagatcggctaccagaaggagctgatgtacaagcacagcaatggcagctacagcgccttcggggagagagatggaaatggaaacacctggctgacagcctttgtgaccaagtgcttcggccaggcccagaagttcatcttcatcgaccccaagaacatccaggatgccctgaagtggatggccggcaaccagctgcccagcggctgctacgccaacgtgggcaacctgctgcacacagccatgaagggcggcgtggatgatgaggtgtccctgacagcctacgtgacagctgccctgctggagatgggcaaggatgtggatgaccccatggtgtcccagggcctgcgctgcctgaagaacagcgccaccagcaccaccaacctgtacacccaggccctgctggcctacatcttcagcctggccggggagatggacatccggaacatcctgctgaagcagctggaccagcaggccatcatctctggagagagcatctactggagccagaagcccacccccagcagcaatgccagcccctggagcgagcctgctgctgtggatgtggagctgacagcctatgccctgctggcccagctgaccaagcccagcctgacccagaaggagatcgccaaggccaccagcatcgtggcctggctggccaagcagcacaatgcctacggcggcttcagcagcacccaggacacagtggtggccctgcaggccctggccaagtatgccaccacagcctacatgcccagcgaggagatcaacctggtggtgaagagcacagagaacttccagaggaccttcaacatccagagcgtgaaccggctggtgttccagcaggacaccctgcccaacgtgcccggcatgtacaccctggaggccagcggccagggctgtgtgtatgtgcagacagtgctgcgctacaacatcctgccccccaccaacatgaagaccttcagcctgtctgtggagatcggcaaggcccgctgtgagcagcccaccagccccaggagcctgaccctgaccatccacaccagctatgtgggcagccgcagcagcagcaacatggccatcgtggaggtgaagatgctgagcggcttcagccccatggagggcaccaaccagctgctgctgcagcagcccctggtgaagaaggtggagtttggaacagacaccctgaacatctacctggatgagctgatcaagaacacccagacctacaccttcaccatcagccagagcgtgctggtgaccaacctgaagccagccaccatcaaggtgtatgactactacctgcctgatgagcaggccaccatccagtacagcgacccctgtgagtag

SEQ ID NO: 143352 - DNA, 1830 bp, Artificial Sequence
  Description of Artificial Sequence: Synthetic coding sequence
atgaagtgggtggagagcatcttcctgatcttcctgctgaacttcacagagagcaggaccctgcacagaaatgaatatggcatcgccagcatcctggacagctaccagtgcacagctgagatcagcctggccgacctggccaccatcttctttgcccagtttgtgcaggaggccacctacaaggaggtgtccaagatggtgaaggatgccctgacagccatcgagaagcccactggagatgagcagagcagcggctgcctggagaaccagctgcctgccttcctggaggagctgtgccacgagaaggagatcctggagaagtatggccacagcgactgctgcagccagagcgaggagggccgccacaactgcttcctggcccacaagaagcccaccccagccagcatccccctcttccaggtgcctgagcctgtgaccagctgtgaggcctatgaagaagatcgggagaccttcatgaacaagttcatctatgagatcgcccggcggcaccccttcctgtatgcccccaccatcctgctgtgggccgcccgctatgacaagatcatccccagctgctgcaaggccgagaatgctgtggagtgcttccagaccaaggccgccaccgtgaccaaggagctgcgggagagcagcctgctgaaccagcacgcctgtgctgtgatgaagaactttggcaccaggaccttccaggccatcaccgtgaccaagctgagccagaagttcaccaaggtgaacttcacagagatccagaagctggtgctggatgtggcccacgtgcatgagcactgctgcagaggagatgtgctggactgcctgcaggatggagagaagatcatgagctacatctgcagccagcaggacaccctgagcaacaagatcacagagtgctgcaagctgaccaccctggagcggggccagtgcatcatccatgctgaaaatgatgagaagccagagggcctgagccccaacctgaaccgcttcctgggggaccgggacttcaaccagttcagcagcggggagaagaacatcttcctggccagctttgtgcatgagtacagccgccgccacccccagctggccgtgtctgtcatcctgcgggtggccaagggctaccaggagctgctggagaagtgcttccagacagagaaccccctggagtgccaggacaagggggaggaggagctgcagaagtacatccaggagagccaggccctggccaagaggagctgtggcctcttccagaagctgggggagtactacctgcagaatgccttcctggtggcctacaccaagaaggccccccagctgaccagcagcgagctgatggccatcaccaggaagatggccgccacagctgccacctgctgccagctgtctgaggacaagctgctggcctgtggggagggcgctgctgacatcatcatcggccacctgtgcatcagacatgagatgacccctgtgaaccctggggtgggccagtgctgcaccagcagctatgccaacagaagaccctgcttcagcagcctggtggtggatgagacctacgtgcccccagccttcagtgatgacaagttcatcttccacaaggacctgtgccaggcccagggcgtggccctgcagaccatgaagcaggagttcctgatcaacctggtgaagcagaagccccagatcacagaggagcagctggaggccgtgattgctgacttcagcggcctgctggagaagtgctgccagggccaggagcaggaggtgtgctttgctgaggagggccagaagctgatcagcaagaccagggctgccctgggcgtgtag

SEQ ID NO: 143353 - DNA, 3735 bp, Artificial Sequence
  Description of Artificial Sequence: Synthetic coding sequence
atgaacaaccagaaggtggtggccgtgctgctgcaggagtgcaagcaggtgctggaccagctgctgctggaggccccagatgtgtctgaggaggacaagtctgaggaccagcgctgccgggccctgctgcccagcgagctgcggaccctcatccaggaggccaaggagatgaagtggccctttgtgcctgagaagtggcagtacaagcaggccgtgggccctgaggacaagaccaacctgaaggatgtgattggagctggcctgcagcagctgctggccagcctgcgggccagcatcctggcccgggactgtgccgctgctgctgccatcgtgttcctggtggaccgcttcctgtatggcctggatgtgtctgggaagctgctgcaggtggccaagggcctgcacaagctgcagcctgccacccccatcgccccccaggtggtgatccggcaggcccgcatctctgtgaacagcggcaagctgctgaaggccgagtacatcctgagcagcctcatcagcaacaatggagccaccggcacctggctgtacagaaatgaaagtgacaaggtgctggtgcagagcgtgtgcatccagatccggggccagatcctgcagaagctgggcatgtggtatgaagctgctgagctgatctgggccagcatcgtgggctacctggccctgccccagcctgacaagaagggcctgagcaccagcctgggcatcctggccgacatctttgtgtccatgagcaagaatgactatgagaagttcaagaacaacccccagatcaacctgagcctgctgaaggagtttgaccaccacctgctgtctgctgctgaggcctgcaagctggccgccgccttcagcgcctacacccccctgtttgtgctgacagctgtgaacatccggggcacctgcctgctgagctacagcagcagcaatgactgccccccagagctgaagaacctgcacctgtgtgaggccaaggaggcctttgagatcggcctgctgaccaagagagatgatgagcctgtgacaggcaagcaggagctgcacagctttgtgaaggccgccttcggcctgaccaccgtgcaccggcggctgcatggagagaccggcaccgtgcatgctgccagccagctgtgcaaggaggccatgggcaagctgtacaacttcagcaccagcagccgcagccaggaccgggaggccctgagccaggaggtgatgtctgtcatcgcccaggtgaaggagcacctgcaggtgcagagcttcagcaatgtggatgacaggagctatgtgcctgagagctttgagtgccgcctggacaagctgatcctgcacggccagggcgacttccagaagatcctggacacctacagccagcaccacacctctgtgtgtgaggtgtttgaaagtgactgtggcaacaacaagaatgagcagaaggatgccaagacaggagtgtgcatcacagccctgaagacagagatcaagaacatcgacacagtgtccaccacccaggagaagccccactgccagagggacaccggcatcagcagcagcctgatgggcaagaatgtgcagcgggagctgcggcggggcggcagaagaaactggacccacagtgatgccttccgggtgtccctggaccaggatgtggagacagaaacagagcccagcgactacagcaatggagagggcgctgtgttcaacaagagcctgagcggcagccagaccagcagcgcctggagcaacctgagcggcttcagcagcagcgcctcctgggaggaggtgaactaccacgtggatgacagaagtgccaggaaggagcccgggaaggagcacctggtggacacccagtgcagcacagccctgtctgaggagctggagaatgaccgggagggccgggccatgcacagcctgcacagccagctgcatgacctgagcctgcaggagcccaacaatgacaacctggagcccagccagaaccagccccagcagcagatgcccctgacccccttcagcccccacaacaccccaggcatcttcctggcccctggggccggcctgctggagggcgcccctgagggcatccaggaggtgaggaacatgggccccaggaacaccagcgcccacagccggcccagctacagaagtgcctcctggagcagtgacagcggccggcccaagaacatgggcacccaccccagcgtgcagaaggaggaggcctttgagatcatcgtggagttccctgagaccaactgtgatgtgaaggaccggcagggcaaggagcagggcgaggagatcagcgagcggggggccggccccaccttcaaggccagccccagctgggtggaccctgagggggagacagctgagagcacagaagatgcccccctggacttccaccgggtgctgcacaacagcctgggcaacatctccatgctgccctgcagcagcttcacccccaactggcctgtgcagaacccagacagcaggaagagcggcggccctgtggccgagcagggcatcgaccctgatgccagcacagtggatgaggagggccagctgctggacagcatggatgtgccctgcaccaatggacatggcagccaccggctgtgcatcctgcggcagcccccaggccagagagctgagacccccaacagctctgtgtctggcaacatcctcttccctgtgctgtctgaggactgcaccaccacagaggagggcaaccagcccggcaacatgctgaactgcagccagaacagcagcagcagctctgtgtggtggctgaagagccctgccttcagcagcggcagcagcgagggggacagcccctggagctacctgaacagcagcggcagctcctgggtgtccctgcccgggaagatgaggaaggagatcctggaggcccggaccctgcagccagatgactttgagaagctgctggccggcgtgagacatgactggctgttccagaggctggagaacacaggagtcttcaagcccagccagctgcaccgggcccacagcgccctgctgctgaagtacagcaagaagtctgagctgtggacagcccaggagaccatcgtgtacctgggggactacctgactgtgaagaagaagggccggcagagaaatgccttctgggtgcaccacctgcaccaggaggagatcctgggccgctacgtgggcaaggactacaaggagcagaagggcctgtggcaccacttcacagatgtggagcggcagatgacagcccagcactacgtgacagagttcaacaagaggctgtatgagcagaacatccccacccagatcttctacatccccagcaccatcctgctgatcctggaggacaagaccatcaagggctgcatctctgtggagccctacatcctgggggagtttgtgaagctgagcaacaacaccaaggtggtgaagacagagtacaaggccacagaatatggcctggcctacggccacttctcctatgagttcagcaaccacagagatgtggtggtggacctgcagggctgggtgactggaaatggcaagggcctcatctacctgacagacccccagatccacagcgtggaccagaaggtgttcaccaccaactttgggaagaggggcatcttctacttcttcaacaaccagcacgtggagtgcaatgagatctgccaccggctgagcctgacccggcccagcatggagaagccctgcacctag

SEQ ID NO: 143354 - DNA, 429 bp, Artificial Sequence
  Description of Artificial Sequence: Synthetic coding sequence
atgaacaaccagaaggtggtggccgtgctgctgcaggagtgcaaggccctgctgcccagcgagctgcggaccctcatccaggaggccaaggagatgaagtggccctttgtgcctgagaagtggcagtacaagcaggccgtgggccctgaggacaagaccaacctgaaggatgtgattggagctggcctgcagcagctgctggccagcctgcgggccagcatcctggcccgggactgtgccgctgctgctgccatcgtgttcctggtggaccgcttcctgtatggcctggatgtgtctgggaagctgctgcaggtggccaagggcctgcacaagctgcagcctgccacccccatcgccccccaggtggtgatccggcaggcccgcatctctgtgaacagcggcagccacccagccaagcacagcatgtag

SEQ ID NO: 143355 - DNA, 3735 bp, Artificial Sequence; identical to SEQ ID NO: 143353
  Description of Artificial Sequence: Synthetic coding sequence

SEQ ID NO: 143356 - DNA, 3501 bp, Artificial Sequence
  Description of Artificial Sequence: Synthetic coding sequence
atgtgcaggaagaggacccgggcccggaccagcgctgctgaggccagcctgcgggccagcatcctggcccgggactgtgccgctgctgctgccatcgtgttcctggtggaccgcttcctgtatggcctggatgtgtctgggaagctgctgcaggtggccaagggcctgcacaagctgcagcctgccacccccatcgccccccaggtggtgatccggcaggcccgcatctctgtgaacagcggcaagctgctgaaggccgagtacatcctgagcagcctcatcagcaacaatggagccaccggcacctggctgtacagaaatgaaagtgacaaggtgctggtgcagagcgtgtgcatccagatccggggccagatcctgcagaagctgggcatgtggtatgaagctgctgagctgatctgggccagcatcgtgggctacctggccctgccccagcctgacaagaagggcctgagcaccagcctgggcatcctggccgacatctttgtgtccatgagcaagaatgactatgagaagttcaagaacaacccccagatcaacctgagcctgctgaaggagtttgaccaccacctgctgtctgctgctgaggcctgcaagctggccgccgccttcagcgcctacacccccctgtttgtgctgacagctgtgaacatccggggcacctgcctgctgagctacagcagcagcaatgactgccccccagagctgaagaacctgcacctgtgtgaggccaaggaggcctttgagatcggcctgctgaccaagagagatgatgagcctgtgacaggcaagcaggagctgcacagctttgtgaaggccgccttcggcctgaccaccgtgcaccggcggctgcatggagagaccggcaccgtgcatgctgccagccagctgtgcaaggaggccatgggcaagctgtacaacttcagcaccagcagccgcagccaggaccgggaggccctgagccaggaggtgatgtctgtcatcgcccaggtgaaggagcacctgcaggtgcagagcttcagcaatgtggatgacaggagctatgtgcctgagagctttgagtgccgcctggacaagctgatcctgcacggccagggcgacttccagaagatcctggacacctacagccagcaccacacctctgtgtgtgaggtgtttgaaagtgactgtggcaacaacaagaatgagcagaaggatgccaagacaggagtgtgcatcacagccctgaagacagagatcaagaacatcgacacagtgtccaccacccaggagaagccccactgccagagggacaccggcatcagcagcagcctgatgggcaagaatgtgcagcgggagctgcggcggggcggcagaagaaactggacccacagtgatgccttccgggtgtccctggaccaggatgtggagacagaaacagagcccagcgactacagcaatggagagggcgctgtgttcaacaagagcctgagcggcagccagaccagcagcgcctggagcaacctgagcggcttcagcagcagcgcctcctgggaggaggtgaactaccacgtggatgacagaagtgccaggaaggagcccgggaaggagcacctggtggacacccagtgcagcacagccctgtctgaggagctggagaatgaccgggagggccgggccatgcacagcctgcacagccagctgcatgacctgagcctgcaggagcccaacaatgacaacctggagcccagccagaaccagccccagcagcagatgcccctgacccccttcagcccccacaacaccccaggcatcttcctggcccctggggccggcctgctggagggcgcccctgagggcatccaggaggtgaggaacatgggccccaggaacaccagcgcccacagccggcccagctacagaagtgcctcctggagcagtgacagcggccggcccaagaacatgggcacccaccccagcgtgcagaaggaggaggcctttgagatcatcgtggagttccctgagaccaactgtgatgtgaaggaccggcagggcaaggagcagggcgaggagatcagcgagcggggggccggccccaccttcaaggccagccccagctgggtggaccctgagggggagacagctgagagcacagaagatgcccccctggacttccaccgggtgctgcacaacagcctgggcaacatctccatgctgccctgcagcagcttcacccccaactggcctgtgcagaacccagacagcaggaagagcggcggccctgtggccgagcagggcatcgaccctgatgccagcacagtggatgaggagggccagctgctggacagcatggatgtgccctgcaccaatggacatggcagccaccggctgtgcatcctgcggcagcccccaggccagagagctgagacccccaacagctctgtgtctggcaacatcctcttccctgtgctgtctgaggactgcaccaccacagaggagggcaaccagcccggcaacatgctgaactgcagccagaacagcagcagcagctctgtgtggtggctgaagagccctgccttcagcagcggcagcagcgagggggacagcccctggagctacctgaacagcagcggcagctcctgggtgtccctgcccgggaagatgaggaaggagatcctggaggcccggaccctgcagccagatgactttgagaagctgctggccggcgtgagacatgactggctgttccagaggctggagaacacaggagtcttcaagcccagccagctgcaccgggcccacagcgccctgctgctgaagtacagcaagaagtctgagctgtggacagcccaggagaccatcgtgtacctgggggactacctgactgtgaagaagaagggccggcagagaaatgccttctgggtgcaccacctgcaccaggaggagatcctgggccgctacgtgggcaaggactacaaggagcagaagggcctgtggcaccacttcacagatgtggagcggcagatgacagcccagcactacgtgacagagttcaacaagaggctgtatgagcagaacatccccacccagatcttctacatccccagcaccatcctgctgatcctggaggacaagaccatcaagggctgcatctctgtggagccctacatcctgggggagtttgtgaagctgagcaacaacaccaaggtggtgaagacagagtacaaggccacagaatatggcctggcctacggccacttctcctatgagttcagcaaccacagagatgtggtggtggacctgcagggctgggtgactggaaatggcaagggcctcatctacctgacagacccccagatccacagcgtggaccagaaggtgttcaccaccaactttgggaagaggggcatcttctacttcttcaacaaccagcacgtggagtgcaatgagatctgccaccggctgagcctgacccggcccagcatggagaagccctgcacctag

SEQ ID NO: 143357 - DNA, 1149 bp, Artificial Sequence
  Description of Artificial Sequence: Synthetic coding sequence
atggccctgcagggcatctctgtggtggagctgagcggcctggcccctggccccttctgtgccatggtgctggccgactttggagcccgggtggtgcgggtggacaggcctggcagccgctatgatgtgtcccggctgggccggggcaagaggagcctggtgctggacctgaagcagcccagaggagctgctgtgctgcggcggctgtgcaagagaagtgatgtgctgctggagcccttcagaagaggagtgatggagaagctgcagctgggccctgagatcctgcagcgggagaaccccaggctcatctatgcccggctgagcggcttcggccagagcggcagcttctgccgcctggccggccatgacatcaactacctggccctgagcggcgtgctgagcaagattggccgctctggagagaacccctatgcccccctgaacctgctggccgactttgctgggggcggcctgatgtgtgccctgggcatcatcatggccctgtttgacaggaccaggacaggcaagggccaggtgattgatgccaacatggtggagggcacagcctacctgagcagcttcctgtggaagacccagaagctgagcctgtgggaggccccccggggccagaacatgctggatggaggagcccccttctacaccacctacagaacagcagatggagagttcatggctgtgggcgccatcgagccccagttctatgagctgctgatcaagggcctgggcctgaagagtgatgagctgcccaaccagatgtccatggatgactggccagagatgaagaagaagtttgctgatgtgtttgctgagaagaccaaggccgagtggtgccagatctttgatggaacagatgcctgtgtgacccctgtgctgacctttgaggaggtggtgcaccacgaccacaacaaggagcggggcagcttcatcaccagcgaggagcaggatgtgagccccaggcctgcccccctgctgctgaacaccccagccatccccagcttcaagagggaccccttcatcggggagcacacagaggagatcctggaggagtttggcttcagccgggaggagatctaccagctgaacagcgacaagatcatcgagagcaacaaggtgaaggccagcctgtag

SEQ ID NO: 143358 - DNA, 597 bp, Artificial Sequence
  Description of Artificial Sequence: Synthetic coding sequence
atggccctgcagggcatctctgtggtggagctgagcggcctggcccctggccccttctgtgccatggtgctggccgactttggagcccgggtggtgcgggtggacaggcctggcagccgctatgatgtgtcccggctgggccggggcaagaggagcctggtgctggacctgaagcagcccagaggagctgctgtgctgcggcggctgtgcaagagaagtgatgtgctgctggagcccttcagaagaggagtgatggagaagctgcagctgggccctgagatcctgcagcgggagaaccccaggctcatctatgcccggctgagcggcttcggccagagcggcagcttctgccgcctggccggccatgacatcaactacctggccctgagcggcggcagaaattccatcttcaagttcttctctgtggagaacagcgagattgaatctgtgggcagcaccagcaggacagagcacgtgggctggtggagcaccttcctgtatgacctgcaggacagccgctggggcatccacggctgctggagcaacagaacacctgtgctgcgggctgctgaccagaggacctggaccaaggtgtag

SEQ ID NO: 143359 - DNA, 690 bp, Artificial Sequence
  Description of Artificial Sequence: Synthetic coding sequence
atggccctgcagggcatctctgtggtggagctgagcggcctggcccctggccccttctgtgccatggtgctggccgactttggagcccgggtggtgcgggtggacaggcctggcagccgctatgatgtgtcccggctgggccggggcaagaggagcctggtgctggacctgaagcagcccagaggagctgctgtgctgcggcggctgtgcaagagaagtgatgtgctgctggagcccttcagaagaggagtgatggagaagctgcagctgggccctgagatcctgcagcgggagaaccccaggctcatctatgcccggctgagcggcttcggccagagcggcagcttctgccgcctggccggccatgacatcaactacctggccctgagcggcggcagaaattccatcttcaagttcttctctgtggagaacagcgagattgaatctgtgggcagcaccagcaggacagagcacgtgggctggtggagcaccttcctgtatgacctgcaggacagccgctggggcatccacggctgctggagcaacagaacacctgtgctgcgggctgctgaccagaggagcctcatcccctacttcaacctgtacctgcagttcctgaacatctccatgcagaacctcttcaaggtgcacaccctgctgcggccctgctacttcctgggccagaagtag

SEQ ID NO: 143360 - DNA, 1185 bp, Artificial Sequence
  Description of Artificial Sequence: Synthetic coding sequence
atggccctgcagggcatctctgtggtggagctgagcggcctggcccctggccccttctgtgccatggtgctggccgactttggagcccgggtggtgcgggtggacaggcctggcagccgctatgatgtgtcccggctgggccggggcaagaggagcctggtgctggacctgaagcagcccagaggagctgctgtgctgcggcggctgtgcaagagaagtgatgtgctgctggagcccttcagaagaggagtgatggagaagctgcagctgggccctgagatcctgcagcgggagaaccccaggctcatctatgcccggctgagcggcttcggccagagcggcagcttctgccgcctggccggccatgacatcaactacctggccctgagcggcgtgctgagcaagattggccgctctggagagaacccctatgcccccctgaacctgctggccgactttgctgggggcggcctgatgtgtgccctgggcatcatcatggccctgtttgacaggaccaggacaggcaagggccaggtgattgatgccaacatggtggagggcacagcctacctgagcagcttcctgtggaagacccagaagctgagcctgtgggaggccccccggggccagaacatgctggatggaggagcccccttctacaccacctacagaacagcagatggagagttcatggctgtgggcgccatcgagccccagttctatgagctgctgatcaagggcctgggcctgaagagtgatgagctgcccaaccagatgtccatggatgactggccagagatgaagaagaagtttgctgatgtgtttgctgagaagaccaaggccgagtggtgccagatctttgatggaacagatgcctgtgtgacccctgtgctgacctttgaggaggtggtgcaccacgaccacaacaaggagcggggcagcttcatcaccagcgaggagcaggatgtgagccccaggcctgcccccctgctgctgaacaccccagccatccccagcttcaagagggaccccttcatcggggagcacacagaggagatcctggaggagtttggcttcagccgggaggagatctaccagctgaacagcgacaagatcatcgagagcaacaaggccggcagcaagttctggatcctgtaccccacccacagcaacatccagaagtag

SEQ ID NO: 143361 - DNA, 1002 bp, Artificial Sequence
  Description of Artificial Sequence: Synthetic coding sequence
atggctgctggctgctgcggcgtgaagaagcagaagctgagcagcagccccccatctggcagcggcggcggcggcggggccagcagcagcagccactgcagcggggagagccagtgcagagctggggagctgggcctgggcggggccggcacccggctgaatggcctgggcggcctgaccggcggcggcagcggcagcggctgcaccctgagccccccccagggctgcggcggcggcggcggcggcatcgccctgagccccccacccagctgtggggtgggcaccctgctgagcaccccagctgctgccaccagcagcagccccagcagcagcagcgctgccagcagcagcagccctggcagcaggaagatggtggtgtctgctgagatgtgctgcttctgctttgatgtgctgtactgccacctgtatggctaccagcagcccaggaccccccgcttcaccaatgagccctaccccctgtttgtgacctggaagattggccgggacaagaggctgcggggctgcatcggcaccttcagcgccatgaacctgcacagcggcctgcgggagtacaccctgaccagcgccctgaaggacagccgcttcccccccatgaccagagatgagctgcccaggctcttctgcagcgtgtccctgctgaccaactttgaagatgtgtgtgactacctggactgggaggtgggcgtgcacggcatcagaattgagttcatcaatgagaagggcagcaagaggacagccacctacctgcctgaggtggccaaggagcagggctgggaccacatccagaccatcgacagcctgctgaggaaaggaggctacaaggcccccatcaccaatgagttcaggaagaccatcaagctgacccgctacagaagtgagaagatgaccctgtcctatgcagagtacctggcccaccggcagcaccaccacttccagaatggcatcggccaccccctgcccccctacaaccactacagctag

SEQ ID NO: 143362 - DNA, 633 bp, Artificial Sequence
  Description of Artificial Sequence: Synthetic coding sequence
atggtggtgtctgctgagatgtgctgcttctgctttgatgtgctgtactgccacctgtatggctaccagcagcccaggaccccccgcttcaccaatgagccctaccccctgtttgtgacctggaagattggccgggacaagaggctgcggggctgcatcggcaccttcagcgccatgaacctgcacagcggcctgcgggagtacaccctgaccagcgccctgaaggacagccgcttcccccccatgaccagagatgagctgcccaggctcttctgcagcgtgtccctgctgaccaactttgaagatgtgtgtgactacctggactgggaggtgggcgtgcacggcatccgcatcgagttcatcaatgagaagggcagcaagaggacagccacctacctgcctgaggtggccaaggagcagggctgggaccacatccagaccatcgacagcctgctgaggaagggcggctacaaggcccccatcaccaatgagttcaggaagaccatcaagctgacccgctacagaagtgagaagatgaccctgtcctatgcagagtacctggcccaccggcagcaccaccacttccagaatggaattggccaccccctgcccccctacaaccactacagctag

SEQ ID NO: 143363 - DNA, 891 bp, Artificial Sequence
  Description of Artificial Sequence: Synthetic coding sequence
atggctgctggctgctgcggcgtgaagaagcagaagctgagcagcagccccccatctggcagcggcggcggcggcggggccagcagcagcagccactgcagcggggagagccagtgcagagctggggagctgggcctgggcggggccggcacccggctgaatggcctgggcggcctgaccggcggcggcagcggcagcggctgcaccctgagccccccccagggctgcggcggcggcggcggcggcatcgccctgagccccccacccagctgtggggtgggcaccctgctgagcaccccagctgctgccaccagcagcagccccagcagcagcagcgctgccagcagcagcagccctggcagcaggaagatggtggtgtctgctgagatgtgctgcttctgctttgatgtgctgtactgccacctgtatggctaccagcagcccaggaccccccgcttcaccaatgagccctatgccctgaaggacagccgcttcccccccatgaccagagatgagctgcccaggctcttctgcagcgtgtccctgctgaccaactttgaagatgtgtgtgactacctggactgggaggtgggcgtgcacggcatccgcatcgagttcatcaatgagaagggcagcaagaggacagccacctacctgcctgaggtggccaaggagcagggctgggaccacatccagaccatcgacagcctgctgaggaagggcggctacaaggcccccatcaccaatgagttcaggaagaccatcaagctgacccgctacagaagtgagaagatgaccctgtcctatgcagagtacctggcccaccggcagcaccaccacttccagaatggaattggccaccccctgcccccctacaaccactacagctag

SEQ ID NO: 143364 - DNA, 2862 bp, Artificial Sequence
  Description of Artificial Sequence: Synthetic coding sequence
atgtgcaaccctgaggaggccgccctgctgcggctggaggaggtgttttctgccaccctggcccacgtgaacagcctggtgctgcagcccctgctgcctgctgccccagaccccagcgacccctggggcagagaatgtctgcggctgctgcagcagctgcacaagagcagccagcagctgtgggaggtgacagaggagagcctgcacagcctgcaggagcggctgcgctacccagacagcacaggcctggagagcctgctgctgctgcggggagctgacagagtgctgcaggcccacatcgagtacatcgagagctacaccagctgcatggtggtgcaggccttccagaaggccgccaagagaagaagtgagtactggaggggccagaggaaggccctgcggcagctgctgagcggcgtgagcagcgagggctctgtgggcgccagcctgggccaggccctgcaccagcccctggcccaccacgtgcagcagtatgtgctgctgctgctgagcctgggggacaccatcggggagcaccaccccacccgggagctggtggtgaatgctgtgaccctgtttggaaacctgcagagcttcatgaagcaggagctggaccaggccgtggccacccaggccctgtggcacaccctgcggggccgcctgagagatgtgctgtgcaccccagcccaccggctgctgcaggacagccaggatgtgcctgtgacagtggcccccctgcgggcagagcgggtgctgctgtttgatgatgccctggtgctgctgcagggccacaacgtgcacacctttgacctgaagctggtgtgggtggaccccggccaggacggctgcaccttccacctgctgaccccagaggaggagttctccttctgtgccaaggacagccagggccaggccgtgtggcagtggaaggtgacctgggccgtgcaccaggccctgcacggcaagaaggacttccctgtgctgggcgccggcctggagcccagccagcccccagactgccgctgtgccgagtacaccttccaggccgagggccgcctgtgccaggccacctatgaaggagagtggtgccggggccggccccacggcaagggcaccctgaagtggccagatggaagaaatcatgtgggcaacttctgccagggcctggagcacggcttcggcatccggctgctgccccaggccagcgaggacaagtttgactgctacaagtgccactggagggagggctccatgtgtggctacggcatctgtgagtacagcacagatgaggtgtacaagggctacttccaggagggcctgcggcacggcttcggcgtgctggagagcggcccccaggccccccagcccttccgctacacaggccactgggagcggggccagaggagcggctatggaattgaagaagatggagacagaggagagcgctacatcggcatgtggcaggccggccagagacatggccctggggtgatggtgacccaggccggcgtgtgctaccagggcaccttccaggccgacaagacagtgggccctggcatcctgctgtctgaagatgacagcctgtatgagggcaccttcacccgggacctgaccctgatgggcaagggcaaggtgaccttccccaacggcttcaccctggagggcagctttggaagtggagctggccggggcctgcacacccagggcgtgctggacacagctgccctgcccccagaccccagcagcacctgcaagaggcagctgggcgtgggcgccttccctgtggagagccgctggcagggcgtgtacagccccttccgggactttgtgtgtgccggctgcccccgggacctgcaggaggccctgctgggctttgatgtgcagagcagccgggagctgcggcgcagccaggactacctgagctgtgagaggacccaccctgaggacagcgtgggctccatggaggacatcctggaggagctgctgcagcaccgggagcccaaggccctgcagctgtacctgaggaaggccctgagcaacagcctgcaccccctgggcaagctgctgcggaccctgatgctgaccttccaggccacctacgccggcgtgggcgccaacaagcacctgcaggagctggcccaggaggaggtgaagcagcacgcccaggagctgtgggccgcctaccggggcctgctgcgggtggccctggagaggaagggccaggccctggaggaggatgaggacacagagacccgggacctgcaggtgcacggcctggtgctgcccctgatgctgcccagcttctacagcgagctgttcaccctgtacctgctgctgcacgagagagaagattccttctacagccagggcatcgccaacctgagcctcttcccagacacccagctgctggagttcctggatgtgcagaagcacctgtggcccctgaaggacctgaccctgaccagcaaccagcgctacagcctggtgcgggacaagtgcttcctgagcgccacagaatgtctgcagaagatcatgaccaccgtggacccccgggagaagctggaggtgctggagaggacctatggagaaattgagggcaccgtgtcccgggtgctgggccgggagtacaagctgcccatggatgacctgctgcccctgctgatctacgtggtgtcccgggcccgcatccagcacctgggcgctgagatccacctgatccgggacatgatggaccccaaccacactggaggcctgtatgacttcctgctgacagccctggagagctgctatgagcacatccagaaggaggacatgaggctgcaccggctgcccggccactggcacagccgggagctgtggtag

SEQ ID NO: 143365 - DNA, 903 bp, Artificial Sequence
  Description of Artificial Sequence: Synthetic coding sequence
atggaggacatcctggaggagctgctgcagcaccgggagcccaaggccctgcagctgtacctgaggaaggccctgagcaacagcctgcaccccctgggcaagctgctgcggaccctgatgctgaccttccaggccacctacgccggcgtgggcgccaacaagcacctgcaggagctggcccaggaggaggtgaagcagcacgcccaggagctgtgggccgcctaccggggcctgctgcgggtggccctggagaggaagggccaggccctggaggaggatgaggacacagagacccgggacctgcaggtgcacggcctggtgctgcccctgatgctgcccagcttctacagcgagctgttcaccctgtacctgctgctgcacgagcgggaggacagcttctacagccagggcatcgccaacctgagcctcttcccagacacccagctgctggagttcctggatgtgcagaagcacctgtggcccctgaaggacctgaccctgaccagcaaccagcgctacagcctggtgcgggacaagtgcttcctgagcgccacagagtgcctgcagaagatcatgaccaccgtggacccccgggagaagctggaggtgctggagaggacctacggggagattgagggcaccgtgtcccgggtgctgggccgggagtacaagctgcccatggatgacctgctgcccctgctgatctacgtggtgtcccgggcccgcatccagcacctgggcgctgagatccacctgatccgggacatgatggaccccaaccacactggaggcctgtatgacttcctgctgacagccctggagagctgctatgagcacatccagaaggaggacatgaggctgcaccggctgcccggccactggcacagccgggagctgtggtag

SEQ ID NO: 143366 - DNA, 2862 bp, Artificial Sequence; identical to SEQ ID NO: 143364
  Description of Artificial Sequence: Synthetic coding sequence

SEQ ID NO: 143367 - DNA, 12504 bp, Artificial Sequence
  Description of Artificial Sequence: Synthetic coding sequence
atggagcctgaggacctgccctggccaggagagctggaggaggaggaggaggaggaggaggaggaggaggaggaggaggaggaggccgctgctgctgctgctgccaacgtggatgatgtggtggtggtggaggaggtggaggaggaggccggccgggagctggacagcgacagccactacggcccccagcacctggagagcattgatgatgaggaggatgaggaggccaaggcctggctgcaggcccaccctggccgcatcctgccccccctgagccccccccagcaccgctacagcgagggggagaggaccagcctggagaagatcgtgcccctgacctgccacgtgtggcagcagatcgtgtaccagggcaacagcaggacccagatcagtgacaccaacgtggtgtgcctggagaccacagcccagaggggcagcggagatgaccagaagacagagagctggcactgcctgccccaggagatggacagcagccagaccctggacaccagccagacccgcttcaacgtgaggacagaggacacagaggtgacagacttccccagcctggaggagggcatcctgacccagagcgagaaccaggtgaaggagcccaacagagacctcttctgcagccccctgctggtgatccaggacagctttgccagcccagacctgcccctgctgacctgcctgacccaggaccaggagtttgccccagacagcctcttccaccagagcgagctgagctttgcccccctgcggggcatcccagacaagtctgaggacacagagtggagcagccggcccagcgaggtgtctgaggccctcttccaggccacagctgaggtggccagtgacctggccagcagccgcttctctgtgtcccagcaccccctgattggcagcacagctgtgggcagccagtgccccttcctgcccagcgagcagggcaacaatgaggagaccatcagctctgtggatgagctgaagatccccaaggactgtgacagatatgatgacctgtgcagctacatgtcctggaagaccaggaaggacacccagtggccagagaacaacctggccgacaaggaccaggtgtctgtggccaccagctttgacatcacagatgagaacatcgccaccaagagaagtgaccactttgatgctgcccggagctatggccagtactggacccaggaggacagcagcaagcaggccgagacctacctgaccaagggcctgcagggcaaggtggagagtgatgtgatcaccctggatggcctgaatgaaaatgctgtggtgtgcagcgagcgggtggccgagctgcagaggaagcccacccgggagagcgagtaccacagcagtgacctgaggatgctgaggatgagcccagacacagtgcccaaggcccccaagcacctgaaggccggggacaccagcaagggcggcatcgccaaggtgacccagagcaacctgaagagcggcatcaccaccacccctgtggacagcgacatcggcagccacctgagcctgagcctggaggacctgagccagctggccgtgagcagcctggagaccaccaccggccagcacacagacaccctgaaccagaagaccctggccgacacccacctgacagaggagaccctgaaggtgacagccatccctgagcctgctgaccagaagacagccacccccaccgtgctgagcagcagccacagccaccggggcaagcccagcatcttctaccagcagggcctgcctgacagccacctgacagaggaggccctgaaggtgtctgctgcccctggcctggccgaccagaccaccggcatgagcaccctgaccagcaccagctacagccaccgggagaagccaggcaccttctaccagcaggagctgcctgagagcaacctgacagaggagcccctggaggtgtctgctgcccctggccctgtggagcagaagacaggcatccccaccgtgagcagcaccagccacagccacgtggaggacctgctcttcttctaccggcagaccctgcctgatggccacctgacagaccaggccctgaaggtgtctgctgtgtctggccctgctgaccagaagacaggaacagccaccgtgctgagcaccccccacagccaccgggagaagccaggcatcttctaccagcaggagtttgctgacagccaccagacagaggagaccctgaccaaggtgtctgccaccccaggccctgctgaccagaagacagagatcccagctgtgcagagcagcagctacagccagcgggagaagcccagcatcctgtacccccaggacctggccgacagccacctgcctgaggagggcctgaaggtgtctgctgtggccggccctgctgaccagaagacaggcctgcccaccgtgcccagcagcgcctacagccaccgggagaagctgctggtgttctaccagcaggccctgctggacagccacctgcctgaggaggccctgaaggtgtctgctgtgtctggccctgcagatggcaagacaggcaccccagctgtgaccagcaccagcagcgccagcagcagcctgggggagaagcccagcgccttctaccagcagaccctgcccaacagccacctgacagaggaggccctgaaggtgtccatcgtgcccggccctggggaccagaagacaggcatccccagcgcccccagcagcttctacagccaccgggagaagcccatcatcttcagccagcagaccctgcctgacttcctgtttcctgaggaggccctgaaggtgtctgctgtgtctgtgctggccgcccagaagacaggcacccccaccgtgagcagcaacagccacagccacagcgagaagagctctgtgttctaccagcaggagctgcctgacagcgacctgccccgggagagcctgaagatgtctgccatccctggcctgacagaccagaagacagtgcccacccccaccgtgcccagcggcagcttcagccaccgggagaagcccagcatcttctaccagcaggagtggccagacagctatgccacagagaaggccctgaaggtgtccacaggccctggccctgctgaccagaagacagagatcccagctgtgcagagcagcagctacccccagcgggagaagcccagcgtgctgtacccccaggtgctgagtgacagccacctgcctgaggagagcctgaaggtgtctgccttccctggccctgctgaccagatgacagacaccccagctgtgcccagcaccttctacagccagcgggagaagccaggcatcttctaccagcagaccctgcctgagagccacctgcccaaggaggccctgaagatctctgtggcccctggcctggccgaccagaagacaggcacccccaccgtgaccagcaccagctacagccagcaccgggagaagcccagcatcttccaccagcaggccctgcccggcacccacatccctgaggaggcccagaaggtgtctgctgtgacaggccctggcaaccagaagacctggatcccccgggtgctgagcaccttctacagccagcgggagaagccaggcatcttctaccagcagaccctgcccggcagccacatccctgaggaggcccagaaggtgtcccctgtgctgggccctgctgaccagaagacaggcacccccacccccaccagcgccagctacagccacacagagaagccaggcatcttctaccagcaggtgctgcctgacaaccaccccacagaggaggccctgaagatctctgtggccagcgagcctgtggaccagaccaccggcaccccagctgtgaccagcaccagctacagccagtaccgggagaagcccagcatcttctaccagcagagcctgcccagcagccacctgacagaggaggccaagaatgtgtctgctgtgcccggccctgctgaccagaagacagtcatccccatcctgcccagcaccttctacagccacacagagaagccaggagtcttctaccagcaggtgctgccccacagccaccccacagaggaggccctgaagatctctgtggccagcgagcctgtggaccagaccaccggcacccccaccgtgaccagcaccagctacagccagcacacagagaagcccagcatcttctaccagcagagcctgcccggcagccacctgacagaggaggccaagaatgtgtctgctgtgcccggccctggggacaggaagacaggcatccccaccctgcccagcaccttctacagccacacagagaagccaggcagcttctaccagcaggtgctgccccacagccacctgcctgaggaggccctggaggtgtctgtggcccctggccctgtggaccagaccatcggcacccccaccgtgaccagccccagcagcagctttggagagaagcccatcgtcatctacaagcaggccttccctgagggccacctgcctgaggagagcctgaaggtgtctgtggcccctggccctgtgggccagaccaccggggcccccaccatcaccagccccagctacagccagcaccgggccaagagcggcagcttctaccagctggccctgctgggcagccagatccctgaggaggccctgcgggtgtcctctgcccctggccctgctgaccagaccaccggcatccccaccatcaccagcaccagctacagctttggagagaagcccatcgtgaactacaagcaggccttcccagatggccacctgcctgaggaggccctgaaggtgtccatcgtgtctggccccacagagaagaagacagacatcccagctggccccctgggcagcagcgccctgggggagaagcccatcaccttctaccggcaggccctgctggacagccccctgaacaaggaggtggtgaaggtgtctgctgcccctggccctgctgaccagaagacagagaccctgcctgtgcacagcaccagctacagcaacagaggcaagcctgtgatcttctaccagcagaccctgagtgacagccacctgcctgaggaggccctgaaggtgccccctgtgcccggcccagatgcccagaagacagagaccccatctgtgagcagcagcctgtacagctaccgggagaagcccatcgtgttctaccagcaggccctgcctgacagcgagctgacccaggaggccctgaaggtgtctgctgtgccccagcctgctgaccagaagacaggcctgagcacagtgaccagcagcttctacagccacacagagaagcccaacatctcctaccagcaggagctgcctgacagccacctgacagaggaggccctgaaggtgtccaatgtgcccggccctgctgaccagaagacaggagtgtccacagtgaccagcaccagctacagccaccgggagaagcccatcgtgtcctaccagcgggagctgccccacttcacagaagctggcctgaagatcctgcgggtgcccggccctgctgaccagaagacaggcatcaacatcctgcccagcaacagctacccccagcgggagcacagcgtcatctcctatgagcaggagctgcctgacctgacagaggtgaccctgaaggccatcggcgtgcccggccctgctgaccagaagacaggcatccagatcgccagcagcagcagctacagcaaccgggagaaggccagcatcttccaccagcaggagctgcctgatgtgacagaggaggccctgaatgtgtttgtggtgcccggccagggcgacaggaagacagagatccccaccgtgcccctgagctactacagccggcgggagaagcccagcgtcatcagccagcaggagctgcctgacagccacctgacagaggaggccctgaaggtgtcccctgtgtccatcccagctgagcagaagacaggcatccccatcggcctgagcagcagctacagccacagccacaaggagaagctgaagatcagcacagtgcacatcccagatgaccagaagacagagttccctgctgccaccctgagcagctacagccagatcgagaagcccaagatcagcaccgtcatcggccccaatgaccagaagacccccagccagacagccttccacagcagctacagccagacagtgaagcccaacatcctcttccagcagcagctgcctgaccgggaccagagcaagggcatcctgaagatctctgctgtgcctgagctgacagatgtgaacacaggcaagcctgtgtccctgagcagcagctacttccaccgggagaagagcaacatcttcagcccccaggagctgcccggcagccacgtgacagaagatgtgctgaaggtgtccaccatccctggccctgctggccagaagacagtgctgcccacagccctgcccagcagcttcagccaccgggagaagccagacatcttctaccagaaggacctgcctgacagacacctgacagaagatgccctgaagatcagcagcgccctgggccaggccgaccagatcaccggcctgcagacagtgcccagcggcacctacagccacggggagaaccacaagctggtgtctgagcacgtgcagaggctgattgacaacctgaacagcagtgacagctctgtgagcagcaacaacgtgctgctgaacagccaggctgatgacagagtggtgatcaacaagccagagagcgctggcttcagagatgtgggcagcgaggagatccaggatgctgagaacagcgccaagaccctgaaggagatccgcaccctgctgatggaggccgagaacatggccctgaagcgctgcaacttccctgcccccctggcccgcttccgggacatcagtgacatctccttcatccagagcaagaaggtggtgtgcttcaaggagcccagcagcactggagtgtccaatggagacctgctgcaccggcagcccttcacagaggagagccccagcagccgctgcatccagaaggacatcggcacccagaccaacctgaagtgccggcggggcatcgagaactgggagttcatcagcagcaccaccgtgcgcagccccctgcaggaggccgagagcaaggtgtccatggccctggaggagaccctgcggcagtaccaggccgccaagtctgtgatgaggtctgagcctgagggctgcagcggcaccatcggcaacaagatcatcatccccatgatgaccgtcatcaagagtgacagcagcagtgatgccagtgatggaaatggcagctgctcctgggacagcaacctgcctgagagcctggagagcgtgtctgatgtgctgctgaacttcttcccctacgtgagccccaagaccagcatcacagacagccgggaggaggagggcgtgtctgagagtgaagatggcggcggcagctctgtggacagcctggccgcccacgtgaagaacctgctgcagtgtgagagcagcctgaaccacgccaaggagatcctgagaaatgctgaggaggaggagagccgggtgcgggcccacgcctggaacatgaagttcaacctggcccatgactgtggctacagcatcagcgagctgaatgaagatgacaggaggaaggtggaggagatcaaggccgagctgtttggacatggccgcaccacagacctgagcaagggcctgcagagcccccggggcatgggctgcaagccagaggccgtgtgcagccacatcatcatcgagagccatgagaagggctgcttccgcaccctgaccagcgagcacccccagctggacagacacccctgtgccttccgctctgctggccccagcgagatgacccggggccggcagaaccccagcagctgccgggccaagcacgtgaacctgagcgccagcctggaccagaacaacagccacttcaaggtgtggaacagcctgcagctgaagagccacagccccttccagaacttcatcccagatgagttcaagatcagcaagggcctgaggatgccctttgatgagaagatggacccctggctgtctgagctggtggagcccgcctttgtgccccccaaggaggtggacttccacagcagcagccagatgcccagccctgagcccatgaagaagttcaccaccagcatcaccttcagcagccaccgccacagcaagtgcatcagcaacagctctgtggtgaaggtgggcgtgacagagggcagccagtgcaccggggcctctgtgggcgtcttcaacagccacttcacagaggagcagaaccccccccgggacctgaagcagaagaccagcagccccagcagcttcaagatgcacagcaacagccaggacaaggaggtgaccatcctggccgagggccggcggcagagccagaagctgcctgtggactttgagaggagcttccaggaggagaagcccctggagaggagtgacttcaccggcagccacagcgagcccagcacccgggccaactgcagcaacttcaaggagatccagatcagtgacaaccacaccctcatctccatgggccggcccagcagcaccctgggcgtgaacagaagcagcagccggctgggcgtgaaggagaagaatgtgaccatcaccccagacctgcccagctgcatcttcctggagcagcgggagctgtttgagcagagcaaggcccccagggcagatgaccacgtgaggaagcaccacagccccagcccccagcaccaggactatgtggccccagacctgcccagctgcatcttcctggagcagcgggagctgtttgagcagtgcaaggccccctacgtggaccaccagatgagggagaaccacagccccctgccccagggccaggacagcatcgccagtgacctgcccagccccatcagcctggagcagtgccagagcaaggcccctggggtggatgaccagatgaacaagcaccacttccccctgccccagggccaggactgtgtggtggagaagaacaaccagcacaagcccaagagccacatcagcaacatcaacgtggaggccaagttcaacacagtggtgtcccagagcgcccccaaccactgcaccctggccgccagcgccagcaccccacccagcaacaggaaggccctgagctgtgtgcacatcaccctgtgccccaagaccagcagcaagctggacagcggcaccctggatgagcgcttccacagcctggatgctgccagcaaggccaggatgaacagcgagttcaactttgacctgcacacagtgagcagccgcagcctggagcccaccagcaagctgctgaccagcaagcctgtggcccaggaccaggagagcctgggcttcctgggccccaagagcagcctggacttccaggtggtgcagcccagcctgcctgacagcaacaccatcacccaggacctgaagaccatccccagccagaacagccagatcgtgaccagccggcagatccaggtgaacatcagtgactttgagggccacagcaaccctgagggcacccctgtgtttgctgaccggctgcctgagaagatgaagacccccctgagcgccttcagcgagaagctgagcagtgatgctgtgacccagatcaccacagagagccctgagaagaccctcttcagcagcgagatcttcatcaatgctgaggaccggggccacgagatcatcgagcccggcaaccagaagctgaggaaggcccctgtgaagtttgccagcagcagctctgtgcagcaggtgaccttcagccggggcacagatggccagcccctgctgctgccctacaagcccagcggcagcaccaagatgtactacgtgccccagctgcggcagatcccccccagcccagacagcaagagtgacaccaccgtggagagcagccacagcggcagcaatgatgccatcgccccagacttccctgcccaggtgctgggcaccagagatgatgacctgagcgccaccgtgaacatcaagcacaaggagggcatctacagcaagagggtggtgaccaaggccagcctgcctgtgggggagaagcccctgcagaatgaaaatgctgatgcctctgtgcaggtgctgatcactggagatgagaacctgagtgacaagaagcagcaggagatccacagcaccagggctgtgacagaagctgcccaggccaaggagaaggagagcctgcagaaggacacagctgacagcagcgctgctgctgctgctgagcacagcgcccaggtgggggaccctgagatgaagaacctgcctgacaccaaggccatcacccagaaggaggagatccacaggaagaagacagtgcctgaggaggcctggcccaacaacaaggagagcctgcagatcaacatcgaggagagcgagtgccacagcgagtttgagaacaccaccaggagcgtcttccgcagcgccaagttctacatccaccaccctgtgcacctgcccagcgaccaggacatctgccacgagagcctgggcaagtctgtgttcatgaggcacagctggaaggacttcttccagcaccacccagacaagcaccgggagcacatgtgcctgcccctgccctaccagaacatggacaagaccaagacagactacacccgcatcaagagcctgagcatcaacgtgaacctgggcaacaaggaggtgatggacaccaccaagagccaggtgcgggactaccccaagcacaacggccagatcagtgacccccagagggaccagaaggtgaccccagagcagaccacccagcacacagtgtccctgaatgagctgtggaacaagtaccgggagcggcagaggcagcagaggcagcctgagctgggggacaggaaggagctgagcctggtggaccggctggaccggctggccaagatcctgcagaaccccatcacccacagcctgcaggtgtctgagagcacccatgatgacagcagaggagagaggtctgtgaaggagtggagcggccggcagcagcagaggaacaagctgcagaagaagaagcgcttcaagagcctggagaagagccacaagaacacaggagagctgaagaagagcaaggtgctgagccaccaccgggccggccgcagcaaccagatcaagattgagcagatcaagtttgacaagtacatcctgagcaagcagcccggcttcaactacatcagcaacaccagcagtgactgccggcccagcgaggagagcgagctgctgacagacaccaccaccaacatcctgagcggcaccaccagcacagtggagagtgacatcctgacccagacagaccgggaggtggccctgcacgagaggagcagctctgtgtccaccatcgacacagcccggctcatccaggcctttggacatgagcgggtgtgcctgagcccccggcgcatcaagctgtacagcagcatcaccaaccagcagaggcgctacctggagaagaggagcaagcacagcaagaaggtgctgaacacaggccaccccctggtgaccagcgagcacacccggcggcggcacatccaggtggccaaccacgtgatcagcagtgacagcatcagcagcagcgccagcagcttcctgagcagcaacagcaccttctgcaacaagcagaatgtgcacatgctgaacaagggcatccaggccggcaacctggagatcgtgaatggagccaagaagcacaccagagatgtgggcatcaccttccccacccccagcagcagcgaggccaagctggaggagaacagtgatgtgacctcctggagcgaggagaagcgggaggagaagatgctgttcaccggctacccagaggacaggaagctgaagaagaacaagaagaacagccatgaaggagtgtcctggtttgtgcctgtggagaatgtggagagccgcagcaagaaggaaaatgtgcccaacacctgtggccctggcatctcctggtttgagcccatcaccaagacccggccctggagggagcccctgcgggagcagaactgccagggccagcacctggatggccggggctacctggccggccctggccgggaggccggccgggacctgctgcggccctttgtgcgggccaccctgcaggagagcctgcagttccacaggccagacttcatcagccgctctggagagcgcatcaagaggctgaagctgattgtgcaggagaggaagctgcagagcatgctgcagacagaaagagatgccctcttcaacatcgaccgggagcggcagggccaccagaacaggatgtgccccctgcccaagagggtcttcctggccatccagaagaacaagcccatcagcaagaaggagatgatccagaggagcaagaggatctatgagcagctgcctgaggtgcagaagaagcgggaggaggagaagaggaagtctgagtacaagagctaccgcctgcgggcccagctgtacaagaagagggtgaccaaccagctgctgggcaggaaggtgccctgggactag

SEQ ID NO: 143368 - DNA, 7686 bp, Artificial Sequence
  Description of Artificial Sequence: Synthetic coding sequence
atggagcctgaggacctgccctggccaggagagctggaggaggaggaggaggaggaggaggaggaggaggaggaggaggaggaggccgctgctgctgctgctgccaacgtggatgatgtggtggtggtggaggaggtggaggaggaggccggccgggagctggacagcgacagccactacggcccccagcacctggagagcattgatgatgaggaggatgaggaggccaaggcctggctgcaggcccaccctggccgcatcctgccccccctgagccccccccagcaccgctacagcgagggggagaggaccagcctggagaagatcgtgcccctgacctgccacgtgtggcagcagatcgtgtaccagggcaacagcaggacccagatcagtgacaccaacgtggtgtgcctggagaccacagcccagaggggcagcggagatgaccagaagacagagagctggcactgcctgccccaggagatggacagcagccagaccctggacaccagccagacccgcttcaacgtgaggacagaggacacagaggtgacagacttccccagcctggaggagggcatcctgacccagagcgagaaccaggtgaaggagcccaacagagacctcttctgcagccccctgctggtgatccaggacagctttgccagcccagacctgcccctgctgacctgcctgacccaggaccaggagtttgccccagacagcctcttccaccagagcgagctgagctttgcccccctgcggggcatcccagacaagtctgaggacacagagtggagcagccggcccagcgaggtgtctgaggccctcttccaggccacagctgaggtggccagtgacctggccagcagccgcttctctgtgtcccagcaccccctgattggcagcacagctgtgggcagccagtgccccttcctgcccagcgagcagggcaacaatgaggagaccatcagctctgtggatgagctgaagatccccaaggactgtgacagatatgatgacctgtgcagctacatgtcctggaagaccaggaaggacacccagtggccagagaacaacctggccgacaaggaccaggtgtctgtggccaccagctttgacatcacagatgagaacatcgccaccaagagaagtgaccactttgatgctgcccggagctatggccagtactggacccaggaggacagcagcaagcaggccgagacctacctgaccaagggcctgcagggcaaggtggagagtgatgtgatcaccctggatggcctgaatgaaaatgctgtggtgtgcagcgagcgggtggccgagctgcagaggaagcccacccgggagagcgagtaccacagcagtgacctgaggatgctgaggatgagcccagacacagtgcccaaggcccccaagcacctgaaggccggggacaccagcaagggcggcatcgccaaggtgacccagagcaacctgaagagcggcatcaccaccacccctgtggacagcgacatcggcagccacctgagcctgagcctggaggacctgagccagctggccgtgagcagcctggagaccaccaccggccagcacacagacaccctgaaccagaagaccctggccgacacccacctgacagaggagaccctgaaggtgacagccatccctgagcctgctgaccagaagacagccacccccaccgtgctgagcagcagccacagccaccggggcaagcccagcatcttctaccagcagggcctgcctgacagccacctgacagaggaggccctgaaggtgtctgctgcccctggcctggccgaccagaccaccggcatgagcaccctgaccagcaccagctacagccaccgggagaagccaggcaccttctaccagcaggagctgcctgagagcaacctgacagaggagcccctggaggtgtctgctgcccctggccctgtggagcagaagacaggcatccccaccgtgagcagcaccagccacagccacgtggaggacctgctcttcttctaccggcagaccctgcctgatggccacctgacagaccaggccctgaaggtgtctgctgtgtctggccctgctgaccagaagacaggaacagccaccgtgctgagcaccccccacagccaccgggagaagccaggcatcttctaccagcaggagtttgctgacagccaccagacagaggagaccctgaccaaggtgtctgccaccccaggccctgctgaccagaagacagagatcccagctgtgcagagcagcagctacagccagcgggagaagcccagcatcctgtacccccaggacctggccgacagccacctgcctgaggagggcctgaaggtgtctgctgtggccggccctgctgaccagaagacaggcctgcccaccgtgcccagcagcgcctacagccaccgggagaagctgctggtgttctaccagcaggccctgctggacagccacctgcctgaggaggccctgaaggtgtctgctgtgtctggccctgcagatggcaagacaggcaccccagctgtgaccagcaccagcagcgccagcagcagcctgggggagaagcccagcgccttctaccagcagaccctgcccaacagccacctgacagaggaggccctgaaggtgtccatcgtgcccggccctggggaccagaagacaggcatccccagcgcccccagcagcttctacagccaccgggagaagcccatcatcttcagccagcagaccctgcctgacttcctgtttcctgaggaggccctgaaggtgtctgctgtgtctgtgctggccgcccagaagacaggcacccccaccgtgagcagcaacagccacagccacagcgagaagagctctgtgttctaccagcaggagctgcctgacagcgacctgccccgggagagcctgaagatgtctgccatccctggcctgacagaccagaagacagtgcccacccccaccgtgcccagcggcagcttcagccaccgggagaagcccagcatcttctaccagcaggagtggccagacagctatgccacagagaaggccctgaaggtgtccacaggccctggccctgctgaccagaagacagagatcccagctgtgcagagcagcagctacccccagcgggagaagcccagcgtgctgtacccccaggtgctgagtgacagccacctgcctgaggagagcctgaaggtgtctgccttccctggccctgctgaccagatgacagacaccccagctgtgcccagcaccttctacagccagcgggagaagccaggcatcttctaccagcagaccctgcctgagagccacctgcccaaggaggccctgaagatctctgtggcccctggcctggccgaccagaagacaggcacccccaccgtgaccagcaccagctacagccagcaccgggagaagcccagcatcttccaccagcaggccctgcccggcacccacatccctgaggaggcccagaaggtgtctgctgtgacaggccctggcaaccagaagacctggatcccccgggtgctgagcaccttctacagccagcgggagaagccaggcatcttctaccagcagaccctgcccggcagccacatccctgaggaggcccagaaggtgtcccctgtgctgggccctgctgaccagaagacaggcacccccacccccaccagcgccagctacagccacacagagaagccaggcatcttctaccagcaggtgctgcctgacaaccaccccacagaggaggccctgaagatctctgtggccagcgagcctgtggaccagaccaccggcaccccagctgtgaccagcaccagctacagccagtaccgggagaagcccagcatcttctaccagcagagcctgcccagcagccacctgacagaggaggccaagaatgtgtctgctgtgcccggccctgctgaccagaagacagtcatccccatcctgcccagcaccttctacagccacacagagaagccaggagtcttctaccagcaggtgctgccccacagccaccccacagaggaggccctgaagatctctgtggccagcgagcctgtggaccagaccaccggcacccccaccgtgaccagcaccagctacagccagcacacagagaagcccagcatcttctaccagcagagcctgcccggcagccacctgacagaggaggccaagaatgtgtctgctgtgcccggccctggggacaggaagacaggcatccccaccctgcccagcaccttctacagccacacagagaagccaggcagcttctaccagcaggtgctgccccacagccacctgcctgaggaggccctggaggtgtctgtggcccctggccctgtggaccagaccatcggcacccccaccgtgaccagccccagcagcagctttggagagaagcccatcgtcatctacaagcaggccttccctgagggccacctgcctgaggagagcctgaaggtgtctgtggcccctggccctgtgggccagaccaccggggcccccaccatcaccagccccagctacagccagcaccgggccaagagcggcagcttctaccagctggccctgctgggcagccagatccctgaggaggccctgcgggtgtcctctgcccctggccctgctgaccagaccaccggcatccccaccatcaccagcaccagctacagctttggagagaagcccatcgtgaactacaagcaggccttcccagatggccacctgcctgaggaggccctgaaggtgtccatcgtgtctggccccacagagaagaagacagacatcccagctggccccctgggcagcagcgccctgggggagaagcccatcaccttctaccggcaggccctgctggacagccccctgaacaaggaggtggtgaaggtgtctgctgcccctggccctgctgaccagaagacagagaccctgcctgtgcacagcaccagctacagcaacagaggcaagcctgtgatcttctaccagcagaccctgagtgacagccacctgcctgaggaggccctgaaggtgccccctgtgcccggcccagatgcccagaagacagagaccccatctgtgagcagcagcctgtacagctaccgggagaagcccatcgtgttctaccagcaggccctgcctgacagcgagctgacccaggaggccctgaaggtgtctgctgtgccccagcctgctgaccagaagacaggcctgagcacagtgaccagcagcttctacagccacacagagaagcccaacatctcctaccagcaggagctgcctgacagccacctgacagaggaggccctgaaggtgtccaatgtgcccggccctgctgaccagaagacaggagtgtccacagtgaccagcaccagctacagccaccgggagaagcccatcgtgtcctaccagcgggagctgccccacttcacagaagctggcctgaagatcctgcgggtgcccggccctgctgaccagaagacaggcatcaacatcctgcccagcaacagctacccccagcgggagcacagcgtcatctcctatgagcaggagctgcctgacctgacagaggtgaccctgaaggccatcggcgtgcccggccctgctgaccagaagacaggcatccagatcgccagcagcagcagctacagcaaccgggagaaggccagcatcttccaccagcaggagctgcctgatgtgacagaggaggccctgaatgtgtttgtggtgcccggccagggcgacaggaagacagagatccccaccgtgcccctgagctactacagccggcgggagaagcccagcgtcatcagccagcaggagctgcctgacagccacctgacagaggaggccctgaaggtgtcccctgtgtccatcccagctgagcagaagacaggcatccccatcggcctgagcagcagctacagccacagccacaaggagaagctgaagatcagcacagtgcacatcccagatgaccagaagacagagttccctgctgccaccctgagcagctacagccagatcgagaagcccaagatcagcaccgtcatcggccccaatgaccagaagacccccagccagacagccttccacagcagctacagccagacagtgaagcccaacatcctcttccagcagcagctgcctgaccgggaccagagcaagggcatcctgaagatctctgctgtgcctgagctgacagatgtgaacacaggcaagcctgtgtccctgagcagcagctacttccaccgggagaagagcaacatcttcagcccccaggagctgcccggcagccacgtgacagaagatgtgctgaaggtgtccaccatccctggccctgctggccagaagacagtgctgcccacagccctgcccagcagcttcagccaccgggagaagccagacatcttctaccagaaggacctgcctgacagacacctgacagaagatgccctgaagatcagcagcgccctgggccaggccgaccagatcaccggcctgcagacagtgcccagcggcacctacagccacggggagaaccacaagctggtgtctgagcacgtgcagaggctgattgacaacctgaacagcagtgacagctctgtgagcagcaacaacgtgctgctgaacagccaggctgatgacagagtggtgatcaacaagccagagagcgctggcttcagagatgtgggcagcgaggagatccaggatgctgagaacagcgccaagaccctgaaggagatccgcaccctgctgatggaggccgagaacatggccctgaagcgctgcaacttccctgcccccctggcccgcttccgggacatcagtgacatctccttcatccagagcaagaaggtggtgtgcttcaaggagcccagcagcactggagtgtccaatggagacctgctgcaccggcagcccttcacagaggagagccccagcagccgctgcatccagaaggacatcggcacccagaccaacctgaagtgccggcggggcatcgagaactgggagttcatcagcagcaccaccgtgcgcagccccctgcaggaggccgagagcaaggtgtccatggccctggaggagaccctgcggcagtaccaggccgccaagtctgtgatgaggtctgagcctgagggctgcagcggcaccatcggcaacaagatcatcatccccatgatgaccgtcatcaagagtgacagcagcagtgatgccagtgatggaaatggcagctgctcctgggacagcaacctgcctgagagcctggagagcgtgtctgatgtgctgctgaacttcttcccctacgtgagccccaagaccagcatcacagacagccgggaggaggagggcgtgtctgagagtgaagatggcggcggcagctctgtggacagcctggccgcccacgtgaagaacctgctgcagtgtgagagcagcctgaaccacgccaaggagatcctgagaaatgctgaggaggaggagagccgggtgcgggcccacgcctggaacatgaagttcaacctggcccatgactgtggctacagcatcagcgagctgaatgaagatgacaggaggaaggtggaggagatcaaggccgagctgtttggacatggccgcaccacagacctgagcaagggcctgcagagctag

SEQ ID NO: 143369 - DNA, 1944 bp, Artificial Sequence
  Description of Artificial Sequence: Synthetic coding sequence
atggccgccccagctgggggcggcggcagcgctgtgtctgtgctggcccccaacggccgccgccacacagtgaaggtgacccccagcacagtgctgctgcaggtgctggaggacacctgccggcggcaggacttcaacccctgtgaatatgacctgaagttccagaggtctgtgctggacctgagcctgcagtggaggtttgccaacctgcccaacaatgccaagctggagatggtgcctgccagccgcagccgggagggccctgagaacatggtgcgcatcgccctgcagctggatgatggcagccggctgcaggacagcttctgcagcggccagaccctgtgggagctgctgagccacttcccccagatccgggagtgcctgcagcaccctggaggagccacccctgtgtgtgtgtacaccagagatgaggtgactggagaggccgccctgcggggcaccaccctgcagagcctgggcctgaccggcggcagcgccaccatccgctttgtgatgaagtgctatgaccctgtgggcaagaccccaggcagcctgggcagcagcgccagcgctggccaggccgccgccagcgcccccctgcccctggagagcggggagctgagcagaggagacctgagcaggccagaagatgctgacaccagcggcccctgctgtgagcacacccaggagaagcagagcacccgggccccagctgctgccccctttgtgcccttcagcggcggcggccagaggctgggcggccccccaggccccacccggcccctgaccagcagcagcgccaagctgcccaagagcctgagcagccctgggggccccagcaagcccaagaagagcaagagcggccaggacccccagcaggagcaggagcaggagcgggagcgggacccccagcaggagcaggagcgggagaggcctgtggaccgggagcctgtggaccgggagcctgtggtgtgccacccagacctggaggagcggctgcaggcctggccagctgagctgcctgatgagttctttgagctgactgtggatgatgtgagaagaaggctggcccagctgaagtctgagaggaagaggctggaggaggcccccctggtgaccaaggccttccgggaggcccagatcaaggagaagctggagcgctaccccaaggtggccctgcgggtgctcttcccagacagatatgtgctgcagggcttcttccggcccagcgagaccgtgggggacctgcgggactttgtgcgcagccacctgggcaaccctgagctgtccttctacctgttcatcaccccacccaagacagtgctggatgaccacacccagaccctcttccagccccagctgggggacagagtggcccccttcaccctgggccccagcctgaagcgctgcctgggccctgagcagaggacccggctgcctgtggtgggagatggaggagatgtggacagcggccgcctgctcttctggggccccagccggggccgggccagccccagcacaggccagcccccctgccaccctgtgtgccggcccagcagcccccccagcccccggcccagcagcggggaccccagccgggtgaaggccggccacaagcacgtgggcaccggccgggccaacctcttccctgctgccctggtgcacctgggcgctgaggagcctgctggggtgtacctggagcccggcctgctggagcacgccatcagccccagcgctgctgatgtgctggtggcccgctacatgagcagagctgctggcagccccagccccctgcctgccccagaccctgcccccaagtctgagcctgctgctgaggagggcgccctggtgcccccagagcccatccctggaacagcccagcctgtgaagaggagcctgggcaaggtgcccaagtggctgaagctgcctgccagcaagaggtag

SEQ ID NO: 143370 - DNA, 1662 bp, Artificial Sequence
  Description of Artificial Sequence: Synthetic coding sequence
atggccgccccagctgggggcggcggcagcgctgtgtctgtgctggcccccaacggccgccgccacacagtgaaggtgacccccagcacagtgctgctgcaggtgctggaggacacctgccggcggcaggacttcaacccctgtgaatatgacctgaagttccagaggtctgtgctggacctgagcctgcagtggaggtttgccaacctgcccaacaatgccaagctggagatggtgcctgccagccgcagccgggagggccctgagaacatggtgcgcatcgccctgcagctggatgatggcagccggctgcaggacagcttctgcagcggccagaccctgtgggagctgctgagccacttcccccagatccgggagtgcctgcagcaccctggaggagccacccctgtgtgtgtgtacaccagagatgaggtgactggagaggccgccctgcggggcaccaccctgcagagcctgggcctgaccggcggcagcgccaccatccgctttgtgatgaagtgctatgaccctgtgggcaagaccccaggcagcctgggcagcagcgccagcgctggccaggccgccgccagcgcccccctgcccctggagagcggggagctgagcagaggagacctgagcaggccagaagatgctgacaccagcggcccctgctgtgagcacacccaggagaagcagagcacccgggccccagctgctgccccctttgtgcccttcagcggcggcggccagaggctgggcggccccccaggccccacccggcccctgaccagcagcagcgccaagctgcccaagagcctgagcagccctgggggccccagcaagcccaagaagagcaagagcggccaggacccccagcaggagcaggagcaggagcgggagcgggacccccagcaggagcaggagcgggagaggcctgtggaccgggagcctgtggaccgggagcctgtggtgtgccacccagacctggaggagcggctgcaggcctggccagctgagctgcctgatgagttctttgagctgactgtggatgatgtgagaagaaggctggcccagctgaagtctgagaggaagaggctggaggaggcccccctggtgaccaaggccttccgggaggcccagatcaaggagaagctggagcgctaccccaaggtggccctgcgggtgctcttcccagacagatatgtgctgcagggcttcttccggcccagcgagaccgtgggggacctgcgggactttgtgcgcagccacctgggcaaccctgagctgtccttctacctgttcatcaccccacccaagacagtgctggatgaccacacccagaccctcttccaggccaacctcttccctgctgccctggtgcacctgggcgctgaggagcctgctggggtgtacctggagcccggcctgctggagcacgccatcagccccagcgctgctgatgtgctggtggcccgctacatgagcagagctgctggcagccccagccccctgcctgccccagaccctgcccccaagtctgagcctgctgctgaggagggcgccctggtgcccccagagcccatccctggaacagcccagcctgtgaagaggagcctgggcaaggtgcccaagtggctgaagctgcctgccagcaagaggtag

SEQ ID NO: 143371 - DNA, 1050 bp, Artificial Sequence
  Description of Artificial Sequence: Synthetic coding sequence
atggtgcctgccagccgcagccgggagggccctgagaacatggtgagaattgccctgcagctggatgatggcagccggctgcaggacagcttctgcagcggccagaccctgtgggagctgctgagccacttcccccagatcagagaatgtctgcagcaccctgggggcgccacccctgtgtgtgtgtacaccagagatgaggtgactggagaggccgccctgcggggcaccaccctgcagagcctgggcctgactggaggcagcgccaccatccgctttgtgatgaagtgctatgaccctgtgggcaagaccccaggcagcctgggcagcagcgccagcgctggccaggccgccgccagcgcccccctgcccctggagagcggggagctgagcagaggagacctgagcaggccagaagatgctgacaccagcggcccctgctgtgagcacacccaggagaagcagagcacccgggccccagctgctgccccctttgtgcccttcagcggcggcggccagaggctgggcggccccccaggccccacccggcccctgaccagcagcagcgccaagctgcccaagagcctgagcagccctgggggccccagcaagcccaagaagagcaagagcggccaggacccccagcaggagcaggagcaggagcgggagcgggacccccagcaggagcaggagcgggagaggcctgtggaccgggagcctgtggaccgggagcctgtggtgtgccacccagacctggaggagcggctgcaggcctggccagctgagctgcctgatgagttctttgagctgactgtggatgatgtgagaagaaggctggcccagctgaagtctgagaggaagaggctggaggaggcccccctggtgaccaaggccttccgggaggcccagatcaaggagaagctggagcgctaccccaagaggaggagcctgagcctgagcccccggctggagagcgtggtgcccagccagctgacagccagcagcgccagccgggtgcaggtggtgctgctgccccagccccccaagtag

SEQ ID NO: 143372 - DNA, 981 bp, Artificial Sequence
  Description of Artificial Sequence: Synthetic coding sequence
atggagttcctgtctgagaagtttgccctgaagagcccccccagcaagaacagcgacttctacatgggcgctgggggccccctggagcacgtgatggagaccctggacaatgaaagcttctacagcaaggccagcgctggaaaatgtgtgcaggccttcggccccctgcccagggctgagcaccacgtgcggctggagaggaccagcccctgccaggacagctctgtgaactacggcatcaccaaggtggagggccagcccctgcacacagagctgaacagagccatggacaactgcaacagcctgaggatgagccctgtgaagggcatgcaggagaagggggagctggatgagctgggggacaagtgtgacagcaatgtgagcagcagcaagaagagaagacacaggaccaccttcaccagcctgcagctggaggagctggagaaggtgttccagaagacccactacccagatgtgtatgtgcgggagcagctggccctgaggacagagctgacagaggcccgggtgcaggtgtggttccagaacagaagagccaagtggaggaagcgggagagatatggccagatccagcaggccaagagccactttgctgccacctatgacatctctgtgctgcccaggacagacagctacccccagatccagaacaacctgtgggccggaaatgccagcggcggctctgtggtgaccagctgcatgctgccccgggacaccagcagctgcatgaccccctacagccacagccccaggacagacagcagctacacaggcttcagcaaccaccagaaccagttcagccacgtgcccctgaacaacttcttcacagacagcctgctgactggagccaccaatggacatgcctttgagaccaagccagagtttgaaagaagaagcagcagcattgctgtgctgaggatgaaggccaaggagcacacagccaacatctcctgggccatgtag

SEQ ID NO: 143373 - DNA, 1032 bp, Artificial Sequence
  Description of Artificial Sequence: Synthetic coding sequence
atggaccctgagcactgtgcccccttccgggtgggccctgcccctggcccctacgtggccagcggagatgagcccccaggcccccagggcaccccagctgctgccccccacctgcacccagccccaccccggggcccccggctgacccgcttccctgcctgtggccccctggagccctacctgcctgagcccgccaagcccccagccaagtacctgcaggacctgggccctggccctgccctgaatggaggccacttctatgagggccctgctgaggccgaggagaagaccagcaaggccgccagcttcccccagctgcccctggactgccggggcggccccagagatggccccagcaacctgcagggcagccctggcccctgcctggccagcctgcacctgcccctgagccctggcctgcctgacagcatggagctggccaagaacaagagcaagaagagaagaaacagaaccaccttcagcaccttccagctggaggagctggagaaggtgttccagaagacccactacccagatgtgtatgcccgggagcagctggccctgaggacagacctgacagaggcccgggtgcaggtgtggttccagaacagaagagccaagtggaggaagcgggagagatatggcaagatccaggagggcaggaaccccttcaccgctgcctatgacatctctgtgctgcccaggacagacagccacccccagctgcagaacagcctgtgggccagccctggcagcggcagccctgggggcccctgcctggtgtccccagagggcatccccagcccctgcatgagcccctacagccacccccacggctctgtggccggcttcatgggcgtgcctgcccccagcgctgcccaccctggcatctacagcatccacggcttcccccccaccctgggcggccacagctttgagcccagcagtgatggagactacaagagccccagcctggtgtccctgcgggtgaagcccaaggagcccccaggcctgctgaactggaccacctag

SEQ ID NO: 143374 - DNA, 1236 bp, Artificial Sequence
  Description of Artificial Sequence: Synthetic coding sequence
atgaatgctgagacctgtgtgtcctactgtgagagccctgctgctgccatggatgcctactacagccctgtgtcccagagccgggagggcagcagccccttccgggccttccctggaggagacaagtttggcaccaccttcctgtctgctgctgccaaggcccagggctttggagatgccaagagccgggcccgctacggggccggccagcaggacctggccacccccctggagagcggggccggggcccggggcagcttcaacaagttccagccccagcccagcaccccccagccccagcccccaccccagccccagccccagcagcagcagccccagccccagcccccagcccagccccacctgtacctgcagagaggagcctgcaagaccccaccagatggcagcctgaagctgcaggagggcagcagcggccacagcgctgccctgcaggtgccctgctacgccaaggagagcagcctgggggagcctgagctgcccccagacagcgacacagtgggcatggacagcagctacctgtctgtgaaggaggccggcgtgaagggcccccaggaccgggccagcagtgacctgcccagccccctggagaaggctgacagcgagagcaacaagggcaagaagagaagaaacagaaccaccttcaccagctaccagctggaggagctggagaaggtgttccagaagacccactacccagatgtgtatgcccgggagcagctggccatgaggacagacctgacagaggcccgggtgcaggtgtggttccagaacagaagagccaagtggaggaagcgggagagatttggccagatgcagcaggtgaggacccacttcagcacagcctatgagctgcccctgctgaccagggctgagaactatgcccagatccagaaccccagctggctgggcaacaacggggccgccagccctgtgcctgcctgtgtggtgccctgtgaccctgtgcctgcctgcatgagcccccacgcccaccccccaggcagcggggccagctctgtgacagacttcctgtctgtgtctggagctggcagccacgtgggccagacccacatgggcagcctgtttggagctgccagcctgagccctggcctgaatggctatgagctgaatggagagccagacaggaagaccagcagcattgctgccctgaggatgaaggccaaggagcacagcgctgccatctcctgggccacctag

SEQ ID NO: 143375 - DNA, 630 bp, Artificial Sequence
  Description of Artificial Sequence: Synthetic coding sequence
atgaggagcaccatcctgctcttctgcctgctgggcagcaccaggagcctgccccagctgaagccagccctgggcctgccccccaccaagctggccccagaccagggcaccctgcccaaccagcagcagagcaaccaggtgttccccagcctgagcctcatccccctgacccagatgctgaccctgggccctgacctgcacctgctgaacccagctgctggcatgaccccaggcacccagacccaccccctgaccctgggcggcctgaatgtgcagcagcagctgcacccccacgtgctgcccatctttgtgacccagctgggcgcccagggcaccatcctgagcagcgaggagctgccccagatcttcaccagcctcatcatccacagcctcttccctgggggcatcctgcccaccagccaggccggggccaacccagatgtgcaggacggcagcctgcctgctggaggagctggggtgaacccagccacccagggcaccccagctggccgcctgcccacccccagcggcacagatgatgactttgctgtgaccaccccagctggcatccagaggagcacccacgccatcgaggaggccaccacagagagcgccaacggcatccagtag

SEQ ID NO: 143376 - DNA, 627 bp, Artificial Sequence
  Description of Artificial Sequence: Synthetic coding sequence
atgaggagcaccatcctgctcttctgcctgctgggcagcaccaggagcctgcccctgaagccagccctgggcctgccccccaccaagctggccccagaccagggcaccctgcccaaccagcagcagagcaaccaggtgttccccagcctgagcctcatccccctgacccagatgctgaccctgggccctgacctgcacctgctgaacccagctgctggcatgaccccaggcacccagacccaccccctgaccctgggcggcctgaatgtgcagcagcagctgcacccccacgtgctgcccatctttgtgacccagctgggcgcccagggcaccatcctgagcagcgaggagctgccccagatcttcaccagcctcatcatccacagcctcttccctgggggcatcctgcccaccagccaggccggggccaacccagatgtgcaggacggcagcctgcctgctgggggcgccggcgtgaacccagccacccagggcaccccagctggccgcctgcccaccccatctggaacagatgatgactttgctgtgaccaccccagctggcatccagaggagcacccacgccatcgaggaggccaccacagaaagtgccaacggcatccagtag

SEQ ID NO: 143377 - DNA, 2256 bp, Artificial Sequence
  Description of Artificial Sequence: Synthetic coding sequence
atgcctgccctgggctgggccgtggccgccatcctgatgctgcagacagccatggccgagcccagccctggcaccctgcccaggaaggccggggtcttcagtgacctgagcaaccaggagctgaaggctgtgcacagcttcctgtggagcaagaaggagctgcggctgcagcccagcagcaccaccaccatggccaagaacacagtgttcctgattgagatgctgctgcccaagaagtaccacgtgctgcgcttcctggacaagggggagcggcaccctgtgcgggaggcccgggctgtgatcttctttggagaccaggagcaccccaacgtgacagaatttgctgtgggccccctgcccggcccctgctacatgagggccctgagcccccggcccggctaccagagctcctgggccagccggcccatcagcacagcagaatatgccctgctgtaccacaccctgcaggaggccaccaagcccctgcaccagttcttcctgaacaccaccggcttctccttccaggactgccacgaccgctgcctggccttcacagatgtggccccccggggcgtggccagcggccagaggaggtcctggctgatcatccagcgctacgtggagggctacttcctgcaccccaccggcctggagctgctggtggaccacggcagcacagatgctggccactgggccgtggagcaggtgtggtacaacgggaagttctacggcagccctgaggagctggccaggaaatatgcagatggagaggtggatgtggtggtgctggaggaccccctgcccggcggcaaaggacatgacagcacagaggagcccccactcttcagcagccacaagcccaggggggacttccccagccccatccacgtgtctggcccccggctggtgcagccccacggcccccgcttccggctggagggcaatgctgtgctgtatggaggctggagctttgccttccggctgcggagcagcagcggcctgcaggtgctgaatgtgcactttggaggagagcgcatcgcctatgaggtgtctgtgcaggaggccgtggccctgtatggaggccacaccccagctggcatgcagaccaagtacctggatgtgggctggggcctgggctctgtgacccatgagctggcccctggcatcgactgcccagagacagccaccttcctggacaccttccactactatgatgctgatgatcctgtgcactacccccgggccctgtgcctgtttgagatgcccactggagtgcccctgcggcggcacttcaacagcaacttcaagggcggcttcaacttctacgccggcctgaagggccaggtgctggtgctgcggaccaccagcacagtgtacaactatgactacatctgggacttcatcttctaccccaacggggtgatggaggccaagatgcacgccaccggctacgtgcacgccaccttctacaccccagagggcctgcggcacggcacccggctgcacacccacctgattggcaacatccacacccacctggtgcactacagagtggacctggatgtggccggcaccaagaacagcttccagaccctgcagatgaagctggagaacatcaccaacccctggagccccaggcaccgggtggtgcagcccaccctggagcagacccagtacagctgggagcggcaggccgccttccgcttcaagaggaagctgcccaagtacctgctcttcaccagcccccaggagaacccctggggccacaagaggacctaccgcctgcagatccacagcatggctgaccaggtgctgcccccaggctggcaggaggagcaggccatcacctgggcccgctaccccctggccgtgaccaagtaccgggagagcgagctgtgcagcagcagcatctaccaccagaatgacccctggcacccccctgtggtgtttgagcagttcctgcacaacaatgaaaatattgaaaatgaagacctggtggcctgggtgacagtgggcttcctgcacatcccccacagcgaggacatccccaacacagccaccccaggcaacagcgtgggcttcctgctgcggcccttcaacttcttccctgaggaccccagcctggccagccgggacacagtgattgtgtggccccgggacaatggccccaactacgtgcagcgctggatccctgaggaccgggactgcagcatgcccccacccttctcctacaacggcacctacagacctgtgtag

SEQ ID NO: 143378 - DNA, 2313 bp, Artificial Sequence
  Description of Artificial Sequence: Synthetic coding sequence
atgcctgccctgggctgggccgtggccgccatcctgatgctgcagacagccatggccgagcccagccctggcaccctgcccaggaaggccggggtcttcagtgacctgagcaaccaggagctgaaggctgtgcacagcttcctgtggagcaagaaggagctgcggctgcagcccagcagcaccaccaccatggccaagaacacagtgttcctgattgagatgctgctgcccaagaagtaccacgtgctgcgcttcctggacaagggggagcggcaccctgtgcgggaggcccgggctgtgatcttctttggagaccaggagcaccccaacgtgacagaatttgctgtgggccccctgcccggcccctgctacatgagggccctgagcccccggcccggctaccagagctcctgggccagccggcccatcagcacagcagaatatgccctgctgtaccacaccctgcaggaggccaccaagcccctgcaccagttcttcctgaacaccaccggcttctccttccaggactgccacgaccgctgcctggccttcacagatgtggccccccggggcgtggccagcggccagaggaggtcctggctgatcatccagcgctacgtggagggctacttcctgcaccccaccggcctggagctgctggtggaccacggcagcacagatgctggccactgggccgtggagcaggtgtggtacaacgggaagttctacggcagccctgaggagctggccaggaaatatgcagatggagaggtggatgtggtggtgctggaggaccccctgcccggcggcaaaggacatgacagcacagaggagcccccactcttcagcagccacaagcccaggggggacttccccagccccatccacgtgtctggcccccggctggtgcagccccacggcccccgcttccggctggagggcaatgctgtgctgtatggaggctggagctttgccttccggctgcggagcagcagcggcctgcaggtgctgaatgtgcactttggaggagagcgcatcgcctatgaggtgtctgtgcaggaggccgtggccctgtatggaggccacaccccagctggcatgcagaccaagtacctggatgtgggctggggcctgggctctgtgacccatgagctggcccctggcatcgactgcccagagacagccaccttcctggacaccttccactactatgatgctgatgatcctgtgcactacccccgggccctgtgcctgtttgagatgcccactggagtgcccctgcggcggcacttcaacagcaacttcaagggcggcttcaacttctacgccggcctgaagggccaggtgctggtgctgcggaccaccagcacagtgtacaactatgactacatctgggacttcatcttctaccccaacggggtgatggaggccaagatgcacgccaccggctacgtgcacgccaccttctacaccccagagggcctgcggcacggcacccggctgcacacccacctgattggcaacatccacacccacctggtgcactacagagtggacctggatgtggccggcaccaagaacagcttccagaccctgcagatgaagctggagaacatcaccaacccctggagccccaggcaccgggtggtgcagcccaccctggagcagacccagtacagctgggagcggcaggccgccttccgcttcaagaggaagctgcccaagtacctgctcttcaccagcccccaggagaacccctggggccacaagaggacctaccgcctgcagatccacagcatggctgaccaggtgctgcccccaggctggcaggaggagcaggccatcacctgggccaggacagagggcggccagccccgggccctgagccaggccgccagccctgtgcccggccgctaccccctggccgtgaccaagtaccgggagagcgagctgtgcagcagcagcatctaccaccagaatgacccctggcacccccctgtggtgtttgagcagttcctgcacaacaatgaaaatattgaaaatgaagacctggtggcctgggtgacagtgggcttcctgcacatcccccacagcgaggacatccccaacacagccaccccaggcaacagcgtgggcttcctgctgcggcccttcaacttcttccctgaggaccccagcctggccagccgggacaccgtcatcgtgtggccccgggacaatggccccaactacgtgcagcgctggatcccagaagatcgggactgcagcatgcccccacccttctcctacaacggcacctacagacctgtgtag
